United States Patent 6,812,339 (POLYMORPHISMS IN KNOWN GENES ASSOCIATED WITH HUMAN DISEASE, METHODS OF DETECTION AND USES THEREOF) - sequence listing, part 28

SEQ ID NO: 13046 - DNA, 28555 bp, Human
  misc_feature (1)...(28555): n = A,T,C or G
tttgcacacgaggttctctttgaagcagagccataaggtacaattattctagaacaaggtgggcaaactacagtcctccgactaaatctaacccaccacatgtttttgtatgaccctcgagctgagaatggtttttccgttttcaagtgatagaaaaaaaaaatcaaaagattttgtgacccgtgaaaacgattttagtgtctgtagttttatcggaacgcagccaaatgcatccatattttccatggctgctttgcgctgcaaagcgacagagtcgagcagttgcccccaaagcctaaaatatttactatctcggtccttttagaaaaagtcttgccaactaatgtcctagaatatgagggctgtattgcttaaacacccttccaactctcttccctctctagccaccccctcagccttaggcactaacaagattccttgacccagaatggggggagggcgttataataatgaacggtattgtatcggaaacaacacagtaaatatctacagaagggaatgtgactggttctgccactgactaacgtctgggtttgcgtcccggtcagaaaagtgggcatgacagcggcatctgcaagatagcatctgagcatgaaggcacttggaaaggtatcaaggcagcaaatgttccgggggtgcttttgcaagaggagcctctcccggagctggacgtacacttcggttccctttgcacgcaggcaccttggtcgcctcccccaactccgtcccctctgctcctggccctcattttcttctatttcccttttggccttgcagccagctttctcctcccccgacacactcctcaggggctatgaagttcctgagcagagcagggctcaggtaagcaggcccagggtagttcagccctgctctctccagctccgccagcttggggtggggtcgcgctgggacccctgcaggtgacaaaaatgactcagcaggggccggggctgggatgagaaaggaacgccagtgcagggacaaaatcccctgaagcgcgaagaggccgcaaaccatcatcttaaggacccaaacatcgaacaaattaaaatgtaacagtgtaaatcggcttcggccgccggcgcgctgccagcaggctgcacatttagcctaacagggcgcgccggcggcttttgcaggcagaaaacgcccgcggctctccaaaagctctcctccgtctgagaccagccccacctcggcccgaccgcgcaggaaaggccagtcggtggaggagaacatttcaggggtgcagagaattgcatgtccgtgattatcagggagactttgaaggcacagtaatctctcgagaacaggaaccattttaccctcttgctctgagattttgcttggctaagcggcggccgtcccttttccccctcttagccccaccaccgctgccgctacaagcaaccacgccccgtgttcccaaggttcgtgccccgggcctctggtactcatctcatccggccatcgcgcctccatcatttcgccctcgttttttcctattctnnnnnnnnnnnnnnnnnnnntccgggggttgctggggtcctcaggcctatggctgccgaggcgggcgtcgtgggagctggggcctcccctgatggggattggagagaccaggcctgtgggcttctgctacacgtgcatttgtcttcccgactgggtcgcgcagcccctgtacgtacaggtcgtcatcttagaacaggtgcgaacagctgtaacagggtaaacaatttccatgtccgtgtaattgactacccaacatggtgtacgcagggggtattgatctcaatggaaaaaataggcttcctgattgttagtattttctccaccttctggaagagcagttagttgtccgtgtccaaattagaggtaaaaggaaagagtacatgaggtgtggccatcttgaggtgacctccaatttctgactttgatctatctcagccacttaatcgtgtgggctttctccaaatttcagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaagtaagggtttctggcaacttttattttgtttaaatttaactgtcgttctgaatttcctagttttggcgttttatgcatagaacataagtatgtaatcagcccttgcatgaggtggcaggtggtttttattttcaaaacttacgtgatttgtgggatgatttctggtgtatagtgtggtggtaaaaggggagaaagaagctgttgtgagattaatcgtgtttggaggaagcactgaatatatttgacatttcctgggcttgaatgtagagcagcatctttctgggcccaaactaatgcgtttctttaaaactttactgaaaaatagaatatttacggaaaagttcacacatcttaagtgttgtatggcttgataaatttttacaaagtgaacacacgtaacagtcatccaagataaatacattttaattggtaaagggaaaaagaccttgtcaacaattgaccaaagaaaagatgttatcggcttatggaatacactttgagattgctgttagtcttcataagagtattcttttctgttacatctgcagtttctctggtaataattgctggcatttattgagcactcagaacagggcctggcacatctgaagaatctacgtcctgttgtttgttgtaatcctcataatagtactatgctgtaggtacttttcatcatccttgttttactgataaggaaactgggagtgagagtttaagtgccatcccaagatcacacagctggtccctgcattagactgcctttctcattcacttgcaccttttctagtaggaacttgaccatgtacttttaaagtgtattaaatatggggtcaggcacagtggtttatactcctgtaatcctagtgctttggaaggttagcttgagctcaggagttcaaggctgcagtgagccatgattgcgccactgcattctagcttagccaacagagtgagaccgtgtctctcaaagaaacaaaaaacaagcatcttaaatttgggtgttgcggacatataatttaaagaggattaaatgaaactctaacctaaaaagaggattttgcaacaagttataaaaataataagctaattttggctgggtgcggtggctcacgcctgtaatcgtagcacttcgggaggccgaggcaggcggattgcctgagctcaggagttcaaaaccagcccaggcaacaaggtgaaatcccatctctactaaaataccaaaaaaaaaaaaaaaccgggcgtggcagcgtgtacctgtagtcctagctacaggctacagggaggcagaggcaggagaattgcttgaacctgggaggcggaggttgcagtgagccaacatcgcaccactgcactccagcctgggcgagagcgagactccatctcttaaaaataaaaataattattataataataatctaatgtatataaaactgctcttacagtggccgggttctccatatgcaaacattgatttctatacagataggaatttccactaggcttcccaaaaatctaaatataaatgtacagatgtgggaagagtagagaagaactaaatgatggagacttggaagcattgacgtttacagccacaacagattgaaaaatagattaagcatcatatactcgggtattcaagttctggtttggagcatcgtgtgcatttgcctctttggtctgttaagcagatttaaaatgtattaactaaatttaccttttgggggatctttttgacccactgtaacataatagaaaacagcaggggctttaaacttagagacctgggttaaaatcatgcccctacttcttagcttcatgaactggggccgtgttgtctgggctgtaaatggagatgttggtcatactgactacctacatttgagggaatgaaataagatcatgcatgttaaagtgcctggtgcagcataagtacacggtaagtggtgactgatgctgattctcccaccccttcctgttcagaaataatttgtcaggattgaaatagctctgtttcttcatttggatttcaatgaaagctacttgctgaagttttttttaaaaaaatgttacctataatatgtaatacttaggaatgtaacaaaatgctttaattaaattatttaatgtgtatcatggtgttctttgtatacaaagctgttgtgggattgggttgtgggatgtgcagtggcttagagaatgtaagaaaatgccaagcagcctgcattcttggatgttgaggattgttgtgtggtgctttgcagggttcagtttggggtataaagggactgtgttttatcaccatacagaacagtaaaaatgttgactattctcaatgcctgactctgaggaacaagatcctactccacctcataggcctttcttctgctgacttacaacatgcttcataacgattacttggactttcttagctattgtccttcaattgagttaggtaattgtccaaataattgatttggctggctggcttgctttcttgctttctttctttctttctttcttttttttttttttttttttttttttttttttttgagacagtctcgctctgtctcccaggctggagtgcagtggcaccatcttggctcactgcagcctccacctcccgggttcaagcgattctcctgcctcagcctcctgagtagctgggattacaggtttgtgccaccacacccagctaattgttgtatttttggtaaagacagggtttcactatgttggtcaggctggtctcaaactcctgacctcgtgatccgcccgcctcggcctcccagagtgctgggattacaggtgttgatttggcttttaaaaggttttatttaagtatctctaagaaatttgttttaattagatagttatttcatatctcttgttgaataatgtcttaaatatattgagactaacttactgtctacctaaaaagctttgtaatttttcaaattcaggaagtataaaaggacatagagtgaagaataagtcccctttccacatcccttactgtcctacttcctttccccagtcattgttttcaatttcctaacccatccttgccagcgtgtagaagtgcatacctgtatcttcattttttatggtagcaagttcttcacttgagtttgtcagtaagagtatgtattggagattttcctgtcagcatgcttggatatgcttgttcttttcaagagtgccatagaattttgtttatggatacactgtgtaatgtatgataccagttccttgctgatggatacttagttattttcagtctttttccttctataaacaatactgctgagaataatcttgcaataggccagatttatgtgatgcttggctaaatttcctagtggtagttactggggtcaaaggattctgcactgaaaatgaataggctttcttaaccattagtccttctgcagcctttaggtacatccagtattggaggaaaatagtgtcatattgattagtttaggaaaacaggctgtgttttaatgatggaggtgaagggatttctagtaaaaagaaaagtcctcatatgatgatcaagttggggaaaactggaataattaaatttgagtccagagggatttttaagctcctccagtccgtcttgggacagtgttccttagaaagggcctgtgataaactgacctacctgttattttttacttgttggtcttagttttcctgcttaactccacaaaaaacaagtgacttttttcctttgatgacagtaccagcattgctctgtggtgccttctttctctcaagcattattatttctctttttaaatatttatttaaatttttgttttttgtttttgtgttttttgttttttgtggagatgggattttgccacgttgcccaggctggtctcgaagtcctgggttcaagcaatccgcttgccttggcttcccaaagtgctgggattagaggcgtgagccaccacatccggccaaatatttattctttttttttttttttttttttttttttgagacagggtcttgctatgttgcccaggctggacatgaactcctaggctcaagcagtcttccgtagtagccctagtagctggtactacgggtgcacagcactgcacctggcttaccctttcattttaagccactattccctgtaaaggtttgatttttatccaagtcctcataaagtatgttgcttagagcctaattttaatggttttactggttaaaaataagtgggcaagccagatatggtggcacacatctgtagtcccagctgctgaagaggttgatgtaggaggatcaacttgagtccaggagttggaggccagcctgggcaacatagtgagaccttgtctcttaaaaaaagaaaaggtcgggggtagggggcacatgtgctcatgtgcattgccccctacatacatataaagaccacctaagatggaattaattaattttttgatagccacatcatattcttggcccactgtgcatgtatcaaccaagacccatgttttctttcttttttttttttttttttttttttttggagacggagtttcactcgttgcccaggctggagtgcaatggtgtgatcttgagatcttgactcaccacaacctccacctcccaggttcaagtgattctcctgcctccgcctcctgagtagctgggattacaggcatgcgccaccatgcccggctaattttgtatttttaatagagatggggtttctccacgttggctaggctggtctcgaactcctgacctcaggtgatccgcctgccttggcctcctaaagtgctgggattacaggcgtgagccacggcgcccatttgtctttttttcaaacacgttgctattgcttagtcacggctgccttactctgttttggggggagtgtgtctgtgtgtgtgtgtgtctcttctccatgtgcacacacttttttaccgtaagccaaattttggtaaaattgcatcttgtattttcttattactaaattacttgcctagaagtaatcttcaatctttttagaaaaaaaaaaaaaattgaatcctttgtgcagctgaaatttagaaacagataaatggcctaacttgtcttgtgttagggcctagacccctacttctcagtcctcttcattgaagtgggaccatggagcacagttgaaaattgtattctagataatacaaatgggaaagcctttttaatagatactgatgcaaaaatcactgctcggaccaaggtgccaagaggtttgggcaagttcttcagcctcaaggtgtttccacagaacaaggtaacaaagatacctcggtaaaattgagaatgttcgtttcataaacttaggtatcataaacgtcagtgagtttcacatcatgccatttgcacttatagcctattttattcagtgaagaaactgaggccccagggaggttgtgttttaagcaactgcattttagtttgatccaggatttaagctaagtttttttgattcaacactttctgtccatactaccttgtagaatttcttattgggaaataagaaacatctagtgtataagatatttttaggtgggaagaagatttctttaggtgggaagttgtgatttatgagtgtggggattgttggtggattcctgtgtagatgtttgtctgtgtttactgagttgggcctaccttccccggagtgctgctctataaaaggtagtgttcacgctgataattgaggcacaggaggatggctctttgggaaagaagcaagccctctgcatgttgtagctagaatattttcttatatttgcatatgtggggattgtaaagttggtaaccagagggggagaagatacacagttgatgctaagtatatatttgctaaagaaatatgaatgtattttgagggaactagactgaatttgttagcaattggagatttcttgtaggattagtgtgacttattttctttcttaaacagacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggtaggtatatcatatattccaatattggtgtcaaagggaaaatgtctctttcaaagcatatgctattaaaactatactattagcttttggcccagtaatttaacttctaggactttattctacagaacttcccacccacatgtgcacaaggattttagtcgtaattgcagaattgaaaaattaggatcaaccttgtaacccagatgttggttcatagaaagttggttaagcacatggtatgtttgaaatactactcagcaattaataagaaaggccaggtgccatggctcacgcctataatcccagcactttgggaggccaaggtgggaggattgcttgaactcaggagttcaagcccagtctgaaaaacacagacctcatttctaccaaaaatttaaaaaaaaaatttttttttttaatgagaaaaatctgtaggcactggtataggaaggtatccaagataaattaagtgactaactgctatgtgtaattacagtattccactttggtaaaagtaatatgtgttggtgtgtgcaatgggtattttttgtttgaggagagaggcagtagtggtagggttaattcaggaatctgttggctgcttttttctttttttaatttgtcaaacatatactctcctgttttggtattcccatgaccaccccaagtttggtgattttgctaggactcccaagagcaaattatacttgtggctaaagtttgttacagtaaagaacacaaaagcagcaggaaaaagatgtacatcggcaagttcagggaggtctggcacaagtcttgtccaaggccacacaggatgtgtcttccggcagcaaactgcagggacatgtgtgaaatatctctgctcagggaagcctgtttgggtcttggggtctgaggctttcttgggggactagttgcataggcacatcctgctgacaaccagccacagcaactgtaacttgaggaccccagtaatacaaactgaggacccagtaataaaagaaggtacgtgtcatcaatcttgatatctgcagagtaaccctgacaaactggtacaacgcggtccattgctccaggtgcacaccacaaaatcatcagttcatcagtgacagaaagaacattctgaggtgcatgttcccaggagttagccaagggtcagtaatagggtcccagtgttcctcagagactccagggctaagcacccagactgctgtattaactctttcttcacagtcccaaatggcttaacgctattagcactttctaatatgtgccttagggtttttttcttattgaaaataaaatactggccaggtgcagtggctatacccatagtcccaacacttcgggaggccaaggcaggaggaacgcttgagcctgggagtttaagaccactcagggcacacagtgagacattgtctctatcaaaaaataaaattaaaaatcagccatgtgtggtggcgcatgcctgtagtcctagctacttgggaggctgaggatcgcttgagcccaggagttcgaagctgtagtgaactaggatcacaccactgcactccaccctgagcaacagagcaagatcctgtctcaaaaatactacattctctagtgtagtgaaactgctaggttgtatggtgtattcattgtcaacttcatagaaaactattttccaaagtgatttacccagtttactactcccacaatttactgttcattccccgacaactgtatgcattatttctttaaatattggggtttttttgtgttttgtttttgtttgttatgaggcagggtctcgctcagtcgcccaggctggagtgcagtggtgcaatctcggctcactgcaacctccacctcctgggttcaagtgattctcgtacctcagcctcaagagtagctgggattacaggcgtccaccaccatgcccggctaatttttgtatttttagtagagactgggttttgtcatgttggccaggcaggtctcgaactcctggcctcaagtgattcgcctgcctaaacttcccaaagtgctggaattacaggcatgagccaccactcccggcctgaatatattgtaatcagaaatttttaaatggcttttagccctgaagtatgtatttaccgggcttgcagtttaacagtctctgcataatgatgttaatatattattaaagttacacatccagtgtattctaacaagtagctgaaataattcagttaatacctttgttaatattcagtatatatattttttttttctttttttttttcttttttttttcgagacgaagtttcgctctgtcacccaggctggagtgcagtggtgtgacctcagctcactgcaacctctgcctcctgggttcaagcgatttcccgagtagctgggactacaggcgcccgccaccacacctagctaattttttgtatttttagtagagacggggtttcaccttgttagccaggatggtcttgctttcctgacctcatgatccgcacgccttggcctcccaaagtgccgggattacaggcatgagccaccacgcccggccaatattgagttacattttttaatggatattatcattaagacagtgacttttcaaaattttaagtttgagaaaacaaaactctgtgttcaaagtaaatcctacttggaagccccgcccccccccctttttttttaaaggagagctcttcaggttgttttagctaaaggaatcaggaaacttgagtatctttgtagcagaagggttagagccactggagtccatggaatgggatgttgaaggtcaaagtggagcagatttggagcagtctcaggagggaggagacgattggatcaggaggggtcttagcatgccgaggcacatttcttccattgacaccatggaacagaaggtgctacgaggaaaaaggatccttttgcatgtggtcacatgagagtagtgggtagaggagctttggagtaatcgtggatttgagatacggttttttcaaccacactgaaatagtaagctatgtttgcttcagagaggaacggctagatactgatattaagacatggaagcgagtgttcattaagcattccacatagaaggagctgcctggaactgagaaatggtttgctccttttggtggttgctccaggccccggtctattttacttcttacctgtctggctccagtaggcatttgtgttagttgtccctgacctgagacacagggtgagctaaaatggaatgtgcaaagaaaaggcaatataggtcaggaagaataacacaattgtaatgtgaaccctcctatctttttaagcgtcagcaactaattcaggtttttttatctatgagcacaaaaaagaatgttcttgtttgctgtatttgcttagatgttctctacttgtattctttctgctaacatgttgctacttcttggaagttaccgtactttttatatgactttgttactttacaaggcctttttcatgattatttaatactatagtcttattcacacaccagatgggcggagaggttaaccttggcactgcactagcagttaaaccaagtatgctggcagggccaatgtatgtgtgtttagggacaggtaggggttagcgtgggtttctgattgatttgaggatgcttctgacttcagactcaaagggtgttcatactgtggagggttaaaacctttcctgttttgatgaatcctaaaataagatgctaattcagtgcagtacttacagtgagttgtatttgaactaaaaagctattggtctgcttattatatggttacttgaaatttcagtgaataactatatcatcttcataactgaaagaggacagttgttttagatccaaggtggaactgaattaagttgcataaggcagctaccaatattttccagtgcaaatgggctttaagaataaattgatgtggcaaatgaacccacatttttgggttttctctatgcatgtttctgtctttgtcttgtcagtttgtgttgtattctgccaggtcaaaatctgttaggttgattgaactaagtgatttgtgaattttaatcctgagtgtgtgtgtgtgtgtttctttctcctcacattagaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccaggtatgtaataatagagttaggtcattacttgagcagttttcttgattcaaactggtaatgtttttaaggtcaaagtagcatactttataatatttaaaggtttaaaaattgctttgggggtcccataaccatcctcaagttcagggatttgccagaactacctaaaagcagcttatactaacagctaaagtttattacagcaaagaatccagagcaagagtaggaagaaaaagatacacatcaggggaagtccagaggggttagctacaggcgtctgagtccttcccatccagggccacgtgggacatgttttgtctctagcagcaaaccataggaacatgtgctaaatgtctctacccagggcagcccatttgagtttcagaatctgggatttttgtggaggtctgttggcgtgggcacatcctgttctatgaccagccatggtaacaaaattgaggaccccaatagtgaagccaaatacattgtgaatcttgctaaacaatcctacaagtcttgacaggtccctatggcataccccactgctctgggcttacaaaactttatcagtcagtgacgtgaagaactttctgagggtcacattcccaggggttggccaagggtcatttatggttgcaggctaccctagaggcatgcaaggactgagcaaccagacctgttgtgttagaaatatttctaaaaaattggggggttgcggggatacggtcaccactgcccaaatttgtaggatagctatagtttttaatatttttgtgttggggatagtattaggttttccaaagaaaccaatcatctaatggtcatgaggctcaatttgcattgggtattaaagaccagatctcgttcgtgtgcagttgctgtaatggttcactcaatgaaggagtgagaatttattctcaccagttctgataaacagagaataacttaatgtttttcatcttttcttagacccaagtggagaatgtaatcctgatctcagattaagaggtcaccagaaggaaggctatggtctctcctggaattcaaatttgagtggacatctcctaagtgcatctgatgaccatgtgagaaacgtattctttgtaatttgttcatatagtgagagctgacgtgtcacagctgtgctgaaggagtactatatagatgaaaggttttctaagataatactgctgattattgtggtaacattcccccaggactttagagagatggttttcatactgccctgtatgagtcttcggattccacagagctcttttgaagtagccttagaatggagggagcataggcaaaaggcctcccattatttaaaagaggaccctccaggcccttaaaatggaaactgtagagtgtttgtgggacctgattaatataaagtattttttaagtgtacagttcagtgggttttagtatattcacaaaggtgcacaactattgccactaattctagaatgttttcattcgctctctgaaagagaaattccatacccattaagcagtgactccccactcattccctgccttcccccagctcctggtaagcactaatttattttctgtctctatagagttatctgttcttggtatttcatgtaaatggaatctcatatatggccttttctgtttggcttctttcacttagcataatgttttcaagtaacattacttatgttccattcctttttatggatgaacaatattccactgtatggatataccacagttagcttatttgtcagttgatgaaccatttgagttctttctactttggggctattttgaattatgttacaagcatttgtttacaagtttttgtgtagatgtatgtttttatttctcttggatatatacctaggagtggaattattggatcatatggtatctctgtttaattttttgaagaattaccaaactgttttccaaagtggctttccattttacatttccacaagcaatgtacaaatgttccagtttctctacatcctcactaatgcttgtcttttttattatagctatcctagtgtgcataaagtggtatttcctgggtttttttttgtttgtttttggcttgggggtggggagttggtttttgttgttgttgttgttgttgttgttttgtttgttttttgagacggagtctgtctctgtcacccaggctggagtatagtggcacgatctcagctcactgcaacctccacctctcaggtccaagcgattctcctgccttagcctcccaagtagctgagattacagccatgcaccatgaaacccagctaattttcgtacttttagtagagacagggtttcaccatgttggccatgctggtcttgagctcctgggctcaagcaatcctcctgccttggcctcccaaagtgctgggattacaggcatgagtcactacgcccagctcattgtggttttaatttgcatttccctgatgactaatgatgatgagcatcttttcttgtacttactggccatttgcatatctcctttagagaaataggtattcaaattctttgtccatattttaattttgtctttttattgtcaagttataagagtttcttatgtattctaggtataagtccctatgattttcaaaaattttctcccattctgttgtcttttcactttttttttttttttttttttttttttgagacaaggtcttgctctgtcacccaggctgaagtgcagtggctcagtctcggctcactgcaccctccacctttccagctctagtggttctctacctcagcctgtcaagtaggggggactacaggcgcccaccaccacacccagcaaatttttgtattctttgtagagatggagttttgccgtattgcccaaactggtcttgaactcccgggctcaagtgatccaccttccttggcctcccaaagagctgggattataggctctctgaaaggatgcttccctcaaagtgtgtatgagacggtttcccaagtagggaaagtggataagtggattgtactcagtaacccaattactagtaccttttgaagagaccaggctgggaattggtagtaataataatagctgacatttaccaggggctacccacatgccaagcatcatgctaatcttgccaggtccttctgagtcggtgtgaatggcaggagcaccacatgttcctttctcttcagttcacacacattgagtgtcttcatgtgtaagtaacaacagagactgagggcatatgtattgtgtaaaaaaaaattttgttactgggaaaatagccattactgggaaatagctttgttacagaaagtccttcatgtggctgggcacagtggctcacgcctggaatcccagcactttgggaggccaaggtgggtgggtcacctgaagtcaggagtacaagaccagcctggccaacgtggtgaaactccgtctctactaaaaatacaaaaaaattagctgggcttggtggcatacacctgtaatcccatctactcgggaggctgagggaggagaattgcttgaacccgggaggcggaggttgtagtgcgccaaaattgtgcccttgcattccagcctaggcaagagcaagggctccgtctcaaaaaaaaaaaaaaggtgatttaataaaaacagatgaagccctttcatgatcacgtgctatgaattaaaaaaaaaaaaaacccataccagtgtcggtggaactataattagtgctaatataccttcatgggattatttcttattaactattgaatgagaatcgttgccctataccttgcaatattttttcattaaaactttcctcttaactctttctgtgataggatgtcaaggcccacatcatgaggcctccttatttgtgggctgctgtgacctttaggcccagcggccccatggcctctgcttgggctctgctgacgtttcaaggagcacatcattggggatctgtctgtgggcgccaggccttgacctctcagagtagactagtagaggtttctggcccagtgtcgtttacctgtcccatctcctgatgtctgtggtggtttctgccatgaagtgaaagacttgtccatgaggcttttgctatgtgagaggcagagtttaattttaattcccagtcttcccatcccagtgtaaacttttaggatgtgcatttgtgttcagtagatgctgagcgccgggctcttggtgatttgttgtgttgtctaagtgaatttggggtacttgaatgtctgaatgtatgtaggtagaaattccagcatcagtgtccttgcctgccactgtactcagtctcccctccccctcattacagtggagtgtccttttcctctgcacctcacatggaggctgcagccacatactcttctgtttgcttatattttctctcttgtgtttacctcaaacttatatagttgaatagttttgtttgtaatgaaattattttaaataagatgttagcatttaaattcaatctcttgaccgggcacagtggctcacacctgtagtcccagcactttgggaggccaaggcaggcggatcacttgaggccaggagttcaagaccagcctggccaatatggtgagacccccgtctctactaaaaatacaaaaaaaatgagccaggcatggtggcttgcacctgtaatcccagctcaggaggctgaggcaggagaatcgcttgagccctggaggcggaggctgcagtgagccgagatcgcaccagcctgggtgacagactgagacactgtctcgagggaaaaaaaaaaaatcagtctcttatagcccttgttcttttttttttctctcctctcttagactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatgtaaggtggaaaattcagtgggatcttgttaaatgggtgacctgaatgaccatcagtgattgctgcaggctgtagtttgattttttttttttaagttatggctttaaaaaacagctttaggtagcttactcctgtaatctcaataccttgggaagctgaggcaggaggattgcttgagaccaggagtgtgagactctacacaaaatttaaaaacaaaaaattagttgggtatggtggtgtgcacctgtagtcctagctactcaggaggctgaagtgggaggatcacttattatttagaaaaaaagaaaactaggtatggacatgtgaaggaacatacttggtgtggtggtaaatatcaaaattgagatccagagtgatgccagttggaggtcgaggaggaaaatgatttcatcaaggtgtggccacagggcttcattcacttataatcttataaagaaatacctgaggcaaatgtgacaaaatactgggcatttgtcaaaactagttttaggtatcagattgtgacattattctctacatagtctgtattttgtgtacacttgaaatagttggtaattaaaataggaatctaatttaaaaaacaggactaacagccctagcttgttctctgtaggtttcgaatgtatcatttagtggtcgaggtctgaatcaccagctgtgtggttggtttcttcatgaaggggagcacatagtggagctagttgtggagtgcagtgacagtgatgtgaggccgaatgtgagtgtgtcatccctgggtgccgtgtgcctttacctttgtgttttagatgggacaccaggtccaataccacctccaagccgagtcacttggtggatgcgcacactgccgaagtcaactgcctctcattcaatccctacagcgaatttattctagccaccggctctgcggataaggtttcgaagtttttgcattatttggtgtttataaaacccagttctcttgtgccttaatcagatatttgaaaattcttaggtaaagcatagaaatcattttcacttgttatttttctttagaccgtagctttatgggatctgcgtaacttaaaattaaaactccataccttcgaatctcataaagatgaaattttccaggtatgtgacagttttctggtgtctgtatgtcaggaaatgaaatccagggattcatcagttaagctataccagactcgtgggtccactattgaaaaaaatgtcttgtacgtggtgttacatggagatgctcatagggtaaggtacaccttgttgaagaattaaaaagcttctgggatggttatggggtcgaataaatttattgagatcccaggctgagttcctcagtgctggggagtgcagccttcctgaggacaggatggagctgagcccttgcagagcacttgaaagtcggggacaagagagtgaggccatcaggccaaggataagataatagagtgcaagatgggaaaatatcagattagaacaacagccacaaacctagcagcggatgattctttaaatacattttcaaaattatctattactaggtccactggtctccacataatgaaactattctggcttcaagtggtactgaccgccgcctgaatgtgtgggatttaaggtaacttacagtcctgtgacaagatactgcataaatgtgcctatctggcaagttacatagtcattcataaactagaaaagcaatttggtaatccccccttcaagaaacctaatattaaagaaacttctaagcatcttcctaaagagcctttgttctgtaaaatagaagtgaagcagcaaatggaccataaaataaatttctctagtgtgagttttgtctcttaatattcaggcatgaaggtgtatgtgtctgtttttgtttttgcattcaaatgactgtatttaaaacacacttgatatagagaaatcaagatgttagctgttttatgtctcattggatctcagtacgtgtaggcaggactgttttttctgggtttttgtaccatttactttgctttcagtgattcattctgcagatgtgcactcctgctgtgggttgtgtaactgctggggagacctttgtgaaggggacaaggacagcccaagctgtcagagagcttatgttctctggggcctcattgtataaagagtttctgccaatttttaaagttcctttagttcagacttgctgttctaagaattttagactcctttacttgttcatctgagcctttagaacttaataaagttgctcagttacatactcctccgtaagatgtcatcttaagtttaaatcataaaattaccaaaaaataacttatttcctgcttgtattaaatatattgctttgaagtggactgaatttagtacaggttgaatatcccttatccaaaatacttggaataagaagtgtttggggttttggaatttttaggattttggaatatttgcattatactttattggttgagcatctcaaatctgaactgaaagtccaaattcttcttctttttcttttcttttcttttctttttttttttttggagactgaatcttgctctgtcacgcaggctggagtgcagtggcgcaatcttggctcactgtaacctctgcctcccaggttcaagcagttctcatgcctcagcttcccgaggaggtgggtctacaggtctacaagcactgccacagccaccatgcccggttttgtattttttactaaaaaaataaataaataaaggcagagctttgccatattggccaggctggtctcagactcctgaccccacgtgattctcccgccttggcctcccaaagtgctgggattacaggcatgagccattgcactcggtgtgaaagtccaaattctgagtgtcacgtggtgcttaaagttttggattttggaacattttggatttgggatgctcaacctatatattaaaaccaaggctgccttaattatagaggcagtaatcctcagtatatagaagagacgctggagaataaaatgcttgtatgtaaaacttaaaatagctaatgttcagggttctgatggagcaaactcttgccgtgataaatacttgaagatgtagaaaacctttaaagcagacagttgggggcattgtatttgatttaaaaacaattttagtagtaaaataaaacctaaatcaaaactataaagaggttgtatgaagcgtacagcaaggtttggaagtctgatgccctggcaactgaattgcccctgaaggtgccaataatttgtgagcattgtgtgtaatttcttcttagaattatttcttagcttgtttaatattaaaattacattagatagggggccaggcatggcggctcatgtctataatcccagtactttgtgaggctgaagcaggaggatcgcttgaacccaggagttcgagaccaacctgggcaacatagaccctgtctctacaaaaaattgtaaaattacattagataaaatttgggattaaaatggtgagttttagcaactatactgacaggtggaagataagtattgtctagcaatcccacaggtttgagattgtttggttagttttgtgggaaggaaaaaaatgtctcacttggagggctgggttttgttttttagtggttgttactactaaagtctttgggctaggtataaggacagggctgatattgatacataaagagtgatttcactgttgagcactggcaaattctacaaattgaagtttttaagagaaaaaccataaaaacatttccttggcttacacatttctcaaagttttattgccatatctttagacagatctatagtactgatttgtaattatattttactcctgggatgcaacaggctttgagtgaagtatagggattgcacatcagtttatgtgtagatttttttaactatacatttcaccttttaattctaaggcaataaacagttaatgaagggattttgagttaatgtttattattgacaataattcctcattctgcaacttcaattatgaacaactctaacttatttccagaaagtaaacatcccgtccttacaccaaatataaacagtagccagatgtggtgaggctgaggcgagaggatcgcttttgagcccaggagttcaaggctgtagtgcacagtgatcgtgcctgtgaatgaatagctactgactgcagcctgggaaacatagcgaggccatgtctctaaggaaaaaaaaaacctaattgattgtagtatagaaataagttgtttttgtgagtgtgtttatgttttaagattactttctgggctgatactggtttagcagatgttcgtgctacaagaatttcactgatgaaagcgttatattctttattcttacagtaaaattggggaagaacaatcagcagaagatgcagaagatgggcctccagaactcctggtacgcattggcttatagaagatgaaatgtcatatgcagattggattgtcattgatctctttatttcgagaatgggtcagaacttcgaattctagctcttgcagatggtttcaaaatggaggccctgaaggttattgcaactgggctttgacatttatcaaaaatagtaaatggagcccagtaggtttttatgaatgtttcactgagaatggtttgaggtcctggaaaatagtatatagtaatttctcactgatttcaactctggtatttgtgatggtttggggatggggagtgagtataattgctattcagttggcagtacttaacatttcctaacagtatagaaaaaattttaaatgctttttaagtttcctgcccagaaaaggagtgctttctcaatcttgatgttagcagagcccactatctccctcccatgcctgattgaagcatcacgcatctccttggccctttgaaagcttatgtggtggtatctgcccatcctcattcttcccgtctgagtccttcagtgctcacttcgtcatttttctatgaagcattgccggatttagcaatggttccctgtccttgctctgaatccaacatttgtctcctcccattatttggcagatagtcactcatcactctgtcatttacgattttagttctaatgccagtactcatttttggcacacttgtactttgtccatgagttttatttattcattttttctgtgaacctatggagtatattgaatgtccacaagttttcaaaggtaaagaaggtccttgagagcaagccctgcacacagaagatgttcactaagcccaccttgtaagaatgctccagacccttttattttgatgacggctttactgagatataatttacataccacacagttcacttctttaaagtgtacagttcagtggggagggagtgttcttgggttttgggggttttttttctttttttgttcttgaagtcagtggtttttagtatattcatagacttgtaaaactatcaccacaaatcaattctagaacattattcatcccctccaaaagaaactatagctatcacctcccaattctcttcttcctccagcccttggcaactactgtgctactttctggcactataagattgggctattctagatatttcatataaatatgacttttgtcttttgggactgattctttcacatagtacaatgttttcaaggtctccagctattttttttagggagagaggaaagcgtattactttgtatattatgcctctgcaacaattccaaggtccttgagaaaatacactaggattttgctttttacaagagagcttgaaatcaagggacatttgagagtagtaaactgggcctgggcatggtggctcctgcctggaatcccagcactttgggaggccaaggcaggtggatcacgtgagcccacaagttcaagaccaggctgggaaacatggcaaaaccctgtcctgtctctaccaaaaaaaaaaaaaaatacataaattagccaggtgtggtggcgcgtgcctgtagtcccagctacttgggagactgaggtaggagaatcacctgagcccgggaagttgaggctgcagtgagccatcatcacaccactgcactccagcctgggcaatgggagtgagaccctgtcccaaaaacaaagtagtaaactattccaccagtatgctttgataactcctgtatgttttctaagccccagtgatcttaaaatatattcacctgtgtaccccttaagagtactctctctgtcgcccaggctggagtgcagtggtgcaatctcagctcactgcaacctctgcctcccgggttcaagtgattctcctgcctcagcctcccgagtagctgggactacaggtgcgcaacaccatgtccagctaatttttgtatttttagtagagacagggtttcaccatgttggccaggatggtcttgatctcttgacctcgtgatccgcccgcctcagcctcccaaagtggtgggattacaggcgtgagccaccacacccggccagtatattcacttgtgtaccccttaagagtactttaaaaagctatttacctcttttttttttaagtcaaggtctggttctgtcacccaggctggagtgcagtggcgcagtcttagttcactgcaacctccacctcccaggttcaagctgtcttcccatctcagcctcctgagtagctgggactatgggcacaccccaccacgcccggctaattttcgtattttttgtagagacggggttttgtcatgttgcccaggctggtcttgaactcctgagctcgagccatccgcctgctttggcctcccaaagtgctgggattacaggcgtgagttttacccagccccacctcatatttttaacccgataagattattcggtaaaatagatacattgcataatacctagttggcaggcagagacctcattgtcaaactagagtcaaatcagactttgtcagaaagtgtgatgtcccagttccaaacagtgtatttagtactgtccttgtgaagaagtgtttcgtttaaatcttaattctaagataaaaaaataaggcatagtgcattccgacgaggttgtctcttgcggggaacaactgctctcttcagaattgtttagcaaagctctcaccttaggcatagcttatgagggactatctggagctatgcttttggagccagggattttctttcaccctggtgctgtctgtgtacgttggaaagatgggcaagaagtatgcctctctcagtaaagtggagaggggaagaaccagaagactcctcaggccccttgtataatagaagagtatgttacatggcatataacggattgattaccttagatgtttgcacctaactgtatatgagcaaatgatgctggattaatgttcatcataatcagtatggaaatggcattttgactaggaaaatgtcctcattcttaagggatgcaggctgaagtcttcagccatttcattgtataggctcatggataaagcatcagttatgctagtattacttggtgaatctaggtaaagggtatacaggtatccattgtactatattctgtcacctattctggaggtttggaaatttgcaaaataagtataaatagattactgagcctgtaccaccttctaaaaccagacagcacccacccccagttgaaatactgatagctctaaaaacttagtaaaacctttgttaggattaacaggagagtatatgaaatcaaagctttttttgttcttgtaacagtttattcatggaggacacactgctaagatttcagattttagctggaaccccaatgagccttgggtcatttgctcagtgtctgaggataacatcatgcagatatggcaaatggtgagttaaaatgtttttcttgaatgactgtcttgtaaaggagagatttactacttacataatgtaataaagttatttcgaatatgtaggtgcatattatgccaaacatttacagaaaccgtttaaaagaactttttccatttcaacaatacaatctttagtcccatatggtgcttcgtccactgtttgctatttgtagcacctgtcaggtcaggagaaatctctgcatctgcactgattttcattgttgttgtgctcttcatacactggagtcttggcgtcgctactctgtctccagtgtctgttctgtgtggtaggcatgagggatacaggaaggagaggtcaaggcattcaaatgacaccaagttctctgaggatgagcactaagtagctgacatttctaagttgttgttaaccgagacttccataacatctgggctaccacttcctctaaacgatgcttgaagtgcctttggaaaacatctcttatgaacagtgattgaaataagtagtgcatcgatgggtggctaagtatacatacggaattacacactggcaaagaatttttcaaaatactggctagcctaccatttccttattgaagtttttaagagagaaatgtaaaaatgaaactattaagttctaaatagattaaattgtttttacatgaccatgtgaaaaccatagggagtttttacctgtgaatttatttggttatctccaggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaagaggtagatttttctgcaacacctgagaattgaattgtgataaccaggtgtaataaaggcagttgcatacataactgaaaaatactggtctcaagaccaagaaatgtactcctaacaagtctgaggatgaaatggtccatattacccaagacccaagttttctctacaccttggagtccaccgccaatataaataatacacatcacgattccatgatggtgcaacaattgcaatttaagtgaattcaacatttaaaccttttctgggccagcctagtagcattacagtgttctagaatatggtagatatggggtgcgctacaaagccacaacactgggctggtgaggtgatcactgtaggaagatgtccttctcagggggtcccatttgtttttattcacagggtaatgggaggaagggttctgaaaggacaacaaatgcatcccagacagaatccatatcctttcaacactataatagcatctagctaaaaatacaaagtaagccaaaagcagcaggccaagtactgttaatcacattgctttaaagcccttggaagtatgcaacaggcccaagatttacaatcttccacacaggacaagcaccacaaagaaacgtggtgggctacacaaatggcttaataaaatgttaagagctgtacatccagcagagttcttgtgaaataatgtgatcattagtactaattttaaggtggattatatttctgatctatacctgcattcccccccaccaccagggaaatgagtctagtattttagtagcagaacagggtgtactcctaagaggctgttggagggtgttgttttttgcttctgactcattttgatggtaattagataatctactttgtggatttattttcctccactgtggccccttgaattaacatgactgatggtggaggcttagatacaaccctcctccactccaggcggtttcctatctatctatctgttggacaattttcaattctttcaacccagtttcgaccatgaatgtgacaggactttacaaataacacttgtaacaaagagaaaacccttttaactggacaaaacagagtttattcagtccagtaagcaatttaacaagtgtcagtctgatagttttgctcagtggaatgtgctaacatcagttctagtagaaccttttatttcataaagcatttcaatgcaaattataccagggacaaagtcaaaacttccatcagtgcagcctgattaatcatctgcataactgcgccacattcaacattgaaacaaagaactaattcaaaagttatgtgcttaatttcaaattttcccccagtccaagtgtagagaccttgataatactgtggcttttcttttttcttcttaaaaaagagatggtaactaagaagggggtgagaaaacagactgaacacgtaagtaacagatcatgactaacactctgccaagtcttcccaaagtaaaaatgttggtgccagtgtttgttctggaaatgaaaatcaatttcggttggtactgatccataatgaaaattcccttttgaaaaacctggagtactttgctggtggaatttttgtagtaactttcaagtagccagaaggtattggagaaacttctgcctagt

SEQ ID NO: 13047 - DNA, 63183 bp, Human
  misc_feature (1)...(63183): n = A,T,C or G
cgcagtgagtggtcaggcccctgcgtccccttctgctcatacccggtgttccagccataccaaactgcatggtttgtgaccatacaatggcccgtgtcctggccacaccactctcttcccttttcccttcccgccggtcctctgtcactcaccttgtctgtgagtctcaactcccatggtttcctgatacctgagtcccctcctcccatcactagttcagcactggcatttgcttcctttggctcccaccacacttggtttctcctctttgtttacgtgtctagtgccttccctgacgtgagctcctggagggcagggactgtgtcttcttgtccgctccggctccccagtgctgatggagactcaggcaggctgcgctggaccaaataggacacgtggtggtgatgacatttttggtccaatccagtagcagcctgtgaagtgctcattgcaggcagagctgagtaagctgtgaccccactctcaggcagcttctcttcgggggggagcggcagggacacctgttccgaagatcatgtcctgcatgatctctgtgtgctgaggaatgaagcatgagtggagatggctggggtccatgacgagtatgaccttgggcaagtcactgtgaatggcactcctgggtgaggcttaggctgagtgcaggctccatgcagatacttcctccagctctggccccacaccagcagcacaccagccagaaggcaaatctcaaggcgagtacgggagttggtggcacctctctgcctccagctgtggaagaggcacccggtgcctgtctgggtgctaggataaggacaagaattgtcacaaccagcagctgtagcactggacacggggaacagggactttctgccatttcccactttggcattccagctgatcctctactctttattcccagatagggcccctggtttgagtctcattctgagctcaccttccgggtagcccccttccttcatgggctggaagggaagcagaaagctgcttattgtcatcttgggaaaagatagagaagaggcggaaacagaggtgccagtgctggtcaggatcctggacctgaaggaatgtgcaggatccctccaccctgacttttcagttaacgcgtgttctcggggacatcggggtgttcagacctctgcctggcttggatcagggcgcacttacgttcccgtagcaggctcagcctacccgctctcttcagatgccagcttctgtcacacagtgagcgcgccgaaccatgcaagacctccgaccaattagcctcgggttcgggaggccaagcaaaagatctaacagtgagctattgactgtgcctcctccaaggagctggtcagagctcagcctggtgttttgcttccttgcgatggtggggtggtacccagtaggtgggaactctgttctggcttcttactggggtgccctttaggataacactttgttaaatgaactgagctgggtggtttcatagtatgttcaagcatgtgaacatctgcttgctgataaatcgtactgggtcaccagctcacactaatcaccaggtaacatgtgccctggtgagggatccagtcttctggccctgtggggagacaggcccatgatgtcaccagttcccaggtggacaacccaaggcatagtgaggtctcggcaggaaggaggaagacattagactccttcttttttcttctccccattgaatcttctgctcctttccttaggccagatgccctgtctctctcctggctggctttcccagccctggccctggccctcccttctttgtgaaactcgaacaccactgccctttcatctttccaccagaacttgtgagcagtggcttttgaccgccgctcttccagctcacccctgacctagtgtttgtttttttatccttccctcagtctactcaaggcccacccctaagccagagattggctcccaagcagcctctctctcctgggagcggtaaaggaggggacagttctggaaagtcattgacaggggattaacctagaacatcaattataaacaggcagcaggcctcaggcccagacttgggtgttacaggaacagtgtggcctctctggaactctgcagaccaactgccgtggtaagagaaccgactttcagaggcctctaggcactttgtcctgggtaggggtgcccacacatcctggccattgttgctcttccctctggaacttggcagctttctagcagttagaagagcagagggtagaaggatgggaacagtccttagagaacaggaatctaggggagggttggactagatcatttctcaagagctgtggggactgttctggtcaggcatgggcaagctgaggggcaggaggtaggcaaaccctacttgacctgagaacagatttgttgttgttttgtttttgtttttgagtctcgctttgtcatccaggctggagtgcggtggtatgatctcggctcactgcaacccctgcctcccgggttcaagcgattcttctgcctcagcctcccgagtagctgggattacacgtgtgtgccaccacacccggctaattttgtatttttcgtagagacggggtttcaccatgctggccaggatggtcttgaactcctgacctcaggtgatctgcccgcctcggcctcccaaagtgctgggattacaggcgtgaaccactgttcctggccgagaacaggttttgcctgagaccttggacagaagaccttggccatggatccaagagctctgggccagaacacccttgcatgatggtgacagttgagggaaaggccacatggttccttgtgtaaatggcatggctgccagtggtcatggggaggccctgctcatagttcagcaccagccggcccttcgtgtgctgtgctccagctccccagccggctcagtccttcacaaaatgccctggagttacagaacagaaaggcccggctttcctttaggaatctgggaaataggagggctgaggtcatgctctgttcaacatgtgagacctcccagacagcagtgcaggaaaaacatgttactacccgtattttgggagaccagacctctggcgtttgagtaggactcactgctcagatctaaggggagagaacatctcccattttgaagaaaaccttttcctcagtttaggaggaggagaaactgatcaggttccaaatggcctcttgttctttaactgcaaacgggccaggctccctgccaggtcatgggataacaatccaaggagaggggagaaatgcagtgtgcatgtgtgtgtacatgggcatgctcgtagggggaaagactggggggatggaggtgacgtggacatctgtgtatgcttcagctctatttccctctgcttagtcccaaactgctcgggattagcaattgttaagaacatgcctttctccccaccccgggagttctaggccaggggtggagggattgagcaccgtggctttgttctctgtcaggtggtgcctttctctgtgacaccgagggagacctgccatcaggagggagtctgaggccaggagacagtacttaccgatcaggatggatctttggtcttgtttgtgtgcttggtttcctggctggaatgaaatgtcagtttcatgaggacagggacctgttctctcctgcacaactttctctctgatgaccgacagtgcctggcatgttgtaaaggctcgttcagaagtgactgaatgaatgaatgcatactttttaggcggggctgcatatcgttcccttaaacctcctgattcatcttccgttgcttccgtgtcagcttctcactgggtcattgtctgctttggtgctgcccttccccacaactttgagagttcatgttactgcaggctccccgcccgcccacctctgcctgaaacttctcttttgggctcctgtgctgtgacatactagcagtatttgtttgcccctcttaagaccatcccttcagtttcattcctgcctcagtttctcctcctcacatttctgctgttccacctctgctcctgtgctcttctcaggaaagcaggtgagtggtgatgccctgggctaagctcgccagggcctgggcagcccaggcacccgtggttcgggtggggagggagcatgctggtggccggagctgggcttgtgggcagcagccctccccaccttgctgaggccaagctctttctcatggctttggctgtcacttctatgctgatcacccccaaatcattgtgtctatatttctctattggtgcttctgaccttccaaaatctgatcccaccctggcagtcagaccttatttgatgtcaaggattattaatttgtagcatgtattacatccctaatatggaccagttcacatgcattctcatatttcatcctcccaatgaacatacaaagtcaaataattattcttattttacagagtctcagacaacttagttcctctaggtaaccagattaattagcattagggggttgtgatcaggatttgaactggctccactggcccctgaccctgaacagagtcagcttggagtccgcccttggagacgaggacagccggtcctgtttctccctctcaccccagtgcactcacacagcaggcgttggcacccttgctaagggccaggccaagcgtctcctctgtgagccttcacttagctctcctaagctgctcggcctgcctcctctcccttttctctaacagcagtgcctttgcacacactatgtgtttgttatatgttggctgtgccagtcttgcctcgtcagcagatagtgattttcttaaaggcagaggccatgttttatatgatcctccatccctcaagtgtgtgttacaggcagtttgttgctcagtaaacacttgatacctctgatgaggtgaaatctaatcacagtcctttgcatatgtattgtggtttacagtttctgaaaccgaagagccaatttgaagtttcctgtaaaacagatcccttaattgtcagcgctctgtgctgagagggataaatctgttttgtagacggactaacaggtccagaggtagagtgaattccccaaggtcatatgatggatgatagcaaagccagaacttgaacccaaggtttaactcttaatgccgttcctcttaatgccgttcccttcccacagaatcacagcagcctgtggtccagacttggccaggtgacccctgccaggccttccatcccacttagtcatacagttccttatttgtatttgtcctttctctttcattagaactcgtgtctttttgtgtgtgtgtgttttttgagacagggtctcgctctgtcacccatgctggagtgtggtggcacaatcacagctcactgcagccttgacctcccaggctcaggtgattctcccacctcagcctcctgagtagctgggactacaggcgcatgccaccatgcaaggctaatttttgtatttttttagaggcagagtttcaccatattgcccaggctggtgtcaaactcctgggctcaagtgatctgcttgctttggcctcccaaagtgctgagattacagacatgagccaccgcgcccagccttagaatgcttgtctcttgagggcagggaccctggctgcttttcccattatccttccaaagctccagctctggggccatgaaccagaaatcattccttcaaggatgttgacacagtgagtcacctgagaaggggcagggtgcaggaggggtggggcaggagatcaggaactggtgtgggacattaggggtgggagataggccagaaagccccatgctctgtgtaaaagcttctgtcaaatgaagatgtgcttgtcctacctaccaggcgaggttactcttagtagcaagtgagagtgtctgctaaagcgccttctaaactgcagagcactagcaatattgttgttaaatataattatagtctgtagctgggcatggtgctgggtgtctgtaatcccagctacccgggaggctgaggcaggagtattgcttgggcctaggaggcggaggttgcagtgagctgagatcgtgccgttgtactccagcctgggtgacgaagtgagactctgtctctaaataaaaaaaaaaaaaatgtatatatgtgtgtgggtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggattacaggtgcctgccaccacgcctggctaatttttttttttttgtatttttagtagagacagggtttcgccaagttggccaggctggttttgaactcctgacctcaggtgatccacctgcctcggcttcccaaagtgcaaggattacaggcgtgagccaccacgcccagccaaaaaatatattttttaaaataataataattatagtccgtagggatgagctcaacaacatggttggatagaatcatactggccttgtgagtattgaggagacaatcaggatggtgcctcacccaaggcctggcactccagctattatgaattattcttgttttcataattattataagacatgccctcttccttcagattggggaaaggagttggcagtgctgagaatgcatcgcttctggattgggactaagaagatgggaaaggcagtctggccctagggctttcgtagatccactcaccaccgcaggtccccgactctgaatacctccttcctcccagtgggggttttcagcaagctaatttctcacccctgaggaggaactgttatattcggatgaacacccccctgctaatgtggagcagaaaagtaaggcctggcgagtcagcagctgctcagcaggtggatgggctgcggtggtgtagcgggtaggcgcctgacagcccggcttgccgcagccgctgtgcttccctcccatccctggggtgtgcattttagggtaaaggcaaactggaagctcttgctatttgcagaactccaaaacaacaaaacaaaatgtccactcagctgggggttggctgggcagcaccactgtgattacacagttagcctgggggaagggctgtggtcagagtttgggggacacacaggtgtgactgtgatgtgatacagctggaggaggaagaggagggtgtgatcacaggcccgggagtggccagggcaagagtgatggtggaggagagtggctgaggttggcaggcagggaggagagattggtaactactaatcactagcatgatcagtcttgacaatctatctacaagggactcccaggtggcagggcaggacctgaggcacagctcggcatgacgggcagacaggggtctacgtggctttgagctctgagaccataggcaagctgttcatctgggtgtctttccatgcttacaataatattccccttacaagccctctgatgattgagatcatagaaatcactcagtgcagtggctggcactcagtagcagctcacacaaatgatcagcaattccgacacttgctatgtggccatcacagtaaaatcagcaatagtggatgcccagagctgcatctccgggaagcctctgagccagtcagtgtttgtgctcaaactccaaagcataggatgaaaggtcagatcatggggctatgaagatatgttctcctaggagtcacgaatagggagagaaaacagcagcaaacacagtcaaggccatgtcctgcctgggttgctgtttactttcctcttccaggaactgaagctgtttcccattggatttctttactatcgccttggctcatggactgggtactttggtaatcagttcgcccagagaaccaggctttcacattgacctaggttccacagtgacttcctccacgggatgtcggggtgtgtcatctagcagaatagcagtcaagactacccaggaatggttgagggttgcacactatttttaataaattgaattaaatagccaagaaaagtcagacacccaacaagggaagttgaggcaccaagcgacagtggaaagtcattactaccactaggcttgaaggggtcaggagaagaaatagcatttcctggctgggcgtggtggctcacgcctgtaatcctagcactttgggaggctgaggcgggcggatcacctgaagtcaagagttcaagaccagcctggccaacatggcaaaaccccatctctactaaaaatacaaaaaaattagccaggcatggtggcaggtgcctgtaatcccagctactccagaggctgaagcagaagaattggttaaacccagggaggtggaggttgcagtgagccaagatcgcgccattgtactgcagcctgggtgacagagcgggactctgtctccaaaaaaaaataaataaatagcctttcctgcaaacaccagtgagggctgaatagtggacactgggatgccagcaggaactgtcatagcgacaagacacagcctgggtcaggatggtggcatcaaagctggtagagagtgaggaaggcacaccccacgttctctctccaccgcctcctacctacccttgtctcccgcctgtgcctctgtctcatcggctggacctacaggaaaccagccaggaagggagcccaggtgcctccacccagagggctcagccccgctgggtccagagaagggcatacagggaggccgccaaccaggtagcctttccccaaaaggcaaagctgtggaggaggcatccactcagcaggtgtggaaagcaggggggatgagagctctggcatcctagggtctgagcggctgctgctgctactttttgggaaggggctgccaaatcaaaactagttactagttcaaaatttgatcataaagggcaattaggaaagataaggaaataaagaacatccagattggaaaggaagaggtaaaagtatttttattttcagttgacatgatcttgtatagaaaaacctagggaactcattaaaaatctatttgaattaaatgagttcagcaaggttgcaggacataagatcagtatgccaaaatcaattgtatttcagtagcagtgggcaaattgaaaatgaagaaaacaattccatttaagatagcatcaaaataaaatatttgggaataaatttaataaaagtgcaagacttatactctgaaaactatgaaacattgttgaaaacaattaaagaagacccaaataaatggaaagataccccatgatcatggatcagagacttaatattgttaagatggcaatacttcctgaattgatctgcaatccctatcacaatccaagatgccttcattagcggaaattgacaagatgatcctaaaattcacagagaaatgtaagggaaccagaacaaccaaaagaatcttaagaaagaagaacaggctgggtgcagtggctcgcacctgtaatcccagcactttgggaggccaaggcgggcggatcatgaggtcaggagatcaagaccatcctggctaacatctctactaaaaatacaaaaaaattagtcgggcgtggtggtgggcgcctgtagtcccagctagttgggaggctggagaatgacgtgaacccgggagtcagagcttgcagtgagccgagatcgtgccactgcactccagcctgggcaacagagcaagactccgtctcaaaaaaaaaaaaaaaaaaaaacaacgttggaggactcacacttcctgatttcagaatttaactgcagtgtggtactggtgtaaggatagacatatagatatatagatcaatggaatagaactgagagcccagaataaaccctcacattaacagttaattgattttcagtaagagcgccaagacaatttaatgggggaaagaatagtcttttcaacaagtggcgctaaaacaactgtatatctgcatgcacaggaatgaactggaccccacctcataccatatacaaaaattaattcaaaatggaccaaagacctaaatgtaagaagagctataaggagaaaaataagtgtaattctttgtgaccttaggttaggcaatgattttttagatacgacgccaaagcacaagcaataaaagaaaatgaactgtacgtcatcagaatcaacttttgtacatcaaagaacactatcaagaaagggaaaagacaacccacaaagtgggagaacattttggaaatcatctatgtaacaaggaacttgtatctagactacctcaagaactcttggctgggtacggtggctcacatgggaggatggcttgaggttgggagttcaagaccagcctgggcaatgtcataagaccctgtctctgcaaaaagtaaaaaggaaaaaaaaactagctacttgggaggctgaagcaggaggatggcttcaggagcccaggagtttgaggctgcagtgaactatggtcgtgccactgccctccagcctgggcgacagagtgagactctgtcaagtaaaatcaataatattatgggaccaccatcgtatatgcatttcatcattgactgcaacatcgtgtggcacatacctgtagtcatatgatgggatattatttagccatacaaagaagtgaagtactggcacacaccacaacacggatgaaccttgagagcaatatgctaagtgaaagaagccagacccaaaacccacataatttatgattctgttgatatgaaatgtccagaattggctgggcacggtggctcacccctgtaatcccagcactttgggaggccaaggcaggtggatcacttgaggtcgggagttcaagaccagcctgaccaatatggagaaaccccgtctctactaaaaatacaaaattagccgggcatggtggcgcatgcctgtaatcccagctactcaggaggctgaggcaggagaatcgcttgaacccgggaggcagaggttgtggtgagccaagatcgttgccatagcactccagcccgggcaacaagagcgaaactccatcttaaaaaagaaaagaaaagaaatgtccagaataggcaaatccatagagactgagagtagatgagtggttgccaagggctgagggagctaagggggttggagcatgacagctaggggataggaaatgttctaaaagcggattatggcggtagatgcacatatctgtgaatatatttaaaaagccattgaattgcactttatttgtttcttgagacagagtcttgctctgtcgcccaggctggaatgcagtggcgcaatctcggcttactgcgacctccacctcctgggttcaagcgattctcctgtctcagcctcctaagtatctgggattacaggtgcctgccaccacgcccagcgaatttttgtatttttagtagagatggggttttgccatgttggccaggctggtcttaaactcctgacttcaagtgatctgcccacctcagccttccaaagtgctgggattataggtgtgagccactacacccggccattgaattgcactttatgtgtctcatctatatggtatgtgaattgtatctcagtaaagctgttaaaaaacaaaaccctggccctgaagggcagcgcagtcggctaaaagactgtgatttaatgaggaaactttcccaccgggctgtgaccgctggccctggctccctttggccgggtggaggtgctgtctgccactgagggccctcagctgctttttcaggatctcagaacatgggaggaccccagctccagaagaaaatcttaattccagtttaatcttaattccaatttaatttggttgagttaaacatttttggaactgtactgtgagctaggcaccaggctagctgctctcatgaaaaaacaggggccctggagctgggcagccttaattattcttgagtttgctacttcctgtgggtccttcccagcctcaattttcttttcagtaaaatgagggttgataataccccatgagattgtggtgacaattcagtgggctaaaaggaagatgcctggaatattgtaggcagaaaatgaaagtttctttccagtgctcctggagcaagttatctctaccaagtggacataacaaagatgagttagttatgtctgcccccgtagagctcaaggctggatacatgacctgtactcgctaaccagggcctggggagaagcaggccaggaggagggtccctgtcttactctggtcctgggttgggaaccggggaaggcttcctcagggagggggcaatgaagtgaggctttgaaggaggatagcttttcgcatgttgtattttattcgctttttgtttatttattttttgtaggcaggtctctctctgtcgcccaggctggagtgcagtggcataatctctgcttactgcaacctctgcctcccgggtttaagcaattctccatgctcagcctcccgagtaactgggactacaggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggattataggtgtgagccactgcaccccgacttagtcactttttgaatagataatcaagtacatggtgccaattcaaaagggtcaaggctgggcgcggtggctcatgcctgtaattccagcactttgggacgcctaggcaggtggatcacctgaggtcaggagctcgagaccagcctggccaacatggtgaaaccccatctctactaaaaatacaaaaaaatcagccaggcatggtggtgcgcgcctgtaatcccagctactctggaggctgaggcatgagaatctcttgaatcccgggggcagaggttgcagtgagccgagattgcaccactgcactccagcctgggcgacaagagtgagactccatctcaaaaaacaaacaaacaaacaaacaaaaaacaaaaggatcagcagtgaaagagaaacctttcccagaggcagccactgttaccagctcctgaagtgtcattctagaaatactctatgtttatgagtgtatgtgcgtatatataggcggacgcttctcatctaggcagattttcacagcatccacattgtggtccgtggggatcaggggcctcctgctaaggtgtgggttaggcttcaggtgttatgttcttgctgctttcgtgtcttgcggtcaggttcggcataggccctctcatcagtaagagtgaggcttcattttcctttagttccccttgaagggagccagcggcgctgtccatcctccttgcccctctgctcccttggcgtgccctctcccagggatttcctctgtctttctcctttgttccccgctcctctttctcgtttgcttgctcccttgtttgggtgcagcatattgacagcagcttcctaacaaagacctttgccttttcttgttattttactttcatacatggttgatagtttagctggatagagaatttcaggttggggccaggagccatggctcatgcctgtaatcccagcactttgggaggccgaggcaggtggatcacttgaggccaggagttcaagaccatcttggccaacatggtgaaaccccatccctactgaaaatacaaaaattagctaggcatggtggcacatgtctgtaatcccagctactcgagaggctgaggcagaggattgcttgaacccaagaggtggaggttgcagtgagctgagattgtgccactgcactccagactggatgacagagccagactgtctccggaaagaaaaaaaaaagagaatttcaggttggaaacaatttttccttgacaagtttgaaggattgctttgcacttttctaacttctgaaactgctaagaagtccaaaacctttctgatttctgatacttttgtcttttttttctttttaccctcctttgggaaagcttacaggatctgaaattggacacagtgccttggtgtaggcctgtgttcatctgtttcgtgaggctctcagcaagtccttccagtgtggaaactcatgtcctatcctgggagtttcttgaaacattccttttcttgccctctgttttttactgttctgtctttctgaaactcctattatttagtttttggatctcttggactgaccctctaatttttttccctttttcacctattttccatctctttgtctcttttcttcagtttctagaagatttccttttatctttcaacctttctattgctttgtcttattgtattttttaatttccaagagcttttttgctccccaaatggttctttaaaaatgtgtgtagcatcctatgttttcactgatgtaatcgtttcttatttctgtgagaatgtgaatgccatgtttgtctctaagttttcttctccctgcatagttggtttcctccaaattgctttctctgctctttcctttggtctccatcctctttgaatgaatctgcccagggacctttggttgcccactcataattattaggagggtctaaaatgctgcctgggagctggagcaggtgggggtccagttctgagtttaccagtacatgatctgggcaggctgtttgttggggaacctcagtgtcaacacctgggagctcagttggggaagggggtagcatgcaaagagtcacgtaacctgccacccccatttttggcaaggtccccaggccctcaactgtgcctcgaatttcccagtccagagaccccacacttttccctccccagaaagtaaacctctgttcttccagggctggagaggggaggtctctggcatgagatgggggaggtaggggtctaactgctatttttttttttttttttcctgagacggagttttaactcttgtcacccaggctggagtgcaatggcacaatctcggctcacttcagcttccgcctcctgggttcaagtgattctcctgcctcagcgtcctgagtagctggaactacaggtgcatgccaccacgcccaactgatttttgtatttttagtagatacggggtttcaccatgttggccaggctggtctcgaactcctgacctcaggtgatccacccgccttggcctcccaaagtgttggcattacaggtgcgagccactgtgcccagccctgattgctttttgaaagctttcagcctgccctctttatacacggcagcccgttcagcccattgtggaggtgggaggcctggagctgcagttccctggcctttggaggattcctggtggatggtgggaacccgggtgttctcagcctgctccagacccaggctgtgaggtcagctgacgcgagctgcgctccagcttctgcagtcatgttgctgttgtctcctctcctgttctgcccttgggggttcatagctttaaaaatatatatatatttgctgaagtcttagtgggatttcataagggagggagaaaaattagatgcatacctgagacaggagcaggacttgcatgggcaaaagctgggacgggaagggtgttctaatggtagagggagtgctctgagggagaggggcaggtgctaggatttctgagaacaaagaggaggcagctgggctgcagctggagaatccgggaggctggggcatggggggacaaggctggacaggcagggtgcactaattttgggggaggtccccaaggagacttgagtttcccacctacagacagtggggagtcagagaattaccccacttttcaggaagagtgccgtcatgcctgtatttggggatgctagctatccctagtacctaatgtggattggtagctagagctgtggtaatgagtaggaggtttttacgatagttaagtagtaagaagaggacatttcagggtcctcttcttagaaatgaaaagagggaaggatgtgagggattaaagaggtaaaactgcccagacttcttgaccagatggtaggtgagggaggggaagagctaaagaagaccctaagcttaacccttggtgaccagggagagggtggtgaggaaggaaggaggaggtgtctggttgggtttggtgtatgtgtgcagtttgggagggggagtgagggggtagggggcgggggctaagttctgctatagaataggcatttgccatgtccaccaaaaagcgtgattttacacccccacgcttcaacctccaagtgcctgtgttgatggagagagagaaagaaggtgttgagagcaggggtaaagaaatcagtcccttagaagacaaaagaataattttccagttgttaaatgagattctcaaaagaatttttatgttgatatcctcaaagattaattcatgttgcagaatgtcattggaactaccttaagacattgatagagtgcctgtctgctgtcttccttagctcatcctcatgttttgatcaaattaagtacttggacaccaggtctgtaaaaaagaaaagagccttctttatttgggttctgtaggcaaaagggagagtggagaagcgactctgtctacgctgctcccctcactccccgtctctgggcccttctgggatttgcatgccacccactgctctgtcaggagtggctcttagggaagtgaggaaagggccttgattatagtgtttgccaatttctgtggcataaatatgcccactgtggcccgtgtcaggctaccaacgtgatgtcatagcacagagctggagtcaggcaagcccgtgggagtgagtcgtgccctggggtcacagtgggtgtcctcactgacacggtgcagctggacagcagaatctcatctttcaggtcgtctgacttgttctaagggtctgtcagggttgaatcatgcttgccaagtagcatcttaaaagatatttccactgcagcagccccagcccttcaacctgggcttctgtggccttctaattcttccttctctgcctcccctccacccacccccacatcatcagcagcagatccaacatgaataccaaacactcacagttaatactaaaagccaacaatttttttttttttgagatggagtcttgctctgtcacccaggctagaatgcagtggcgccatcttggctcactgcaacctccacgtcctgggttcaagcgattctcctgcctcagcctcccgagtagctgggaagctgggattataggcgcccgccaccgtgcctggctaatttttttgtatttttagtagagacggggtttcaccatcttggccaggctggtcttgaactcctgacctcatgatccacccaccttggcctcccaaagtgctgggactacaggcgtgagccaccgcgcccggcgacatttttcttaaagttcaatctctcatctctgatgcagctcgcactcattattgccatccttggagcagctgtggcaaacgagtagcttggatgtcagtaggaagtcttgtctctacaggctgacctgcctggactgttgctttgcccttttggttgtgcgttctggaacgtgatgcctgtgcttgtcagccttgatgagtcacattgaaaaagctcttagtcatcccaggccctggctgagtcagtgtattgggtgacacctgtggccaagcactggctgttttacaactgagactgtcccagaactcttaggcactctggtctcaggggaagtgttcttcatctagttcaaggccagtctttcacccgagcctcgcagccttgttcccggactcgccccaccttttattctcatccttccttcttcaacttgtcattccctctcaactccttccccttcctcttcctataacttgctaaacatcctcccaagcgtctgccatgggtataacagagaatggattcatgcctagaatacataaagatttattacagctcagtaagaaaaagacaaccagcccagcagaaaagtgggcaaatgatgtgaacaggcagttcacaaaaggaaaaacctaaaaatatatccacaatcataagaaaatagccaacttcagtaataatcaggggactgaaaattaaaatgataccattttatactacaaggttgacagaaatcaaagtctaacaatataacagttggtaaagatgtggggagatagacattctgttgtatttctagtggctgtgtaaattattaggataactaccttgagacttatttggcaatattgatattaaaaacttgcctattggctgggtgcggtggctcacgcctgtaatcccagcactttgggaggctgaggtgggtggatcacctgaggtcaggagttcacgaccagcctgaccaacgtggtgaaacccgtctctactaaaaatacaaaattagtcgggcatggtggtgcattcctgtaatcccagctactcgggaggctgaggctggagaatcgctcgaacccgggaggcggaggttgtggtgagctgagatcgcgccattgtactccagcctgggcaacaagagcaaaactctgtctcaaaaaaacaaaacaaaacaaaacaaacaaaaaacaaaaaaacttgcctattaggtgggcacagtggctcatgcctgtaatcccagcactttgggaggccaaggtgggcagatcacctgaggtcaggaggtaaagaccagcctggccaacatggtgaaaccctgtctctactaaaaatacaaaaaaaattagttgggcatgttggcgcacatctgtaatcccagctactcaggaggctgagccaggagaatcacttgaacctgggaggcggaagttgcagtgagccgagatcgcgccactgcactcaagcttgggcgacagagcgagactctgaaaacaaaaacaaaaacaaaaaaaaaccccatgcctattgtctgacgcagcaattccaattctaggtatatgtcctagagaaatttttgcacattttctatatggggtcaaagttattcattttttaacacttttaatcgactacttttatatagacacaaaaatagagcaaatagtataatgaactctatgtacctgtcgcccagcttcaacaatgatcattttgtcagcctatacaacacagttcttaattgctaaaaattggaaacaaccgcggcgggggaggtggctcatgcctgtaatcccagcgctttgggaggctgaggtgggtggatcgcctgaggttgggagtggagttcgagatcagcctgaccaacatggagaaaacccatctctcctaaaaatacaaaattagccgggcatggtggcacatgcctgtagtcccagctactcgggaggctgaggcaggagaatcgcttgaacctgggaggcagaggttgcactgagccaagatcacgccattgcactccagcctgggtgatagagtgagactccatctcaaaaaaaaaaaaaaaaagatgaaactgccttatttatttatttattttttgagatggagtctcgctctgtcactccagcccaggcaacaagagtgaaactccatctcaaaaaaaaaaaaaaaaatgggaaacaatctatttgtcactgccttagtctgggctgctataacacaataccataggttcattaaacagcagaaatgcatttctcacagtcctaaagaccagaaagtgcaagatcaagtgtcagcagattcagcgtctggtgagggcccactgcccggttcatagatcactgtgttctcacggacaaaggggaaacagagttgtctgatctcttctgtgaggcttctaatcccattcaggaaggctctgctaccagccgctaatcttctccccgaggccccaccttctgacactgccacattggttagggtttcagcataggaatttggtgtggacacaaacattcaggcaatagcagtccctcattcggcatgtacagattgcgatatgtctaatagaacattgtgcagtcattcgtgaagtaggtctactgtattaacatggagagatttcaaatatatattgggtaaaacaagttaaaatgattatatcatttatgaaaaaaattagaacatatggttatgggcacacaaatatccaggtgaaatcaacaaaggggaagtagtaactctgcattgtgggccccctgggagaaaaggagaaaaggacccggaatggtattaggaagaatcacaaaggaactgcacctgtttgcagagtgtggttttttttcccttttggtaagtttaacttttattttatcaaaataatacatgtgagactgggcacattagctcatgcttgtaatcctagcactttgggaggccaaggcaggcggatcacttgaggtcaggagttggagaccagcctggccaacatagtgaaacccccatctctactaaaaatacaaaaatattagctgggcgtggtggcgggtgcctgtaatcccagctactcgggaggctgaggtgggagaattgcctgaacctgggaggcggagattgcagtgagccgagatcatgccactacactccagcctgggtgacagagtgagacgctctcaaataataataaaagaaaagaaatgaggcctcactatattgcccacgctggtctcaaactcctgggcttaagtgatccacccaccttggcccccgcaaagtatggaattataggcatgcaccaccacacccagctcccactcctgtttcaaagcccacttgcccaagtctcatgcccctaaagcctgtgggagatacctcaccatggctgcatccctttatcatggtgccaggtccataccagggctgacgcccacaannnnnnnnnnnnnnnnnnnntttgttttgttttttgagatggagtctcactctgtcacccaggctggggtgcggtgtcgcgatctcggctcacagcaacctccgcctcctgggttcaagcgattctcctgcctcagcgtcctgagtagctgggattacaggcatgcaccaccacgcccggctaatttttgtatttttagtagagacggggtttcaccatgttggtcagggtggtctcgaactcctgaccttgtgatttgcccgcctgggcctcccagagtgctgggattacaggtgtgagccactgcacccagccaagattttacattgttaacattaagttaatattcacatctgaaaatacagagtgtctactatggtggcattaacttttcattttcctggagttgatgttcatccccagacaagttgtgcgttgccatctcctcttcattctttcggagacaccaggtaatctgcctttttgtttgtttatttaaggccacatccccaggagctgctgtccaggtgcctggcgggtctccaggcctgtggacagcgagcgacctgggcctccctccccatcgccgtgggagttccctttgcctcctctgtgctggctgcccaggtgcctggatcccttgtcttccttattcttggtttatttagtcctttgttttgttcgtgcccatccctgggcttcttgggcagacaggctcacaggtggcacacctcccaaggcctggcgtgtctcaaaagattggtattttacccccactggattagtagtctaactggatagaggactccagcttgggaagcgttttccctccaaaattggaggacattactccagaagcttctgactccatgtcactgctgaagacagttgtgtgtgacccttggtcttcagaagtgtggtaggctggagatggcctccaaaggtacccaggtcctaatcctagttgttaccttagaaggaagaagggctttttcagatgtgatgaaggattctgacctggaaaggtgatcccggatcatccaggtgggccccgaatgccatcacaagtgtccttagaggacagagacctatgctgaggagaaggcgatgtggagacagagccagaggtgggagtgatgtggccacgagcaaaggagcccggcagccatagaggctggaaaagactcgggagggattcgttgcaggccctcggaggggcgcagccctgccctcacttggtttcggcctgtgaaagtgatgttggatttttgacctcccaaactgaaagagagtgggaggtctcttttggcatcccaaactgatctttcttctgagtgggacttttggcatcactccaggcgctccaagacctttccacatggatacgcgtccttcagtcccgggagactttccagcaggattcccctgcccctggctctctcgtctccccttccgggagtcccaggcagctggatgctggacttgctggactgagtctcttattttcttatcttttctcctattttccatatgttagtctttctgggtaatgtcccaaactatcttctaattctctatttattatgtttaaaaattttgcaactctatttttaatttcctagagctctttcttgttgcctttttaaaatagctgccgcctcttacttaatggatgcaatagcttttcttgtttctctgaggagataaattatagtttttctgagtatctgttctctatattacttttctcctcaatgttcctgttttttaaaaatcccaatttgttttggtgaattttttggtcatttcctcaaatatctggtggtggttcgctgaccgttcacactgaaaaatgagacaccaacacccattggcaagtctgggttggggtggagcttggtggcccctggtcctctcgctgggagatgagactgggctccctggggagcccactgcataccagtagctgcaggactcctggttcctggaacggaagcttccagttcgctgcctggaaaagagcccagtaagcactctgtggagccgagaggaccttccacacattccccaacagccatgtgatgcctcacctcctgggccagccctgatggccggggctggagccttgtatcttgggaaagacgctgtggcacagtggtcaaaggcaggaccctaggttctgaagccaggggcgtgcaccgtggcactgacacatcctagcagcgtgccttcctgccttcgtctctggagcgggctgggatgactcccaggtctctgcagctcagaactctttacacaggagactcactgtctagctgtctgttctttccagccggatactcttcaggttcaaagctgagtcactgtttctacccacattggcttcgcgttctttaatttggtgttgccatcgttcaccttaaaacccagggccacccttccctgctgcctctctgcctcccatctaatgggtgctgttgatgccacctcctaagtatttcttggcacagtccctcttcattcctattcccaccaccgtggttcaggtcctcattgtctcttgcccacattagaacatcttcctagctgaccttctacttctcatctttccttctcaaatccagcttccccagagctgccacagtggtcctgagctctcagttgcaaatctgtctccctgctgcctggtatttccatagcatcccgacatagaggacactgcccaagctgctggtggggcccactagctctggactgagtctcaggctcagcccttaggctcctctccctgcctgcactccctgcctcagcgggccacgccaggctgtttgcttcctgccttatctgcctttgctccagccgccccagcacctggacctcctcccctcctctgcctgcccccctccctcccctcttctccctctggacgtcccttcctcctcccaccctggagtctttccttcaggccatcttgctaactctgccctgctctccacgcaggcgtggcccgcctcatcatccttcacttctcatctctgctgcctctcactcagcctgccccagccagctgatcacagtcccaaatagcgacatgctctgaaagccaccgctgtggcctgcatcaggatgtgcggatgagaggggggtatttttaccatcattgtgcttctccagcccctggtgttaggatctgtataggatctggttatttgtaggcaacctgggtgtattagattcctacagctgccatcacagggtgccaaaagctgggtgaaaacaacggtgacttcttgcctcacatctggaggccagaaaccccaattcaaggtgtgagcagggccgtgctctctcggatggctctgggagggtcctgcctggccactgccagcttctggtgtttgccagcagtccttggccttgcctgacttgtagctgcctcactccagtcatgtggccgtcatctcctgtgtcttcacatcttcattctgtgtgtgtctgtgtccagatttccccctttttataaggacactaagcatattggattagggccaccctaatgactttatttttacttgattaccctatttccaaataaggtcacttttttttttttttttttttagacagagtctcactgttgcccaggctggagtgcaatggcgccatctcggctcactgcaacctctgcctcccgggttcaagcaaattctcctgtctcagcttcccgagtagctgggattataggcagccaccaccacacctggctaattttttgtattttttggtagagatgggtttcgccttgttggccaggctagtcttgaactcctgacctcaggtgatcagcccacttcagcctccgaaagtgctgggattacaggcgtgagccatcgcgcctggcccaaataaggtcacattctgacctaggtgctaggggttaggacttcagtgtatcttttttggtgggggacacaattcaacctctaacaccgggtgacacccgcttgtcctgagcttgacaggtcccgaagtccccaaggcctctgggaggccctctctaatccagccagcattcatgtcctgtcatcttggaacgaggggaattgagtggggagcaggtcctgtgaagctctccagcaggggtggggtggcctgaagagggtcgggaaatgtcctgggccacctgcaagtgtctgctgggtcctggcatcttcctccctgcaaagattgtccagttctgtttagaattgagtctttggtgcccctagcctctgtcgcccctcgcagccctgaaactcagcttccctggttcccattgccaggctgcgtctgagtccttttgggctttagtgacaaaataccacaggctgggtggcttttaaacaacagacatttatttctcacagttatggaggctggaagtccaagatcaaggtttcaacatatgggtgtggggggcacaggcacgctctgcattagtctgggaggtgctttttgctgaccttgtccttcagaccctctctctgtcctgtcaacatcactttgggctctaatcaatatgtatgggacatttgtgtgtcccactagtgtgtgtgtgctgttcccaggaggggccaagccttactaatctttatctgaatgctccataatatttctaggtaaatctttttttttaactaattgattaattattttttgagacagagtcttgctctgttgcccaggctggagtgcactgggaccatcatggctcactgcagcttcaaccttctaggttcaagcaatccttctgcctcaggcttccaagcagctgagactatctatgggcaccaccatgcccagctaattttttttttttttttttgagatggagttttgctcttgttgcccaggctggagtgcaatagcacgatctcagcccaccgcaacctctgcctcccacgttcaagcgattttcctgcctcagcctcccaagtagctgggattacaggcgtgtgccaccatgcccggctaattttgtatttttagtagagatggggtttctgcatgttggtcaggctggtcttgaactcccaaccttaggtgatccacccgcttcagcctcccaaagtgctgggattacaagtgtgagccacgtgccaggccacacccagctaattttaaaaagttttttttttaattttttggcagagacaggatctcaatatgttgcccaagctgatctcaaactcctagactcaagtgatacccctgcctcggcctcttaaagtgctgagattacaagcatgagccaccacgcctcacggtgaatcttaacagcctcatgccactctgcaacctcattgtgacctgaagtatttcttcactgattcattccctcagacatttatttagttctggtcttacgcactgtacagagtgccagggagatgtggggacaaaagagaccagggatcctgtgcccagggccctaacagtgtctattaaaggagacaagacgggtcaacaaatctttataacattaaatgctctttgctgaggacacagacgccacggagacctcatggagagccccctgagcaggacgatgggtggggcacagacaaggacagagctgagggaggtggctgcccggggaatatagggaaggcattcctgagcctactcctataggatgtggaggaatggggacaagtgaccttcccatgtgagccctgcccacaccccgtgctgcagggtcggcaggaagctggctcctcgtgcgccagggggcagtgttggccctgaaattctcactgctttccagtgaggctgggatggagcagccacctcactgcaggccctcgggacccctcactctgctttctctgagaccccctttgtcccccagtccacaagtcccgagaccatggcgccagtcgcctcggtgccaccctttccccctcggctgctcctttgaatagagggttgccagggcgatgaggagccctgctggcactgttcactgctgttcgtcgccgcagtgccacttggagcagccggcgctcctgggggcccagagcccggacagctgagcctcggcgagcacccgtgctgtgtctgtttccgtctttggtattgtctctctcctgtcttctgtgtctgtcacctgcattgtttccagcgtcctcccttctgccccccctgcccagaaatctcagcctcagtctgtcctctcttgggtgctttgatatcagccgtggcagccctgagagccaggtggagtcgttctttcatctgtccctcttggctgccagccctggggcccgtcggacatgtttagagcagagccgcctggggagagcggccccatccgtcagagctgccaccgccgcagccccgagtgctctgccaagagctctttctttctggttctgacctgctttcactggcagctgtggagcccagctggggctaggggcacagcctggtgcgggtgctggtgctgggggcagctgggcccataggaagtaggtgtgtggagctttgttggttcggaggttcctggggcctgtttctgaaccacacttctttcttctctgccctctgctgctctccagcacacctctgaggatttgctgagggacccaggtgctctgctgggctttcagaaccaacttgctggccacccgcccctgaagcagggcctggtctttcccttcctctgcggcctcttgcccactgctgccctctgaggctgcaggagacgctctgtgaggacaggaatatgtaggacgaagcgatgtggggcctcagctgcagcagctcttaggtggcgccctgccctggtccccagaaaggctgctgagcactggggccacgttgttgtctggaacaaaacttgggggatgatggcctgacagcaggattctgtgctccttctggttgcaagaggcatcctgggagatgtagttcaggtctgaagtagtgggatttcagggacattttgatgatttattagacaaattgaaactgccttggcttatctgggacatgtgactgctgacattgttcgtcagctctcgttgggaagctctgagtgccactggtggccctgctggaggccaggccagtgacagttttatcagaagtggggtttttggttttggtattttggtttccaagtgcctgtcacactgtgctcctgatgaaagccgtgacttactcctttagttgagtgaagagtccataggccaactctgatgggtccgagctcctgctctggagggggccatatgaagcgggctccaggccggctctgctggtggcctgggtgtgtcacttaatcccactgcacctggtcccttacctgtacagggaggtgatgaggggctgtgagggttactgagtgagtctgcgtgaagagccacagtggcccctgcctggcaaggagcaaggctctgctggggtcactgcccaccattgtgccctcctccactggcactggccgggcaccaggtggagctcagtgagtatgtgttgtgtgctatggaagcggcagctctgtcaggagcggggcaggtgacggccaggccctcgccctgcctcagcctgcaggtcgtcgtaggtgccttcctgactcccttctggaaggggaatgctgagttattgatctgaagctgaagctgggagggaaatggaagctgtggagtcacccgagaggcagcaggggaggaagcaggtgccccacacactactggcttcactgtggctcattcttgcttgcaaggagttatttacacgtcccaagtgacagtcaaagctgtcttatttcttggtctcttatgcacaacccgaggccaagaaaagggatctgtcagctggcatttgcagaaaatagcaagtgggtctctgggctgtcagctctctggagaggaaaacagggtgaaggatctttgggtgatggtggttgcttttctctcactcactcactactgtttccccatttctgaggtcagaaagggagagctttgcttgtgtgtatcaccaggagcaagcaagacagtggcatcccccgaggcgtgtaactgtaacctgagctggttgctggccctggcagcatcccagaatgcccttcacacctggggctctagcagcctcccttgaagagttgcggctcagctcgagggagcaggaaacggctctgtgggttctgttagtaaagccctctgcatttccagggaagcttctcagccaaacttgacaaccttgagaacttcttgattgccatccaccaaccaaatacccaaaagcagggtgcagcatgggactgcagcatgggactgcagcatgggaccgcagagggagcctggccccagccattgctgccccctgcttcctgtgcctggccatcgcctattctgtgccgtgctgtgaagatggcaggaagtgcctggaatggtgccagccagaagggctgcagactggtggcacttgctgggaatgtgccattgtgagttgaaaggctggcatactccagtgtctgggcttggtttcgtacagcctgaggaccgggagtgtcattaataccagaggcaaggcttctgggggtctcaggaaggccgtctcccaccctctgctgccacttccgagggtcaccataggtgcctccagctgcaggggttccttcttctataccccaagtgctgtgcagaggcccctgctcccttcggctttggggaatggtctagtattggggagcagggggagtctgcccacccagctcctccctttgaaccatcccagacccctcaagctcagcatacccagagtcggcttattccaccataaccttgaagaccctgcttcctggagagagggtggtgtgagggggccacgcccatcttacagtgcggtttctcccagccgatgttgattctggaaaggcctgggtttcagatctgggaaggcagtgccattcgataaggaaaaactgggttaaccaagttctaggaagggtgcaggcgccctgggaatgcagtggtgtttcagttcatctttatgtctgttgggccccatccgtgcctggcattgtgtgcgggtcagggagagacaggttggtggtgggggtcttgtgtgaccacagcggtgagcttagtttcagggccataactaggttctaaggagcagtgcagccctcaccctccgtcattcacagcagctcctgacagccttccccagccccacactgcctgctggccaacatttccgtgtcttccgcctcactcggcagcacatcccaaatccatcacagaaacctgccctcccgtctctgactgcctcctgtctcagaccacctccctcatcatcttgccaggtccctagggggccgagggagcaggctgtgggctgtggatcagctactctctgcgtgacccaacctcccgcctccctgcagccagcggcccatgccagcttctaggcctcaggttcacagcctctaggctcactgctgccccttcccctgattgcagcccaggcctccagcagccttgtgttggggaactttgtattctgggccagtaacctcaggcagaagagcagctgtctgtggctcctcagacaccctcctctgtgcactgaaggccggtacagggtgagtgctctgggacaggtgcccccctctctgcaacacctgacactcccaactacttttgtttggggtgggtcttcctttgcagaggaatgttggggacaggtttctgcattggcaaaagcacgtggtgtcctcgggcctgtgtgtttgctccaagtgtatgtgggcatcacacctgctggctcccctatgcagtgaactctgctaagcattgggtgcatggtcagcctggcttggtgggtgggctgcctgtgctgccttcaccccaggacggcctggcctgtggggaggtcagcatggagctgcatcatggtgcgagtgggagggcgcaagtgtgtgggccttccagctgtgtggggccgggggcttcctccctggccctctgttcatctgggaggggagggagttgggaagatagtgacagcagctgatgtttgtcacccaggcatggcgctttagctgtactgtctcagtcgacccccaggatgacctgcttagggtgggctggtggaaccccgttttacagatgtgaaagctggggcctcagaggtgcccaaaccatggagctggggcagcccccggccagtggactgtgggcctgcgctgggctgtgccccagaggaggctactctctgttccacttttccctgctctgacttcagccgaagagccctgatcttttcccttccataaacatctgcctggcatgctgccacccaaagagctcccgtgccccggggacagtcctcttggcctcaagtctaggcctgctttcgcttccctctgagggacacaaggactcacggaggcattcctgtgccccccgctgcccacagcctccggctcttggtggagtgggactgctaaggaatcctttacccaccaagaaaaaatgaggatccaatgcaagaatgtatgtgagaggggccgccgagggggcggcaacatgtcagcactccatcattttcctgcctgagctaagcagacacttggtggccacgctgtggggcagggtgcagccttccagaggctctggaggtgaccggcctttggcatatcttctgaggaaatctctttctttgcatggaaaaggcagtggggagtgagtgtggtgtggacaggggaggagagcaacaaaaatgacctgtttacccacaaaccacgggtaagtgcccctgtggtcgcagggtaaacccacccaggtgggaggaaaggactggggctccctggaaaaagcttgaaactgccctggaggtttgagaatctcggtgccagtgggctgctgccagctgtgaggctgctcacctataggcaggccagcaggtgaggagggggagggtgctaggctcctgggagacacatagccaagtcctcccacccaaggagtcggtgtagcaggagctcccttcgccttttcctgcggagctcttcctgtcccttctgtatatttcttcttttttttctaattataaataacgcatccccaatggagaaaatatggaaattttccatatggaaatatagaaaagcataaagaaggaggaaaacacaactctacagcaattccatagcacgtgggagtgaggagggtggcatgcaagcagtcctacagttgttgccattcctttaaaaaaacttcatgagatcatgttgtttaccattaaattttcttggcttcacattacatcacaggcatttcccatgtcatcaaaacctgtgcaaacacattattgttaatggttacataatgtctgtgggagccagggtgtggaatctttaaattgcttctcatgattttctgttgtaaataatgctgctttgaacatctttctgcgtacatcttggttcccattttggaatatttcctggggttggatttctggaatagtaatgactgggctcaggggcataacccgccaccatgcctagctaatttttttgtattttttagtagagatggggtttcaccgtgttagccaggatggtctccatctcctgacctcgtgatgcacccgccctggcctcccaaagtgttgggattacaggcgtcagccactgtgcccggctttttttgttttgttttgtttttgagatggagtctcgctctatcacccaggctggaatgcaatggcgcgatctcggctcactgcaacttccgcctcacaggctcaagcaactctcctgcctcagcctcccgagtagctgggactataggcgcccactatcatgctgggctaatttttgtacttttagtagagacggggattcaccatgttggccagggtggttttgaattcgtgacctcaaatgatccgcctgtctcagcgtcccaaagtgctgggattacaggcgtgagccaccgcgcctggccgggcataaataccttaaaggctcttgataagttttgcaaacagcttcccggagaagctgccgtgatgctcagcagtgcctgcgggccgcctcctgaaggccttcctggcgctcagcactgcatttacaaagctcccaggcaggagtggcacctcatggttgtattttgaatctcttgctttctcgtgggttcaagagccacttgtgtttgctgtcttgttgctgtgcttgtcccgaaggctcccctcgcctcttcctgactttgccctatgtggtaacttgagctcttttgacatggcctttcccagcgctcagcagagtagacatttggtgcccaggaggagggtgagatttacaccccacacctgctctctgatgccagtgccgcctgctcccagctgggaaagacctgtcctcctagtgggcagcatccgataactcgcctggagcagggcttagaggattgtagatctgcatgtgggagatagcagggtgataacgtctgacgttcatcctgctctgagcagggtgtctccacacctgagctcctcgctggtgctcccggcacctcttgagcagcaggtgctggggcatgcactccctaaggttatctcctccagcggcattagcggtgggtatggttcttttcacttgtcaatttgaaatgatttcagactttcagtaaagttgcaagagtaagacaaagaattctcgtacccctgaccccagttcccccaatactagcatttgcttcattgttcccgtttttccctgaaccatgtgagtgggtgtaaattgcagatgtggtgctcgtggacccttgagttcctcagtgtttttccctaagaatgaggctgttctctaacataaccacagtccactgatcaagatcaggaaattgatatcaacgcaatcctctttcaaacctgcagaccttatttaaattgtatcgttgtcccctgatgtcctcttagcaatagaaacccggatccaatccaggatcgtgtgtggctctcaccattgttgctttggtctcctttcatctgaaaccgttcttgcgtctttgtctctcacgacctttgacatgtttgaagagtccaagccagttattctgtggaatttccctgaatttgagtttgccccttgctttctcctgattaaattcaggccgtgcacggcagcgggaaccccatcaggaggtgtgtggtatcccttcggtgctagtgatattaaccttcatctctcggtcagcgtggtgtccgccaggtttctccactgtgcaatgaataaggacaaggtatattttagaaagaggaggagcccagagtccagcaaggttactctacccacgttcaccatagccgggtgtgacctgggtgcctcctggtcaccgcagtggccccttcccagcccccatcttaccctgcctctgggagtcatgctctgcccaactcgcgccccatcctcctgagagccgctcgcttctgcccagcgacccgtgcgtccctccctcctccaggcatcccccctgggctccttcttggctcttcctcctcggccagactcaactccagtgggcctgaagacgcaggcctgacccacttctcccaggctgttctctccctggcttcagacaccaccgcccctgtgatgctgcccaggttcttgtccctgctcttccccctctgtgagcttgcctcactcccagccctgccttttctgtcttgcccttcttatagcaggaaaagtcatctccacccacccatacaggatttcttcctctaccttgctttctatggggggtctctcgacgaatcttgtctgtcatagcccagatgtttcctaagccccaccccgacccccatagcttccccctgtcagaggctccgcgtctctcagctcagcctctgaattgccccagacatgcgtcgtctgtcagcccctgctgctcgccagtccagagagatcctttccactgtgcatcgatcatgtccctcctgtcctgtccatggctgaagggaggcctcaaccactgggccctgtctgtggctgcagccccacctcaggccgtgggctcacacttccctctctcaggacagcaccaagcctgttcttcctgagaacttcacaattgctatcccttcttcctggagctttctctgcggatctgtgcgtggccgacttctccccatccaggtcccagcttctgtgtcccctcctcagagaggccttttctaatatccagcccccaaacccctgcacccgccccagatcattcgcaaaatgtcacctgtttcttatcttccaggcacttgtgatctgaaatgttctgatttgtgtcttgtttttcttttctttgctcctttcactgccattcatcttccatgagcagaacccttcactgttgtgttctcgactcctaaggcttagaactgtgcctggcataaggtctgcccctagtggggttttctgtttttctcccctggctgtgggtctttcctcctcctcctcttctctttcttctacttatttccttgtttcttctcttttctttttcttctgtctttatttccccttttctaggttgttggctgtaatatggcactaaggtttttgcaatatttgtttcatttcttgagtatgtttttatgttccttacttaaaacaaaatggctgagtcaagtgttttaaacgttttctaagaaatgaatcagatcggccgggtgtggtggctcacacctgtaatgctagcactttgtgaggccgaggcgggtagaccacttgaggtcaggagttcaagaccagcctggccaacatggtgaaaccccatctttatttaaaatacagccaggcgtggtggttcacacctgtaatcccagcactttgggaggccaaggcaggtggatcgcctgaggtcaggaggtcgaggccagcctggccaagatggtgaaaccctgtctctactaaaaatacaaaaattagctgggcgtggtggcgggtgcctgtaattccagctactcgggaggctgaggcaggagaatcactcgaacccaggaggcggaggttgcagtgagccgagatcgcaccattgcgctccagcctgggtgacagagcaagactctgtctcaaaaaaaaaaagaaaaaagaaaagaaacaaaacaaaaacaaaattagccaggcatggtggtgcatgcctataatcccagctacttgggaggctgaggcaggagaattgcctgaacctgggaggcagaggttacagtgagcagagatcatgccattgcactccagcctgggcaacaagagcgagactccgtctcaaaagaaagaaatgaatcagatggttagatgaggcccagatgcaggggtgaaaagagtgtgtctggtttggcttgggctctgtgctgggcagctgtctttttagtctccactgtaccttggtttccttcattttacaaatgaagggctggccaacctctgaagcctctttgcattcagggatataagttgtcgtcagttgatttaaatatatatataatattatataatattataatattatatataatatatattataatattatataatataatatataatattatataatatatataatattatatattatattatatataatatatattttatatataatataatatataatatatataatatattatatatatttatattatattatatataatattttatattttatatataatatattatatataatatatatatattttttaaagatggagtcttgctgtgtcacccagactggtacagtggtgccatctcagctcactgcaacctccacctcccaggctcaagtgattctcatgcctcaccctcccaagtagctgggattacaggcatgtgccaccatgcctggctaagttttatattttctgtagagacagggtttcaccatgttgcccaggtgggtttcaaactcttgagctcacacaaatgtgccttggcctcccaaagtgctgggtttacaggtgtgagccaccgtgcccaacctgaagtattatactttttttttttcctgggacagagtcttgatgtcacccaggctgagggcagtggcgcaatctcagctcactgcaacctctgtcttctaggttcaagcgattctcgtgcctcagcctcctgagtagctagaattacaggcgtgtgccaccatgcccggctaatttttatatttttagtaagaggcggggtttcaccatgttggccaggctggtctcgaactcctgatgtaaggtgctcctcccacttcagcctcccaaagtgctgggattacaggcatgagccaccgcgcccaacctgatacttttattttttttgagacggagtcttgccctgtcgcccaggctggagtacagtggcacgatctcggctcgctgcaagctctgcctcctgggttcatgccattctcctgcctcagcctcccaagtagctgggactacagatgcccgccaccacgcccggctaatttttttttttttgtatttttagtagagacggggtttcaccgtgttagccagggtgggccaacctgatacttttaaaagttatagtgcatattatgctgggtacggcagctcacacctgtagtcttaactactcaggaggctgaggtgggaggatcatttgcgaccagcctaggcaacatagggagaccctgtctctacaacaataaagtcacagttaggatatcaggctgagctgggggttccatttggggttggatttgctcccttctctagagccaggaaatgttgggcttggccaggcatcaggaggtagatggtgctagcctttctgtggggccactgtggggttgggaagggccctcactcattctgaggagcctcagtgctgaggctgcgctaacctgggctctaacttccctccctagatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagcaccagtggggccggtgagaggagcctcatggccgccccagccttggcattcttctcccactcactgccccaggccctggcttcccactcccctttctgcttctcctaggacctaggaatctaacttcttgtttctttgccctctaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggtgagcccagtggcctggctgggcctggacagcagggaccagggagtcttagttgccgcgggggtctcttgaggctggcgtgctcagcgcctctgtgcgtgggtgggtaaacggatgcagctcagcaggttaggcaggggaagaggctggccgaggccttggaagggactgcaaggtaccgtcctctccctgacccccacctgcaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgaatataacgggcaagcaaggggtggccccgcagctcctggagagggtccagcagggaggggtggcagggattcccgcctgttacagagactcccccacacctttctcccaacaggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggtgagtgaagatgcccagggctgggagcagggcagggcagcctgccgtgggggcaggggcggaccactcaagggatctggaaagtgggtggggttcatggcaggggagaggtagcgctgtggggtctgaggtctggctggcccctgcccgccctcgcaggagctggaggagaattacacccgggcctactcagaggctctggccgcctttgggaatggggcgctgtttgtggagaagttcatcgagaagccacggcacatcgaggtgcagatcttgggtgagtggtcctgacgccccgcctggggcagctggaggcgggagctgagaggcccagtcctggtgccgtcacagtggctggccttggggacagccctggggcctgtcgggcgcttttccagaggactctggaaagtgggctctaggggccgagctggcagttggtcctcacagccttggtgatgctggtgtctctcctggcagcctctgtaccgctggcagccggcactgactggcgacagtggttatgtgggggtgatggggcatttaggaggcgtgtagattccagtaaaagctaagcccagtttacctccctccccaggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgaagggtgggcttcccgtgttgggacaggagcctgtgctcacaggccggcaggcctcacagtggggcgctggttggggaaggggaccctgagtccccttctggggactggggatggggagaagagggtgaaggactctcctgggggccagaagtgggtttgtggcatccttcccatgtgcagttgaggcacctggcccagaggccaagcttagagtccaggatggctgagaagagggagggaaggagccccagccgcctcctcagccctgctgctacacagacctggcttctctgtggcatcagctcatccctgtcatcaggagaatgagattccgtggattctgtcaagattgaggaccattatgaaggcagtcctccctcatgtgcttctgtctcctacatcatgtttattatgatctgtttccttgctctgcaccctctgcccatctctgcttttctgggacctctggtcggggggtcctgggctgtggaggaggctgaggtggcaagctatctccccacagtgacctgccccaggactggcctggagagcacctgctgtggccaggtgtgcagcggggtcctgccccctcttcttccctggcctataggcagcagaggatgcgtcacctccccatgccgaaggccggggtgtgcactctgcagcaaggcctcagccacagctaatgcgaggcatcgaccagggtcgcgtttaagtcaggtcttatttactggcttatactatttcacattccagaacaggtttaagggaggtgattcagtctggtttatcgttttggtgagaccaaaagtgaaactggaattagggctgaaatttgagttagagtcattatctgttggtacctctcaaatgaatttctttgggtggtggtggccagaggtgactgcgcagtagactagaaggggactttctgaaaacacctccaagcagaagcagcggctgggagaggcctgggtctccgtgtctgggtggatgacacagccttggcgggcaagcccaggaggcagcagggcaaggtgccgagcctgggatgggtgggggcttctgcccatgtctcgtcccagataagctgggtgcagccatctgtggctccgggaaccctggagcctagtggactacttgggggacgtgtccaggcaggagcatgacctgggccctggggtctgtctgccatctgtgggggcagggtttgccacaggccattcttttacggaaccaacccaatgggtgggacggaatccctgtcctgagtccagtgagtttgcccaggccctgcctgtgccctcccctgctcacgtggccgcccccacaggtgggctacgagaacgcaggcaccgtggagttcctggtggacaggcacggcaagcactacttcatcgaggtcaactcccgcctgcaggtggagcacacggtcacagaggagatcaccgagtgagtgtgggcgggcaggcggggcgggaggcgcggcttctaggatttgcataaagtacaggcgaagtggctcctggggccagccagggggcttgctcactccccacattggtggagagcaatggggatccaggtacttagtgttttaaaagtcattattctaaaagcattacgtggttattataaaaatcagcacaaaggagcaaataaaaatgactgacagccctcctctctgtcaggacgctgccgattgctcaggcccaggtgctcccatctgtcagaggagtaaagcaaggctcagagacatttggagagttgctcggggtcacacagctggcgctggaacccaggcatctccggctgtctttggtttgctcctttcccggtttacctgttttactagagacatagtttgatgcaatagagatgttttatatagaatttttattctacttttcaaattatttaatatttgttgaaggcatttccccaggccataattctgtctgaatacttttagtggctgcgtactattccgtcttgtgtgtatttcttaacttacatagtcctcgattgttaggcaattagtttgtgtgtctggctttggtggttattaagcgtgtcacttatcatctgtgtgcctgaatgtttggcttcagctctgaagagttctgagggtaaacccttcaacaggattatctgattgaaggataagtagcatccctcggaacagccctctagagaggtggcactagcgtgctccctgcaggcactgaggatgacattttcaaaatccgcctggtttctaaatgacagtcatgatggccctcacccttcaaggtctctactatgagccatgtaatttcttgacgctgctttgggccagcccatctcactgtggagcatccctgaccccagttctgcccccagccccaaccccacctgagactgaggatgctgtcggggtggctgctgtggctcgccgggggcatggaggcccctccctccccttaggagaagcttagagacaaggccaacactttggccgagtgagactcttcccctcaagctgctgtgaactcctcggtcttgggtctgcttagagcgtcctgttagggatgggagtctgtctgctgtggagcacgggttttgtgtcagacagattggggctcaggtgctctcaggtcccaagccacgtggagcctgggtgagctccaacctctctgaccctcgagctcctcctctggtgggaatgacagggctctcagcacaccgtcgtggagatgaagcatgggaggagtgcagcctggcctgtggcactgagtggaagctgtcatctctgctgcgaagtgggccagcaggcagcaagaacacggggaaatcctgccagtgtaggttccaggctgccttcaccacaagcctcagtggcaatacatgtaaaaccttgagtggttttttttaagacatagtcttgctctgtcacccaggctggagtgcagtggtgcaatctttgctcactgcaacttctgcctcccgggttcaagtgattctcctgcctcagcctcctgagtagctgggattacaggcacacactaccaggcctggctaatttttgtatttttagtagagacagggtttcaccatgttggccaggctagtctcgaactcctggcctcgtgggattcacccactttggcctcccaaagtgctgggattacaggcatgacctgctgtgcccagcctggtttttttgtttgtttgttttgttttttaaacagctgttccacttggacttgtgactgcccttaggagcagtaaggctgagcttggaaaaccctgcagaggtggggaagcttgcactctccaagcatctctagggggttttgggcacaagtccagcaggaaaacaggcctcagaaggacaggtcctgacccagcacccactgtgcaaccctctcacagctgtggttaccatttcgaggagcccagccttcacagcacctgttcccttgcacactgcccccctcacaaccacccacacagcatagcacatatggccccaagaatgtgctatcctggccctctgacctagagatctgctgaggcttcaaatctaggctttaccaagggggagtttaggggagtggggaaaacagacctcaaggaaggaggaggcagagtacagggaggagcagcttagggctgtgtggacggcaccgtgagtcaggaatgcaggagcaggtggtcctggtatttcagcgggccatctccagctgccaggcactgtgtagtttagtcggctcccggcgggagcagggcaggggctggtggagccactggttgggaggaaccggctgttcaggctggcccagagcctatgggcaggagtcgcactgtgtgtggacgccccactggctgcggtgcccctcgtctatcccccgcctcatgtttccccctttctcccgtcctttcccccctccccccaatgccctacagcgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgggcggagctcgagcagagggagatgccagctcacctgtgcacaggttctgcctggtgcctggggctgcagtgccaagttgccacagcccggcagttagggaggacccgcatgtgggctctgaagtggacatagagtacacggaggcaggcagtgcccagaggaggggcggcgcctcccaggggaagagactgctgggcgcccaggtcaggaggaagccgtgagggtgggagcggggagcaggctggcttggtggagcaaaacgcagggacccagacacaaagccagcccctgaccctccagctcccacaggagccccacgcctggctgccgacggagcccaagcaccacctcccatctgagggatgggctgacatggcaggacctgggggtgggggtggcaaaggactgggcccagaggtcccaatggagtctgagccaagctcaggggcccatcaaggatgggggagggagtcggagatggcggcacaggagggagaccgagaggtagattcggggccgcgagatggcagccttggtgggggagagagtggtgtagggggcgctgaggcggtccacggcaggctcctcagcacagcaagactcgcgccttctccaggagggctccctgtacctttcttcctctcagcaccgggacccagtcattggcctccgaaacccatctcccccgcctctggtcccagctgtgggcaggagccctgcggcctgctcggtgcctgttcccagccctgcacgtgctgccagcaccgtgccagctgtgctagggacttgctccctatccaggggcctgagccccaaaggaggcaagacattgatggagctccagctttgctccagagtccaaggcagaggcccccgggcttgtgtggggcggtgaggggagcaaacatgagtttgggccaggctctgggcttctgagacaagggaggctggggaggctgggggtagggaccagagctctctggattctggaagcagcagagcctgtggcttcagcagggagctggccacctgccttctgtttctggaagagtctgtaggtggcggcagccccaggctgagtgctgcccggcggcccctgacttctctgcctccctccatccccacttccaagccctggctcttcagagcctgcctcatcacagagtatttttagccgacagtttctgctctcagctgagtgttcacccttaaatattttatgaagttcctttttattgaacacaggcctctgcccccgagaagcggaaatgggcagtgggtgtcccgagcccctctgggcggtccccccactccccttcttccttacctgggcctgacgggtcccccacctccggggagcccttctctgcggggctcactcgggcggcacgaacaggtgcaggcggcacgagccacctgtgtgtgtgagtgtcggcgcctctgtctcctcctctccgctgcccctcccattgccgtctggccctggccctgtcccgctgccccgctgccctctcctcgcccttggtttgcttccctgatgggtgtggaccctgcctctggcactttcccttcatttcctctcccacttcctcctcgttgcctcctctccctcccatcctcccttctggaaggaaaggaaaggaaaggaagggagcatgggtggatgttgaggccttccccaccaccctgttaaaaacaaaaacaaacccccggtcagccttgcctcttgcctcgcacatggtcctttggaggccctgtcgccggcctgccgtcccctcgctgtctgggagcccacggcgaggccctttagcggccgggtcagcagacctcaatccgtgctgtggaacgaacgtggatgagtctgaaaggctagagggttgctcaggcaggtgcagcaggtccgtgggaatagaggcagggctggcccctgcctgcccgggcccctctcccgctctgcggcaggcattcccttcctcctctgccccctcccagctcctcacagggagccagtagcagtgactgcgtggcacgtagagaagggacgcactcctgggtttggtggcagaaacagcaaaacctgaccagccagagctgggattcacctgcagacaccccacgctctgctctcagcagctgctgggtgcacacctggccagcctcggggtgggtggggcacttttgaccgcagtttctggcgcaggtcctcacgcctcacccttcccacaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaaggtgagaggctgcagcccccgcctgcctttgctcccggcccttggagggccccctgaccgttcacttccccaccaagggccttgcacatggcttcacctcagccttgcccctgactgatgggtcgaggtcagtggctctccttggctgcagctgcacgccagactccagctgttttcagagtctgcaggcgcctgggcaacccgctgccagagtccctggcagtggcctggccggagctcgtcctcacatgcctcctgtctagtcttgttccggggagacccacgctgtgtcccgcccctctggggtgagaatcacctggaatgtgtgttaaatatcatcaggcttcccttctggaaatcctgatcccacaggtttgggtagaggcgccagaacctgtgttttgaacaagttctccagataattcttttttatttttgaagtggaatcttgctgtcgcccaggctggagtgcagtggcgcgatctcggctcactgcaagctctgcctcctgggttcaagcgattctcctgcctcagcctcccgagtagctgggactacaggtgccccccaccacgcccggctaatttttgtatttttagtagacggggttttatcacattggccaggctggtctcaaactcctgacctcaggtgttccacccgccttgacctcccaaaatgctgagattacaggtgtgagccaccgtgcctggcctcccagataattcttaatttctggaaaatgtggatccccccccaccaggcaagagcccaagtcatgtagatgcggtcactttgcacagtgtcaggcccccgccagccccctgctctcctcacctggcctggtgcacacagtgtcaggtgcttcaggagcagccgagggtgggggcgcagcagagacatgagcaggaggcttgggaggcaacctgcccttggtgggctggcagctcggcttgtctttgggtggccttggtgggtgccctgcctggcatgaggactctaaatgggtatttaggatctaaagagccctttgctgggctctgttactggcgtctgtagctagagaggaatccacagccaggaaatgccgcctcggcctttgaagccagcacgtgtcccgtgggagccaccctcagaatggcaagaagagccggaggacaggggctttggccctcagcccctgtgggagttaccaccccatcttcttcttgggggtccccacagggcgggctgtgctgggcactggcaccggcccctctgccttggcctcgtgtcctccttgcagcttcttccagccctgcctgtcatcgaggcgcagttgcttgggggatgggggggcatgtgggccgtgctgtcccctcagggtcctgcaatcacttctcacatgtccacatggctgcttggtcgcaagagcccctggaggcttctgggcctatgcctgtgtgtgtggccagcctgtctcccaccttaagagggaacagcgcacttcctagaggccagggggtgttactcttccgtggggagcctctcagcctccctgttgggggtccctgtcgtgcacataggcagaggtgtgtcgcgacatcagctgtcgacatcacgcgctccccctgcaccttgctgcggctcctggtgtcctggcggggatgtcctgcggctgcttcggtgttgaggggatgcgtggccatgcacaggggtgacccaggccatccccctcgcctgcccctgcccgttgctctgtggtcctggctggctcctggggttgtgcccggttcctctgctccctcctcaccctcagcagctccccacgtgccaagctggtccctgggccctagaaccttgcgcctgctaggggtgcagctagaggtgggcttctgcaccctggagggcccggaaagatcttcctctttagaccgtcccccgccccccaggtggagaaaggggcactagagaccgtgaccacggggccagcagcaggataagtgtctctggtgtctgggggtgccaagtcctccccaaatgtgcaccaagaccaggccgctggctctagccgcctcctgagcctcatgctagcgcccagcgtggcagccctggccctcctgtccctttgccgtctgtgcccacccaccctgtcccgcgcccccgcccactcctccatggcgttcgctccccacacccttctctgtcgaggaccttgctcccattcatctaaaccaggctctcgaagcccacctctagctgcatgttctggggctgggagggcaggcacacgcgtgtgagccaggtccatgcacacgtgaacacacgtatgccttagagcacctgcctcacctcggctgcccggtggcagcgccttggccctcacacagaaaacaccagggagtctgtgcagcgtgtttgccgtggcctggggtgccagggccgccttctgagttttcatacagcacctgggggagcttgaccctctgcagggctgagggccacgtctgcccatgccccccagccagtgcctagaagcagatagttcaggaggctgcaggggctgggccaggtcggaggctgcccgggcctggccaggggtcctagcagagaaagcagggctcgtgcccatccggctgcctccctgcagcgagggagggcgaaggccgccttcccaggaaggcccagagcacatctgagctggcagctgcggtcctgctcggacccacagttctgacaggaaccttccagaggatcacgggctgatggcagagcagtggggttccctgcccttccagtccctttgggatggcgttttaccagtccacaagatgccctgggaggtggcagacacagctgtcagcacctggagccatgaggacttttcactgtacgctcagcccaggtccgttctcccagagggctgtaccgtcccccacctcctcctgttgcttagtccagtcctgtgtccgccccgcagaccctgaagtgccatggggaaggcgctcacacgtgcttcccaggctttacactggatacggcgtcctgtcgccacctggcaggaaggggcgttctttgcacttacaggcgagggtaggccgcctgcccaagcccatgctcttgcaggtcagaagacaccaggcacagcccttggccgcagccctgggccgcccctgtggacaggaagccaggaggccccaggctgctgtgactgcccccaccggccctggtagccccacccttgtccgtgtgccaccagcggcccgtgtcctgtcctcccgtctcgggggacctagccagacaacaccagagactagcactgaggtgtccccaacaattttattataaataaaaacaagactcccagtgggtggctgcagcccctgcctcggtggctgtgagcacctgttggaggggcctgcccttaccctggtctggaggccagaaccgaggaaagggctccctgcccctccaagtacacaggggagcctgaggtactgagaataaaaaccagggagggactcccaggccaggcggcggccccgggccctctgccccacgaggctcatcccttggagcacacaggaagctgcccgtccatcacaccacactctcttccagccgctcggcgctgcctcctaccccccggcaccctgccccgagcagccccccatgcacagagtggctccgtcgggcccaagctcctcccaggcgcctggcataaccgtagcacccggcatctcccaggtccagagagcagctgcgctgcggccggggcggggggctccgcggcgggtgggccttgggtgtggggctggggcctccattggtctgggactggacgtggctgagcttgagggggaggcggccatttccggccccccggccccgaaccagcaaggccacagtgaagaccagtaaggcagccaccagcacaccccccacggccacggtcagggtcccgcccagcacgtgggcctgcagggcgtggcacaggggcgaggccggcagcgtggagaaatgggcacagcccagcagcctggtggccgtgaggtcagagggcccagcggccggtgacaaggccagcaggcagaggtcatagtcagcgccggggacgaggtgcttcagcaggaagtggtggctggaggctgggacaatcctgcaggcaagggcaggtggtcagagcccggggctggggtctagccccatcctcacctccccactcccgtgctcccagctccaaacacccctccccctggggccactcgggctcttgggttcactcaggaaggtgaacaggctggagagtgtggccaggagatgggtgtgtgcactggcacaggacgcaggcaagcgaggggaatggggtggggggatggcaccagcagaggcagaaataacacgcgggcgcgggccatgtgcttcagacagacccaaccgccacctgctgccggggaggcctgcacagctcagtgacacctgggacatctcggggtggggtccttctgccgccccttgagctccagccccctcaggcagccaggccaggccaggccactgctcctccaagagtccagcagccatggtcggggagggggtgtcagccccagagagaggaggggtggaagcaaagccttgtggggagcagagggcggaggaagggcgccgggagtgcagccgggtgtggggcacgcatcctcaccggtagatgagggtctcatcttcgctgctgttgtactggatttggaacatccacactgggtcggctggccgcccgggaccccagctcaccagccctgaggtggcggtcacctccgtcacctgcacggctggctcagactccagcgtcccctcaccctcggcagcagtgcgagcggaggcggcgatgtccgagggcccggggcggcccccctcggcactgctgttcccaccatggggcaaggccagcacccgcagttctactcgggctgtggcctcaccagcagggttggtggcgatgcaggtgtagcccccagcgtccccagcgccggtcaccccaatctctaaggtcccgttggggaaagcccgggctcgggaggagttgccaaccaaccggtcgtcaggaccgacccagtgcatggtaggcgcggggtcacccagggcccggcaccgcagcgtggcccgctggccttccagcacccagaggcgctgcgtgtggcgggcaatgaggggcggctcacaggagaactcgccctcgggcactgcccagaagtagcggccggccaggccgggcggggaggcgcacgtttccaggtcgtccggccgcgccagccgccgcagccacagcagctcacagttgcagtgcagggggttcccgctaaagctcagcaccaggggggcgggagaggcctctgcatcacgcccacgagagaaaagcgggtccggagccagcgtggccaggcggttggaggtgaggtccaggcgggagagctgaccgagctgggcgaaggcgcctgggggcagtgcgtcaataaggttatggtccaggttgagggtgtgcagggcaggcatggcgccgatgccggcccagggcacctgccggaggttgttgtaggacaggtccaggtcctccaggctctctaggaagtcgtcgaaggctcccggcgcgatgcggcccagctggttgccgctgaggatgaggtgctgcagattgacggggccccggaggctcccggtgcccagctccaccagcctgttgccgtcaaggtggagggaacgcaggctctcgaggtccccaaaggcgcgggccccaatgcgggtgatggcattgcgagacagtgtcaggtccaccagtcccgtcatgttgcggaagtcagggggccccagggcctggatgaagttgtcagccagccgcagctccactgtgcgccggtccacgttgggcggcacaaacagcaggcctcggtgggcacagagggtgctgagcgactcggacaggttctggcagacgcagggcagcgggcaggcggccgctccactggccagcagcagcagcaggagcggcggggccatggtgagcgccctgtaggaaggggccacagcccaggcacaggtggggctggcgcaggtgcccacttgggcccaggacagtcccagaagccagcttctgtgagcctggcccggggaggggctgggtcagaggcccaagagggccgccagagatgagggaaggttggggcctgcagggccaggccccccagagcaaaggtcacatttcccaagcagttaagggggagtccaggcgctggggacaaggtgaggcatgaggcaggaagcggaggaggaccgagagcagggagggtcccggaacttcctttcccaggcgtccccaggaatcgccagccgcctccccactccccgccataccctcccccgccagagaaggcgccccccgaacctcccgtggagtccgtggcccctccctggccggcccccgcgctgcgcccggcggccccctcacctggtgtccgtcgctcagggggcgcggaccggcctccctgcgagcccggccggccccgccgactcctggccgctgctcccgcggggacgaggcccggggatgaccggccgcccgccgcccaccctcggcccatggcgcgcgcccgcggccccggctcgctcggttcccggcaccttttcccggcgcggttagcggtggcggcggcgacaggcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccccagctgccccgcccgccccgcgggccaggcgttccggagccaaccggcctccgcctcgggccggattggtcatgcgcggcgcggcttcccaaccgccgggggcacgcattgggaagctgtgcgtcctcgcagcgtcctgcggcccctccctcccgctctgtcgccgccgggccatttccctggaagagcggctcggaaccagctcctctcagagaaagggctcccggcgtgaggtgggggaggttctttgcttcctggttgagaaagctggggcttcggtggctcggcgagcctggtttccttccagctgtgcccgccaccaccagtggtctgcccagttgggaaacaggaagtcaccacctccccgtgtctcctggtccttaagccacctaaacctcagccatcctcgttctccctccagccctgatccccatgggccaggtggcaggaaactcggggaaacccaagattggaattctgatcctgtcagcacagcagtgtagtcctgggcacgttacctgaccactgaaaacaagttcctcctgtaggccaggagagttggatggtacatacataagcatttcctaggggcgagaggggaggacagctgcagcttgtgaggggcttacaggcagccagaagccattctgtcaccactcactgggcctcagctgtggcgtttgtaaaatgagggggattcagtcctggtgcaggtcaactctgatgtgcagtggcaccagctatgtctttgttcctcttctccccatcaaaaatgttttccaccgggtgcagtggttcatgcctgtaatcccagcagtttgggaggccgaggcgggtggatcacttgaggccaggagttccagaccagcctggcaaacatggcgaaaccccatctctattaaaaatacaaaaattagccgggcgtggtaccgcatgtctgttgggatgaggcacgagaatcgcattaaccagggagccacaggttgcagtgagctgagattgtgccactgaattccagcctgggcgacacactttgtctcaaaaaaaaagttttcattcactctaaatatagatgtttaccagcatccaccatggccacccagtgctgggagccgggttcatcaggaaccagatgggcctggttcctgcccccatagagcttacagtatggaggagaggatgggcaacccgacagtcacaaaggggagactcagtggggaccctccacatgactcggtgatgcagaacggttatgaccttcagcgtgtgtctgtgaacacaagggtcccagcaacagtgtgggtctgcgctcagccctgcccgtgcaggttcctcagcggcctgctggaaaggtgagcatcagctctgccgagggtgtgaggacagggcgaaggcctccaagggtccttctcactctgcgcgctcggggctctttggatggtttcattagctgcctcccttctccagtgccatgccttggcccagctgaaatgtcagcatctcttcaggagaggcaggggcgaggctcaggggcagacaggcacagcactgctggcggggtcccactctgtggtgagcacctgacaggctggtgggggaggcacccttcctgtccaggcctccaggtaataggagcctaagagacggagagctcagaggagtctgggtggccttgagtccctgttgaaggtgccgacagggatcatgaataagtgacgcgtggaggtgttttcttcgcggtggaagccagggctgtcgctacacagccacaggccatgctttcacaggtcttggagcacctgtcacagtgctggctcgcatgtccccgtttaagtcatactcaccctggcccagcctcatgttgtcacccaggcatttaatgagtggaaccgagggcccctgtgcacaaagtgcactgacacatgcctcaggcagcaccctgcccccaagggttcccaggcagacaagcagaggatgaagccgatgggtgtgcttgcccacagcgggttcctcaggggactgctggaaaggtgagtgtcagctctgccgagggtgtgaggacagggcgaaggcccttgagaagttcagggagagcttcccaggcaggtgcaaaggtgtggagcgcaaggcaagtttgatgtggctggaggtggccacaatgaggaaggcggtggagggtgtggcctggagatggagaagaggtcacaaggtcccaaaatggccgtggtcgaatcctctggcttgaccagtggcatgggaggagtgggtgatgagggtgatgggatgcaggttttggtaactggggggacagtggggcacccactgggcacaggaggactgggtgcataggcaggaagctggccgtggacttgctgaacttatgcgaggggtgaacaaggaaaggcccgggaggcagttgcacctctgggtcttgccctggaggcagagcctgtcactggcgccacagccccgggacggggcctcctggggagcatgtggtgtgtgaggagctggggaggaagaggacaggagagcaagatggcttggaagcccagggaacgagcagcaaggcgggagcatgcccgctggactcagctgggaggagtgacttagagtgccagagtgtggtctgttgcggtcaaggccctctttcgagaagcgtggacgaggggcaagggtgactgctgtgggccacgctgctggagaaaaaggctgagccctgttctaggctgcggggaggcaggaagggtggccttcagcacatgctttggtgtaaacaagtatggagggagcaggcccagcccgtgacagcttagggggctctgctggagtgaggagagggctgagggacggggaagtgcccctctgcagggaggcccagaagctgtgctggcccagggcagcatcttcagccttttctctttcagccttttctcctctgccttccctgtctgtgctgcatggtgaccccctcccacccgcctctgtcctgcagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggtctggcccgagactgccctgccctgccctcccctcccctccgctctccaatctcttgctcctacctccttgccactccccatgaccaaagaactccttagtgccccctgcccctcacccctgccctcattctggccctgcgtcctcttgtcctgcaccctgccattcactgctctccttgcttctgatctgagagaccccacctttccatccacgtggtcctcaagacgtccccactgcctgtacccaggaggccctggctttggagaggacaggggccagctggaagcccggggatcctggagggatgtgtccctgtccctgagcccagccactctcactgctgccctcgactcagcctctgcccagcccaccctgacccactgcccgctttctccccaggccatgtcatggtaaacggtccaaccaccccgattcccgtcaaggccagccccagccccacggaccccgttgtccctgcagtgcccataggtaggtgagatccattctgtcaactcatgggggagacaggaggttgccacctgcaggatgggcaccaatgcccctgtctaccctaggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggtaggctggcatgctgcgcagcgcctggtaggaatgggcgcccgctctgtggccagtcccacaggcttaggccactggggacaagctagagacgctgacacgaagaacaccaaagaggaaggaccgaagaaggcacagcgccctctccggccaggcctggtgccggcacgaggttgcagagctgagaccaggtgcatcctgggaggtccagggtcaggaggagacacctgcctgttaattatagcacagagaggtagaggagaagatgggattataaagggggcatagaagggacacaaatgagcctggtctcccccttagagatcagacaagggaaaaatctgtgggggttggagcagggaacacaggtatggcgaagatgagcaggacctggtattggggccagaggcttgtgctgcagagctagctccaaggcctggtggagttccccaggcatgcagagctgatctgggcctctcggttcctgtgcaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagtgagcctggggtggggtgggcagacgctacctggtgtggcccagagggtaccgagccatgtcgtgatggcctctgttctccacggtcagcctgacaccaagtctctctgtggccacacgcagcaggggctgctgtttggaaatatcgagaagtgtaaaattggagttgcagaaccagacaggcttctaaatcactccctcactcctggggcagtggaaggtctgagacttgcctgggtcactcggtgcagggctgggattggaacccaggcctcaagactccttgctcagtaccctcttccacagcctgccactggcctagctgatcctccagggcctggtccacacttgtgtggccaccccccgcctgtggatgccacaccccctgccaggcgagaccctcagatctcattccccaggggccatagagtgggtcaggaaggagccagggaagactgttcagagggaggtggggtggggctcagccctgggctctctcacccttgcaggttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggtgcctgggccacttgtccgtccctccctctctgccccggccatgtccccgccacccacaggcacacatcctgccctctctaccatctctctctctctctctcccacttcccccaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacaggtaggaagaacagcagcccgtggccacacccctctcaaagccgcagccaccaccagtcccagtagtgttggacctgcctaggatccagatgccctgctctggccttgccgccttctgtcacctgagtcagacatgggacctgagctagccctgggtcctggaagagtcacacatttctaaggcctcctctgactctggcctccctgcagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgagcccggcccggtgctccttacctgacccagccctgcatgcacctgccactggcctccttgaggtgcctggcaccctaacctccagggccttctcctcaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtagggaaggcccagcatggtgtgagggtgggggctggatgcaggacttgggactgatcctctgctttgctccccaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtcagtggctctggcgcttctccacactccaccctggccccctgccccagagctctggagtttagcttggctgtcacccagcctcgcaagctttgggagcagaaaggacccttgagaccgggagctaggcctttaggaacgaggagccaaggcccagtgtggggacttcctatggccagggccgggggactgctctcccaccttggcgtccagctctgagtctgcacaccctccctgcaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggtattgtctcccccagggccagccaggcggtggggcttggctgggcccaggatgtcatgtcccctctgccctgtgtcttcaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctggatcctgtgcagcccccagcctgcaccactcagcagtggggggctgcctttcaagctccccatgggtgggcaggtcagttgtgtcgttctcctcagagggtagtgagaatgaccatcgtggccctgttttaagtcactattgggtgcctactgtgtatactccccaaacaggactagtagtactgaacttgcttgaggggtggggcctgttctaagtatttaacacctattaacacagggaattaaccttcatcctcttatggacacagaaatcaagtcacaggaagattaaataatttgtccaggacttcacaagtagtaagagagagagatgaaacccaggccgttggcagactcgcctcccaaccccgctgctttattttctaaaacccaaggccagcgtcccacctcagttagcaggtaaatgcaagcaggtaccaccttgtgggcagtgggtaagaccctcgggaatggtgatccgggagtcttgtgtgtgctctggatgtgagaatgttggtgggaggtgagggggagcaccgggtccagggtctcaggttctaaccctgccactccccatgaccacccctccagactcctgctcagttccctttcctgcagtggggacagtaaccctgcctgcaccactgccctcctgcccacctgcccacaggtagggagaggatggtgaagggagcaggaggctgggcagttcctgagatggaggggtgggtgtggggaggccgatgcaggaaatcagcctctggatgggaagcacccagcaggcctctgcccagtgctcccagagccagtccaacctctgggatgggcaactcacagtgggcttgagcctcttcctttctggaccgccatgtcctagatgtaccccaggaggcagatgactgcgatgctgccccttccatccgggtggatgtcgttgtcatggccagcctgcaggcatcgtgggggagtgaccgcacatcctttttccctcagtggccagcctcagagaagggaccttgggacaacctccttgattggggaatgggacctaaagggctttcttccctcccccgccccccctgccccccaccccggagatggagtctcgctctgtcacccaggctggagtacagtagtgtgattttggctcactggaatctgtgcctcccaggttcaagtgattgtcctgccttagcctcctgccaccacgcccccgcctatgcccggctaattttttgtatttttagtagagacgggtttcaccatgttggtcaggctggtctcggactcctgacctcaagtaatccagggctaatactctttcaggaatctaattttaaaagagcacaggcagggaaacgagagcccttccaaaaatgatggagagcaggcagaacacttgcaggtgccgagaaggaccctggagtcactgtgttgcttggcaaagtccctgctgccctcagggctgcagcctgtgttctgggttcctctggggcagaggtcagaggtggagagaaccagaaaagcctctacttatggtgactcagggacctatttcctcttgtgaaaaacaagactggcagactgtggaggtcctggcagaggcttcaggccagtcatcttcccctcagaggagatacgtcggaggctccatcgctgaggtcagggccagggccatggttcccactccctgacccgtcagccaaggcacaggccccaggatgagctgggctcacacctggtacctgcagtctcagagccaaccacactaggactttggggcatggttcaggaaggaggaagccacaggctcccagcaaccagagctcccagcccatcctgtactccagggaactacccgcctggatgcaccgcccagatgtcagtgttcaaggtagctgggacaggtggtgggcacactcccaagagctgcctagagtcttcacacaagatcccaaatagaccgattcccaaaggcccaaggccatgt

SEQ ID NO: 13048 - DNA, 63183 bp, Human; identical to SEQ ID NO: 13047
  misc_feature (1)...(63183): n = A,T,C or G

SEQ ID NO: 13049 - DNA, 69874 bp, Human; identical to SEQ ID NO: 12361
  misc_feature (1)...(69874): n = A,T,C or G

SEQ ID NO: 13050 - DNA, 8805 bp, Human
  misc_feature (1)...(8805): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggagggaagcggctgggggctagggccctggtggcactaagcccagccgcccacaggtaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcaggtgagccaggggagcacactggccatctgatcaggccttcctccctgtttacagtggtccactccttggctttgtttgctgtgaactggattccaaggacagccttctcagaagagctagaggtcatgggggtgtcatggataggtcaatggccccaagggaatgagctcagagggtctcatcatctcatccttctagcttgcccccattaaatggtgtgccttaatgtcccgggttttccagggctgacacccactctcatgtattgggctggatgttggtttgaaaaggggttatttcaggaaggtgctaggtcctgtccagttccctggcagtccccccacacagagtgactgggggaggtcaggaaatcagaaggtggtcctttgccacgtgtagaaccaaaagactggttagtcactttgggtgggctggactgcactgtggatggcagggaggatgcatccttgcttagtagccttttggattgtagctgttgcaatggcctgaggctttcaatctcttccccagaccaagatacttggtagtgaccgggtgaagctgatggagagtctagtggttggagacattgcagagctaagaccaaaccaggtgggcccttttatttctgctctatgagttttcttagtcatgagccagcaaatgggctgagtccctacctcaggcttaggggcacagagatgagtcaaacacagcttctcagggcttgcagtcttggacagaatccctgagtcatttccagagacacagacatttgtagggaggggaatatcccagtcttactacatcaggctaggaggccagaaaccaaggttaatatgctgctctctggccatcccttctgcttaacccctctctattcaacatgtggtccctggccaggcgacgtgactcaaacacctgtaatcctggcacttggggaggccaaggcgggtggatcacctgaggtcaggagttcgagaccagcctggccaacatggcaaaacctcgtttctactaaaaacacaaaaattagccgggcgtggtggcgcgtgcttgtagtcccagctactcgggaggctgaggttgcagcaagctgaggttgcaccactgcactctggcctgggcaacagagtgagactcagtctaaaaagaaaaataacaacaacaaagtgtggtctctaaaccagcatctttggagcttgttaggaatatagtctcaggcactgctgcagacctgctgaatcagaaccttcattttaacaagatccccaggtgattcatgtgaccccctcaacctcaggctttttgtccatccagtggggaggctaaggaagttttttgggggcattgctatggagtacttaggagagcctgcgatcatcaagatgacctttgaagcttttgtcctgtgggttgccacatgggctaagtcgtcccaggtttgggtaggtgaagcagcaggtcctaggtgtcatagattaagtgtcagatgggactctcagtacagagtggggaggggtgcagaggttgcaccagatcagggaagcaccccaaggtagggaggggatgaaaacttacttgatgcatgaggatcaaagaccttggacttgggcccagacttgtaccttgcacaccctgagtccttcacattagggttcataaccttttggtaactaagtgggtccagggttgtgtctggctcacccttggccttgccctcctggacctggaagccaaaacgctccactttggtcctaggggacactgtcgctgtttaccaacgaggctggaggcatcttagatgacttgattgtaaccaatacttctgagggccacctgtatgtggtgtccaacgctggctgctgggagaaagatttggccctcatgcaggtataccccctctgtgttctagacaccttgtcttccttgttcatagagcagtatccttgttgtccaagacagggttggcacagacaagggacctggaaaatggctctttcagtgaatgaacagctatgagactcaagagcaggccctctctggagcacgccagggtttggtggtgggggattaccaggcatggggagggggtcttggcccctctggtgtgaggtggcagaactgggcttgggtcatctctatcacttagtagctatgtgaccttgtaagatgggaaccagcctactacctttttttttcctccctcctcctcctcctctccactgtcctactactgtccagctctgcagcgtccagcccatggtagctgctcagtaagtggccccagatgctcttgtgtttctgtcttttaggacaaggtcagggagcttcagaaccagggcagagatgtgggcctggaggtgttggataatgccctgctagctctgcaaggtgagagggctgggctggggttggagccaacctttgccttcctggcttcattgactgcttagcacagaggccataccaagaagaatgtgtggaaggtgtgatatttgtgtgccataattttaagttttgtatcttgccctcctcctacctaccacaaggctccatgggctagggacaagggcatcttctcccacttgcagagtaagacatgctcagggcttgttctggtccctgaataaggctttagtccagctttgagggatgctgggacctggatacttggtcactggctccctgggcccaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggtgagctgggccagcactaaaggatagggtcctggaggtcagggtgacccttgataagactagccagcccatgactcatccaaaggttatgtagcctgaagccttcctgagcctcccttccctgaaggtgccactgtgcctttgcccattagaaactgcagatgttggccggatgcggtggctcacatctgtaatcccagcactttgggaggccgaggcgggtggatcacgaggtcaggagatcaagaccatcctggctaacatggtgaaaccccgtctctactaaaaatacaaaaaaaaaattagctgggcattgtggcgggcgcctgtagtcccagctactcgggaggctgaggcaggagaatggcatgaacctgggcggcggagtttgcagtgagccgagattgcgccactgcacctccagccagggcgatagagcgagaccccgtctcaaaaaaaaaaaaaaaaaaaaaaaaagaaactgaagatgctgccgggcatggtggctcacacctgtaatcccagcactttgggaggccaaggtgggtggatcatgaggtcaggaattcgagaatagcctggccaacatggtgagaccccgtctctactgaaaatataaaaattagccaggcgtggtggcgggtgcctgttatcccagctactcgggagactgaggcaggtaaattgcttgaacctgggaggcagagtttgcagtgagctgagatcgtgccactgcattctaggcctgggcgacagagtgactccatctcaaaaaaaaaaaaaagaaactgaagacgctcggcaggtgggcagcatggcctccaggggataggaggtggttggttggctgacggcagtgaagggaggaatagagcctggagtagcccaagcaaaggggccttgatgctagatagtgtgttacttgaggacctcataaggacctcctgtggccagggcttctatgggctgtggcttatgtctcatgtgtcattctccagggaagcgccgccgagctgctatggacttccctggagccaaggtcattgttccccagctgaagggcagggtgcagcgaaggcgtgtggggttgatgtgtgagggggcccccatgcgggcacacagtcccatcctgaacatggagggtaccaagattggtaggtggaccagggaagctgggaaacccttgtctcttcccaggagggtgggggcactggcagggtggtgctgatgcgtggcttatgcttgcttgacaggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgccagtctctagcttcattgttctctgttcacagggttcctgaaatgccaacccaatgcctgccttcctggcctccaagacaagcttggaataggttctccttgaaaggggccagtctataaaaatggagatattgcccctgttgggcaccccatccctgctcctccagggagctgcatcacctctcccctccctgcaagttattgcatctgggtcccaaggggcaacagcttccaggatgttccctctctcactgcccctgtgcatgcacacccttgttctgtctgaataaccacaacaaccgatgcacttccgtgtttaataagccacatcctcagttgagcctggggtgaaatgtgagatcctgactctgtgcagtagtattagtgggtgggccaggggctgtgaataacatcatcctcagtacagctgcaattccagggcccctctaccacaaagatggcttaagcaaaggcagccagatggaagtatgatatccaacaggaaggaagtaggcaggggtcactaaagtggctggtggcccagcagatggaaacagaagtatggccccgagggaaggaggcaggtccagggctacagtgctttcaggtactggtgtttctataggggcatttgccacccacatctttggaaactcccctggcctattgtgacatggcagggctgcctggttcttgaaggtagagaagatgctagtggggaggagctgagcctgtgacgtgcatttgtaccaggtccagatgggaaatgatgaggctgcaggctatgatggggccactgtgcactaaatgcttggtaccatcctatgaggggacaaggtgcagacccacattcccataggcacttaagcagtggtggataggaggctaccccaggggttcagctgtccttcaggtaatcagcttacccccaagaaggactgagaggaatatgagtaggacagttggcagatgacaatttcctttgcctggctcacgggagaagtctggttgggccaggtatgtgggtgtttggtgcctccatctggatagtgccagcaggtacaccaccctgccttatacctgaatggccagctaaataaccatagagcttaaggtctggctcaggtcaggattccctggctccttgccaacaaagcaaaaccagagattcagaaaactcagggcctaggagaaaacagacctgccttacaaaccccagagctggtcaacctcaggcttcctctcaggaaaaaaattttttttttgagatgggtcttgctctgttgcccaggctggagtacaacggcgcaatcttggctcactgcaacctctgcctcccaggttcaagcaaatctcctgcttcagcctcctgagtagctgggattactggtgtgtgccaccacacccggctaatttttgtatttttagtagagatggggttttcaccatgttggtcaggctggtctcgaactcctgacctcgtgatctgcctgcctcagcctcccaaagtgttgggattacaggcgtgagccaccatgcctggccaactcaggaaaaatttttatggggtcacatcttggggatggaagagggacaggaaaagaaacctaagacaaaagaactgatggtcttcccaacccagaggcttcctgagttatcacccctgagagaggaagaacacaatctctctccttaaggcacccagataagagtacaggcaaactcttcacttgcccagtgcctgggtgagggagcaggcttaagaggcagaagaggcccagccctgtaggcactgggtactccctgctaccaaccctgaacccccggcagttgtccctgaggtctggggagtagcagaacccagtgtagaagccagcagacccagtgatgcccttggagaccctctgctgccttcccttattctctgtgggttttgagaggttcgtttgctgccatttccctgaaagtgatggagagagagaagagagagtggttattccatg

SEQ ID NO: 13051 - DNA, 8270 bp, Human
  misc_feature (1)...(8270): n = A,T,C or G
caaaagtagatggaaccaattaagacaagttatccagagatccttcaataagtcattctttacaattaaaaactagtttttcagtccaatgtcacttgtgccaaatgctcaaaacagtatctccgccaatctagccacatctaaggtgacaatcatccgcatggtacacattacacatctgggtgatactaagtggttgaaaaattctctccacatacaacattttaaattatggaagttttttggtttttcaatttttctccttcagaaaggcagagtgaaatatctacttacacacctgcaagaaacgtttaagactttcttcaagacagaaccaaacaagtcaacaacagaggtaaaaatttaaaatcagaactattaaaaaacacaagtggaaccaactttgaggtaaaaaggattccaattttccaccgtaaactactaaacaaggtttgtgaacaaatcaacttggatgcgaatagcgctattcaatgaagacgacccgtaactgtagatccaatcagtaactaaggtacagatgtttagatcattcctaatcaatacagcgacttcgactaagcaacattgcatctattttcatgcaacatcgcttaaatcatttacagttttgtgtgttgttttttttttccaaatggaaaataccccttttccactcaatacagaccccaaagctttcagacgagttcgggcgcgttcgaggtggtatggccgtagatcatacccctaagcgttcaatacaatcttttacttacttacacagtctccaacaagtctgcattaaaagaaaacctacccaaagtgtaactggactttaatcaatataaaacagtgattgtcgtttctcgttaaacgtaaaaagcaaaatggagttgtaaagagtttctttcccatttcaactccgacagccacgcgcgctttcagcggccggctacactgcgcggtcgcggggcccggcccaaagcccccgccctgcccggcgctgctgggagaggaagctccggggaccgagggcgggcaggcgggcagcctgggctccaccaggcccggccgggcgggggaaggggcacaggagactaccgggcgcgcttccggggactgcgcgggcggggtcgccgcttggggcgcggggcccgggctgggagtcaggtcaagggtcaggggccaggggcggctcggccacgagcagccggtggggcgcggccgcggcggtgcggcggcctgccggccggaagagtaccgggctggcgggcctggggccccgcggcgcctggagggaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaacgctactgtaggtcactagggcgggcttgggacgacgtgcgcgcctccgagtgcccagcgggctcgagccggcacaggtcgcggccccgcgcacgcgcgcgcactcacagctcatccactattgctcaggagcccgtccacgccctaaaagcaaaacccttaaccaatcattgcagccgcgtggggcatcacgggaactccggggctataaaagacctggttgctattttatactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtgaggcttcctacgaacctccgtgggctggccgcccccgcccccaccctctcccgactgtaccattgggttccccactatcctgcaagaggctcatcagaacttaacattggttcacggccttactaccctgaacgcatctgacctcggaagctaagccaggtacttggatgggagaacttaacgttgtgccctgactcatgccaccataccattttacgccagaatccccaccagtccacccatcacattgtatctgttcctcagaactctcacctggcaataccattagtcccttaggaccctcaccagacttcaccaaacaataccagtggtctctaacctgacctgggctgatgcctgctcagattcccaccccagccttctgcagctctggatgtgtttctgcctccaggtctgggtggtcagaatggatccacgcctgatggctccacgcatttcccttcgtggtgagtaaatctgtccataccgcaaccccatgcttggcattccaaggacactcctgtgctggtgacagagaggggagttctcaggctttaagcccaccagcttaatggcctttgcagcaagcttcaagtctgcacgtagagctcaggcttcaagttagggtgacaccaaggtctggacagtccatcatcatgctgttcagcagcctgtaggataggtggtggtattgtcataatttcagagagatgaaatgacaggtttgttggattccactccgcacaatcccctcagttgggaaggcagtaatctctgtcctgagcacgttgacctcatcagggtcagcctcctcttctgcaaaacatgcgctcactaatcagggcattcattcagataatctctgggcccctatcacgtgataggggccacacgaggcccagagaacaaagacaacccgggccctgctcatggggagccagggatttattaggggagggcggcagtgcatggggcaagggtggtcagggaaggcttctcccaagaaagacacctaagccgagatcaaatgccacagggtgacaaagtgtaccaagcaaagggaatggattgagcaaggctaagagggaagaatacgggtgacatattagaataggtaagactgtgatgctggagcttgaacgtgagagcttgttggaccctgggagccattgaaagactaactcagcaaggctgtggtctgatctaatttgcctttataaatgcctacttcatggcaagtagataaaggggtccaagagttagggctagaggttagaaaggctgccactgcccaggtttctgtcttagagaagaggccaggccccatggctcatgcctgtaatcccagcactttgggaggctgagatgggcggatcacttgaggtcaggagtttgagactagcctggccaacatagggaaaccccgtctttactaaaaatagaaaaaattagctgggcatggtggcatacgcctgtaatcccagctactcgggaggctgaggcatgagaatcacttgaacccaggaggcagaggttgcagtgagcccagatcacgccactgcactccagactgggcatcagagtgagactctgtctcaaaaaaaataacaggccgggcatggtggctcacgcctgttcctagcactttgggagactgaggagggtagatcacctgaggccaggagtttgagaccagcctggccaacatggcgaaaccccgtcttcactaaaaatacaaaaattagctgggtgtggtggcgggcgcctgtaatcccagctacttgggaggctgaggcaggaaaattgcttgaacccgggaggtggaggctgcagtgagctgagatcttgccattgcaccccaacctgggcaacaagagtgaaactccgtctcaaaaaaagaaaagtaataacaatagtaataaataaaaagaataaaaaaactagagaaggatggcaatgccgtactaacatggagaaccaggaagaagaatgagtctgcagggagaaggtgctgggcccagggtgggctgtgggagaccagcagagaggtctagattgttatgtgaccttactgagcctagctcagcccccaagaaggagcttgggagagccaatttcagcaactgttctgcccatggaataaccactctctcttctctctctccatcactttcagggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgcatcggttgttgtggttattcagacagaacaagggtgtgcatgcacaggggcagtgagagagggaacatcctggaagctgttgccccttgggacccagatgcaataacttgcagggaggggagaggtgatgcagctccctggaggagcagggatggggtgcccaacaggggcaatatctccatttttatagactggcccctttcaaggagaacctattccaagcttgtcttggaggccaggaaggcaggcattgggttggcatttcaggaaccctgtgaacagagaacaatgaagctagagactggcaagtaagaaggaagtttaatttttttttcaggattcagtggagtccattaatgcataccaggggcaaagatcagcccagggtaaggcaagtctgggaggaagcccaccctgccctacagcagccctggaactcagaataggtggtgagtctgccatggtttgctactgggcagcacactagaccaacttgggaatgtggaagagtgagtctatgttccctcagccatccccaagtttacacacaggcatagcagccctactgtgagtcagcaatcattcctgacttgcagtaaggacaatttgcatttacggaaagcaaactggagggggtagcctaagtccgcactgcccatgttattaccctttgcaatgtgaaaaaccatggtgaggtaggttgggcaggttttatcctctccacaaaggtgagcctttgctccacagccagcacctggcagagtgggagagatggcagaaccaaagcttctcattaccctccagcaggcaagagtaggtcagtgggatcatggactgaaacaagacattgtgtgagctggtccgtcactcagaagcagggtcctgaaggaagctggaatggcatgagttaggtggggggaataggtggtgtggcccctcaaccagacaattagaatcagcctccaccttaactgcccacccccagtgagttctgcctcagcttcttgactaaccccttgtaggggcaaaactcctggaagggacagccccaccctgagccagcttcacttgagggtatagtagtttgtgggcacaaagggcatcttgctgactacagccatctgctgcttccgccgcacctctaccagcagcattgtccctggacgactgtactcgcagggcacataacccatcgccacattcttcttcagagagggggaggggcagccactagtcacagtacctgtcaagcaagcataagccacgcatcagcaccaccctgccagtgcccccaccctcctgggaagagacaagggtttcccagcttccctggtccacctaccaatcttggtaccctccatgttcaggatgggactgtgtgcccgcatgggggccccctcacacatcaaccccacacgccttcgctgcaccctgcccttcagctggggaacaatgaccttggctccagggaagtccatagcagctcggcggcgcttccctggagaatgacacatgagacataagccacagcccatagaagccctggccacaggaggtccttatgaggtcctcaagtaacacactatctagcatcaaggcccctttgcttgggctactccaggctctattcctcccttcactgccgtcagccaaccaaccacctcctatcccctggaggccatgctgcccacctgccgagcgtcttcagtttcttttttttttttttgagatggagtcactctgtcgcccaggcctagaatgcagtggcacgatctcagctcactgcaaactctgcctcccaggttcaagcaatttacctgcctcagtctcccgagtagctgggataacaggcacccgccaccacgcctggctaatttttatattttcagtagagacggggtctcaccatgttggccaggctattctcgaattcctgacctcatgatccacccaccttggcctcccaaagtgctgggattacaggtgtgagccaccatgcc

SEQ ID NO: 13052 - DNA, 20441 bp, Human
  misc_feature (1)...(20441): n = A,T,C or G
tttttagagacagtgtctcactggggttccccaggctggagtgtagtgatgcaatctcagctcactgcagcttccacctccagggctcaggggattatcccacctgagcctcccaagtaactgtgattagcatgcaccaccgctcctggctaattttttgtatttttagtagagacagggtttcactatgtttcccaggctcgtcttgaactcctggactctcaagcagtccacctgtttcggcctcccagattgctgggattataggcgtgagccactgcgcccggcccttttctttctcccctcccctctcatgcttccgtccgtccttcctttctcagtgtctcactatgttgtcagggctggtctcttaactcctgggcctgagcattcctcctgcttcagtctcccaaagtgttgggattacagacatgaaccactgtgctcggcctcaattgatttttcttttttgagacggagtttcgctcttgttgcccaggctggagtgcaatggcatgatctcggctcaccacaacctctgcctcccgggttcaagcgattctcctgcctcttgctcctgtgtagctaggattataggcatgtgccaccacgcctggctaattttgtatttttggtagagatggggtttctccatgttggccaggctggtctcaaactcctgacctcaggtgatctgcctgcctcggcctcccaaaatgctgggattataggcgtgagccaccgcgcccagccaagaatgctgtttctttacaaacaaatctagattggtaaaagaaggaatatccaaacttagaaagattgcagaatgtctacccaaacaacctgccgatgacttttttggttctttcctcccttgggtactccctttcatcagtcctttcattgtttttaccctgcttgacaaattgtttcctttttttttttttttttttttgtgagatggagtcttgctctgtcccccaggctggtgtgcagtggcccgatcttggctcactgcaagctctgtctcctgggttcacgccattctcctgcctcagcctcccaagtagctgggactacaggtgcctgccaccatgcccggctagttatttgtatttttagtagagatggggtttctccgtgttagccaggatggtctcgatctcctgacctcgtgatccacccgcctcggcctcccaaagtgctgggattataggcgtgagccactgcgcctggctcaattgattttttaatgttaatattgtatcctgcaaccttactgaacttgtttattctaaaagttttctttaggatttcccacattacaaaatcatctcatgtgtgaattgagatagttttacttcttcctttccaatttggatgtcttttatttcattttcttaccttattgccctggctaggacctccagtatcctgctggatagaagtagcaagaacaggccaggcgtggtggctcacgcctgtaatcccagcactttgggaggctgaggcaggtggatcacctgaggtcaggagttcaagaccagcctggccaacaaggtgaaaccccatctctatcaaaaattagctggatgtggtggtacgtgcctgtaatcccagctacttgggagtctgaggcaggagaattgcttgaacccgggaggctggaggttgcagtgaactgagattgggccagtgcactccagcctgggcgacagagtgagactccgtctcaaaaaaaaaaagaagtggcaagaacagacattcttgtcttgttcctgatcttagggggcagacctttttttcagtcttttaccattaagtataatgttagttacgagtttttaatgtataaccttttggtgccaggtggatcggcgtactagaagtttgaatttgagtatgctaatagaggtttatgccccatggttaccaaagcatgtgtcatcctgtaagctacctatgacttcttgtgcattgcaggtaatatctgtgttttgtgtttcagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtgagtatacttttcataacaactgatgccattttccatgttagaatatttatggagcatgtagagaattagagctttttgcctcttcagtataccatataacaaaaatgttggaaagaagaatccattctcatcctgccatcttagtccaagtttgttctttttttttttttggagacggagtctcattctgttgcccaggctagagtgcagtggctcggtcttggctcactgcaacctctgcctcccaggttcaagtgattctcctgcctcagcctcccaaatagcagggattacaggcatgttgccaccatgctgagctcatttttcgtttagtagagatggggtttcaccaggctggtctcaaactcctgacctcgggtgatccacccacctcagcctcccaaagtgctgggattacaggagtgagccactgtgcccagccttcccccaggtttaaaggattctcctgcctcagcctccccagtagctgggattacgggaatatgccaccacacctggctgatttttgtatttttagtagaaatggggtttcactacgttggccaggctggtcatgaactcctgaccgcaggtgattggctgttttttcatttttaactgctactcatccagactttgtttacattcatatgtatttgacatggtgtccttagcatatgtgttttttttttgttttgttttgttgtttgagacagagtctcgctctgtcgcccaggctggagtgcagtggtacaatctcagctcgctgcaacctccacctcccgggttcaagcaattcttttgcctcagcctccagagtagagtagctgggattacaggcgcacgccaccatgcctggctaatacttgtattttgtaaagatgcaattttgccatgttggccaggctggtctcaagctcctgacctcagatgatccacctgcctcagcctcccaaagtgctgggattacaggcgtgagccaccttgcccagccatatgtgctcttttcaagtttacgtatatttgaagtttagttcattgccatatagataatgctcagatgaacttctttgtatgcttggactttgacaaaaattctgtcaaagtatttaatcagatgtcccagtattagattactagttcaagctctgcctcctgggttcacgctgttctcctgcctcatcctcccaagtagctgggactacaggtgtccaccaccagactggctaattttttgtatttttagtagagacggggtttcaccgtgttagccaggatggtctcgatctcctgatcttgtgatctgcccgtctcggcctcccaaagtgctgggattacaggcatgagccactgtgcccggccaaaagatttttttttactttaacataaaatagcctgccacagttgttttattttattgtcattgatggtgagaacagtgcttccccatttctgtcctaaaagccctctggcaagactggaacaaagctcttgtgaaattggagggtttttttgggttttaattttggttttggtttgtttttgtttttttttttaatcttctgcttccttttgttgtctaagtaatgctttgcttggcctctcatacttttttttttttctcttaaataaagagacagggattgtactttgtctcccaggcctgcagtgctgtgacatgatcatgcagccttgaactcttgggctcaagtgatccttccacctcagcctcccaaatagctggcactgtaggtatgtgccaccacacctgggtaatttatgtttttagagatgaggtcttgtgttggtccagctggtttcaaacaactgggctcaagttcttccatctcagccccaagtggctgggcttacaggcgcaagccagcgtgcccagctctcctatacatcttttgaagtgggtcagctgaaaggaaaaaacccctaaaactagaatgaggtgctcttctccaacattctcatttttcttgagcattcagttatatgtctcatatgctgctaacacttgatatattagcttccattcatcccctttctcctttcttactttgtttttgtttgtttgtctagagacagagtctccctctatcacccaggttggagtgcaatggcatgatcttggtttacaacaacctccgcctcctgagttcaagcaattctcctatctcagcctcccgaggagctgggattacaggtgcctgccaccaagcccagctaatctttgtatttttagtagagacgaggtttcgccatgttggccaggctggtctcgaacttttgacgtcaggtgatccgcccgccttggcctcccaaagtgctgggattacatgcatgagccaccgtgcctggccacttctacttgtccacattacttatttctttctgtcctagggccacctagcctccttttgtggcactgtgtgaggaatgtgggttagatcagctgctcagaactccagggtccctcattgtagggcttcctgatagttgtttgaccatcagtaagctcctgacctttgagccttcctcatttgtaaaacggtttttataggtgacatcaaggttctgtgaagtaacggaaaatgtttggcagcaccaaagcgctttctaagagatgaatactgccatgttcaaaaccctctttcatagtttgtagtccttttttttttttttttttttgagacagagtctcgctctgtcgcccaggctggagtgcagtggcgtgatctctgctaactgcaacctctgcctcctgggttcacgccattctcctgcctcagcctccggagtagccgggactacaggcgcccgccaccacgcctggctagttttttgtatttttagtagagacagggtttcaccgtgttagccaggatggtctggatctcctgacctcgtgatctgcctgcctcccaaagtgctgggattacaggcgtgagccactgcgcccgtcctatagtttgtgctcttttttattcaaatacagagtgagccacgatgattgctcttatgctaataggaactctaagatactttctggcccaagtatagatggaaaaaatacaacaaataccagcctaacagaattttgggatgtaccctgaaggtggcaaaccaatacagagggtgttaattcagcctcagccaagcatggatgcttggacataggtgtttttgtggtcctgataggaaaactggttttatatggacacagggcccagttgtgacaaactaggtagaaatgtgatgacatcttcaggattggtgtcaagttatagccctcttacctaacttagattgatgcaccatacatagaaagatccattggcttggggaagcaatgtcaggttggcattttcatagcttatttctcaaaagcctagtagtgaatgtatattactggttgtatcctaacattttctccagagagtggctgttaattgctgcatgtctgtaagcatgaactggaagggtcttttccatctgtggcagtatgtatgttttggaagcagctctttggttctcttggaaacattatttctgcctgggcatcttggaacaaccagaatcttgcccataagaaatttagagaccttgacttaaaaccttgaggcatggtctgtgagtatttttcttgtgctgcaaaccttggacatcactgaccctcgcaagatagggggaggttctcacttgaggagagtcccctggaataaaagtgtttgattgaagagcatattacaggctacctgcctgcctcagagcaactcaagagtccccaagatgggagagggtactgtgtaggaatattcatttaacagtatgcaatagtataaggccagacgtggtagctcacacctgtaatccagcactttgggaggctgaggcaggaggatcaccagaggtcaggagtttgagaccagcctgcccaacatggcaaaacccaatctctactaaaaatacaaaaaattagctgggcgtggtggcaggcacttgtaatcccagctacttgggaggctgaggcaggagaatgacttgaacctgggaggcagaggttgcagtgaactgagactgcgccactgcactcaagcctgggcgacaagggcgaaactctgtctcaaaaaaaaaaaaaaacagtaggcaatagtacagcctagggaaccatacaagattgtaggtgatcatggtaccaagagtaggcctgctcacaatgaaaaggccccttttgatatgagacagactcaacatcttggaagcattttatcaagcgccaatagaggctggatatatgactaaacaccgtggggtggagggggccgggagagtgggatttgccagggagtaaatgagctccattattgtgagggcagacagattgtgataattgggcatcagtatatcttagttacacatgccagaatgatggtttgcatgacagaagtacagtgggccttgtggaggttatttgtgatgcatcctggggcaaaagttcgggggtggaagagccatcaattttaaggaagaaatcatttagaaactgaaatttgggctgtgaaggtgctaagagaagaaagatgtgttccaagtattggagggagacctcttgggcctcaaagggcctctgtacagaggatgtttaacatggagtctggtgataagaatggggtagcagagctgggtgcagtgctgggcagtgttgaatgggacttgtattcagagcccaggcatcagtttacccttctaccacaggagggtgaggatgtacccggatgtgaaaggagtactctctcaccttacgtgatgcattatttcagacatttcttgagtagtaaaggcacagccaaaagggctttcctgtcatctcaggccttgcctaacagccagcatggtgtcttttcctacctaccaactcaaaatacagatttgtttccatggtttccacattatagcagaaaatttacttagtcttgtatcttcctctctcgcctgtatgcctggtaggatgttatttaaaatttgatttcttccctcctgtctgctttctttcctagtagaatgttatttataattaaacacttttataagctacagagttatttttgacttgacattttgaattatgccacttggttcagttctagtatctgttttgtttttttgtttttttcctaattgagtcaaggtctcactgcctaggctgcagtgcagtggcacaatctctgcttactgcaacctccgcctcccgggctcaagcagtcctcccacctcagtctcccaagtagctgggactacaggcgtgcaccaccacagtcagctaatttttttttttttttaaatggagtttcgctcttgttggccaggctggagtgcagtggtgcaatctcagctcattgcaacctccactcattgcaacctccgcctcctgggttcaagcgattctcctgcctcagcctcctgagtagctgggattacaggcatgcttcaccacgcccagctaattttgtattttcagtagagatggggtttctccacatttgtcaggctagtctcgaacttccgacttcaggtgatccgcccgccttggcctcccaaagtgctgggattacaggcgtgagccaccgcacccagcccacactcagctaagttttattttatttattttttttttttttagagatggaggctcgctttgtcgcccatgctggagtgctggagtgcagtggcacgatcttggctcactgcaacctttgcctctcgagttcaagcaattcacctgccttagcctctccagtagctgggactacaggcgcacgctgccgtgcctggctaatttctttcgtattttagtagggacggggtttcaccatgttgcccaggctggtctcgaactcctgagctcaggcagtcagcccgcctcagcctcccaaagtgctaggattacaggcatgagccaccgcgcctggccacactcagctaatttttaaggtgtttttgtagaggtgggttctcagattttcaattttgagaaatttcaacctaaaataatttaaatatactctcatttgagcttgatgctcataaaagtgaatgggattcggccggggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaggccaggcgcggtgggtcacgcctgcaatcccaacactttgggaggccgaggcggacggatcatgaggtcaggagatccagaccatcctggctaacacagtgaaaccccgtctctactaaaaatacaaaaaattagccgggtgtgatggcgggcacctgtagtcccagctacttgggaggccaaggcaggagaatggtgtgaacccgggagacggagcttgcagggagcagagatcgcgccactgcactctagcctgggcgacagagcaagactacatctcaaaaaaaaaaaaaaaaaggaaaaaagaaaaaatgtaaatactcctgtgttttactgttttagaccgtctgccatttcaatggtctgccatttcaatgtactatggtaagtgtcactttttctaaaagtgggtggggggattaaccttgcactcttgtggttgtttttcccattacaggtagagttggctttgtgggacacagctgggcaggaagattatgatcgcctgaggcccctctcctacccagataccgatgttatactgatgtgtttttccatcgacagccctgatagtttaggtgagtggccctgcaccctgatatttgtcactgcctgtgtagctagttggcatctggtttctgggcatcaagtggctgaaaagcagacatgaacttcagagaagcaatcatcgtcagtggccggagtcctggagtttgggattgtagagcgtgggccttgggtccctttcagcctaggtctcccatgggtactgtatttaaaatgtatccacctaggcagggcacggtgcctgacacctataatccctgcgctttgggaggtccagacgggtggatcacctgagggtcaggagttcaagaccagcctggccaacatggtgaaaccccgtctttactaaaagtacaaaaaaattagccaggcatggtggtgcacgcctgtagtcccaggtacttgggaggctgaggcaggagaatcgtttgaacctggtaggtggagattgcagtgagccgagattatggcactgcattccagactgagcaacagagcaagactctatctcaaaaataataattattattattattactaaataatattaaatgttatttaaaaatctaactgccttgtaaactagatgaattccagatacaaagatgagtaaactaaggctggtgcggcggctgacacctgtaatcctagcactttgggaggccgaggctggcagatcacctgaggtcaggagtttgagaccagcctaggcaacatggtgaaccccttgtctctactaaaatacaaaaattagctgggtgtggtggcgtgcacttgtaatcccagctattccaggggctgaggcaggagaatcacttgagcctgggaagcagaagttgcagtgagccaagatcatgccactgtactgcagactccatctcccaaaaaaaaagatgagcaaactagatgagttccaaatgtaaagccatctcttttggggaaagactttcttttttttggttgccctgtcttagcctttttctgaagtgtcttagctgatagaagcttgaatgtgatcatttcattagcctaaacacagccacataattcagaagtcagtaagtcagtattcttttttttttttttttttttttttgagagggagtcttgctctgtctcccaggctggattgcagcagcttgatctcagctcactgcaagctctgcctcctgggttgatgccattctcctgcctcagccacccaagtagctgggactacaggtggccaccaccacgcccggctaattttttgtattttttagtagagatgggatttcaccacgttagccaggatgatcttgatctcctgacctcgtgatccgcctgcctcggcctcccaaagtgctgggattacaggcgtgagccactgcgcctggcccagaagtcagtattctttaaaaaaagactgaagaatgctaacctgacattctgtgaaaccaggcttgaaaaaacttgctttaggtttgtgctgaagatgatgaggtatctattaataaacttgtgctgcagccctccctgtcatgacagggcagcaggtgggtcaaggatgttgtcgtcattaccacaaacagcctttgagggtctgcttgtggcctcgggttgcctggatagttagtgttagagtgattgtgttgttatggttgtccctaccttaatgatgataactggggttgctccaagatattgagccacttgtttaaggtcatgctggcccaaggagctgagctaagattgagtcctctgtgcagtatgtcccaggacagagaaagagcacgtattccatgccgttggttcacttagatcattttcagcagttatgattgattgattgatttagaggcggggtctcgctctgttgcccaggctggagttgagtggcacaatcttggctcactgcaacctccgccttccaggttcaagcaaatctcctgtctcagcctcccaagtagcttggactacaggcatacgcccccacgcctgggtgatttttgtatttttagtagagaccgggtttctccgtgttggccaggcttctctcaaacttctgacctctggtgatccactcaccttggcctcccaaagtgctgggattacaggtgtgagccaccacacccagcctagttttggttttcaaactaatatgacttccttttgtgaagctgctggaaggccctggaggctgggcagagctttaggccacagagaaaatttgagctagttgacactctcctatcagatacacacataaataacttcacctagatcctattggaatgagaaggactgtgtgcctttgccctcgttatctagtgtataattcttgagggaaaaaactgcctccagagcaaaacattttgtctcttcagtctcacttttttctttttgagacagggtctcgctttcttgcccagtcttgagtgcagttgcagattcagtttactgctgcctcgacctcctgggctcaaacaatcctcccatctcagtccccacccagtagttggtactacaggcacacactgctgcgcttggttaatttttatattttttaggccgggcatggtggctcacgcctgtaatcccagcacttcgggaggctgaggtaggcggatcacctgaggtcaggagttcgagaccagcctggccaacatggtgaaatcctgtcgctactaaaaatacaaaacttagccaagtatggtggcatgtacctgtaatcccagctactcaggaggctgaggcaggagaattgcttgaacctgggaggcagaggttgcagtgagccgagatcgcatcactgcactccagcctaggtgacagagtgagactcttgtctcaaaaaaaaaaaaaaaaaagtttgaaaatttattcaccaaaagtggcgacagtcaatttattcaaattctatgtacctcaaactccaggaagggggtagactattggtataatttcacatattcaggaaataactacagcacctactaacagaacatctattctaggccaggcactgtggctcacacctgtaatcccaccactttgggaggccaaggtgggtggatcctgaggtcaggagttcaagaccagcctgtccaacatggtgaatccctgtctctactaaaaatacaaaaaaatcatccgggcgtggtggcgagtgcctgtaatcccagctactcgggaggctgaggcaggagaattgcttgaacccgggaggcagaggttgtagtgagctgagattgcgccactgcgctccagcctgggcgacagagcaagagtccatctaaaaaaaaaaaaaaaaaacttctgttctagatgagggaagacagaataggctcccctcaatgcccccaaaaaagtaaatcagaaaataacaacagtaaacccagtaacagtaaatattacaaataacatttgtagaggtgggtcatggttgtatgctgttttgttttatttatttttatttttgtttttttgagacagacttttgctcttgtcacgcaggctggagtgcaatggtgcgatctcggctcactgcactccgcctcccgggttcaagcacttcttctgcctcagcctcccaagtagctgggattacaggcatgcaccaccatgcctgactaatttttgtattattagtagagacagggtttcaacatgttggccagactggtctcaaactcctgatccacctgcctcggcctcccaaagtgctgagattacaggcctgatgagccactgcgcctggtctatttatttttatttatttatttatttatttattttgagacggagtctcgctctgtcgcccaggctggagggcagtggcacgatcttggctcactgcaacctccacctccctggttcaaggaatttccctgcctcagcctccctagtagctgggattacaggtgtgcaccaccatgcccagttaatttttttgttttgttttgttgtttttgagacggagtttcgctcttgttgcccaggctggagtgcaatggcacgatctcggctcactgcaacttccgcctcccgggttcaagcgattctccagcctcagcctctcaagtagctgggattgcaggcatgtgccaccacgcccagctaattttgtatttttagtagagacggggtttctccatgttggttatgctggtctcccaactcccgacctgaggtgatccacccgccccggccttcacagtgctgggattataggcatgaaccactgcgcctggcaatctttttgtatttttaatagagatggggtttcaccatgttggccagactggtctcgaactcctgacctaacgcgatccacctgcctcagcctctcaaagttttgggattatagacgtgagccactgcgcccagcctatttatttgtttttaagagatgaagtctcactttgtcaccctggctggagtgcagtagtagcgtgatcatagctcactgctaccttgaatcctggactccagtgatcctcccacctcagcctctcaagtaggtgggaatgcaggcacatgtaccactgtaaactgctaagtttttgtatgtttttgtggagatggggtttttgacttttttgatacagagtctcactctgttgcccaggctggagtgagtgtagtattgcgatctcgactcatcacaacctccacctcctgggttcaagtgtttcttctgcctcagcctcccaagtagctgggactataggtgcacgccactgcgcccggctaattttagtaattttagtagagatgaggtttcgccatgttggccaggctggtctcgaactcctgacctctggtgatccacccacctaagcctcccaaagtgctgggattacaggcacgagccaccacgctgtctggagatggggtttagccatgttgcataggctgttcttgagctcctaggcccaagctgtctacttgccttagcctctcaaaagtgctggaattacaagtatgagtcaccacgcccagcctcttttggttattttcaaaagtcacttttttttatttgagacggagtcttgctctgtcgcccaggagtgcagtggcgcgatctcagctcatggcaagctctgcctcccgggttcacaccattctcctgcctcagcctcctgaatagctgggactacaggtgcccaccactacacccggctaattttttttgtatttttagtagagacggggtttcactgtgttagccaggatggtctcgatctcctgacctcatgatccgcccaccttggcctcccaaagtgctgggattacaggcatgagccaccgctcccggccaaaagtcactcttcagccatttgaaataccagtaaaccccatagggtagaagttatgctgagagttgatgaacaagttagaaaaagagcatgtggaccctgggtcagctgctgccctagaatggggaccccttctgtaagctatgtcagaatcatctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtcttgtagtattcttgaactagggccccaagtttggaggtttggggagcccagcaggaaccttcacaggccaggttgttttagaggctcagaagcccctctgtggccctctgaccctcattaattgggatcttcacagaagatccctaagatagttcaccagtcctgtgagatggaatgtttttttatgaggtagtgctatgcccataaggactgctggcctgagaatgaaccatttcattagtagctagtaatcagtggctctagatgtaggaactttcttttttttgatatggagtctcattctgtcacccaggctggagtgcagtggcgcaatctcagctcactgcaacctccgcctccggggttcaagcgattcttctgcctcagactcccgagtagctgggactacaggcaccctccaccatgaccggctaattttttttttttttaatagatggggtttcaccctgttggccaggctggtcttgaactccttacctcaagtgatctgcccacttttgcctcccaaagtgcagggattacaggtgtgagccactgtgcctggcctctgttagactctttatttttattttttgagacacagttttgcttttgtcacccaggctggaatgcagtgatgctatctcggctgcaacctcagcctccaaggtttaagtgattctcctgcctcagcctcccaagttgctgggattacaggcatgtgccaccacgcctggctaatttttgtatttttagtagagacgggttttctccatgttggtcaggctggtctcaaactcctgaccttaggtgatctgcccgccttggcctcccaaagtgctgggattacaggtgtgagccaccacgcccgggcctgttagactcttgattgccttccccagctattactttggtacatgtgaggccaaagataaattagtggcaactgaaagataaggaaatcttgaaggctgggagtccagatagaaagccctaatgccttccctctcctccactcccaatgcctttttaaaagtgatgatggatgtggcatcttggcctctcagaaaccagctggcctaatggcagggcttcctcactggaggagaagcattgagatcttcaacctaagttctcttactcaggtttctctgtctgaatgtcaagggtaggctttatttccttcagggcatttagtcctggattggtagcttgagtaattttgctcttgattgactccttaaccttccagggctcctctgacctcttccctctacttcccagtgaataccatgtttattagagattttatgtttggtagggggtagttaccatatgtcagtttaaaaatttcataagtttagcagtttgttgttttttttttttgtttttttttttttgagaaggagcctcactgtgtcgccaggctggagtgctgtggcacgatcttggctcaactgcaacctccgcctcccagatttaagcgattcccctgcctcagcctcctgagtagctggggttacaggcgcccactaccacacccaggtgattttttgtattttagtaaagaggggtttcaccatgttggccaggatggtcttgatctcctaaactcgtgatccgcccagctcagcctcccaaagtgctgggattacaggtgtgagccaccacacccagccaagtttaacagcttttgaaagtcttttttttttttaggctgggtacagtggctcatgcctgtatcccagcactttgggaggccgaggtgggcagatcacttggtcaggagttcgagaccagcctggccaaaatggtgaaaccccatctctactaaaaaattacttgggcgtggtggtgggcacctgtagtcccagctactcgggaggctgaggcgggagaatcccttgaacccaggaggtggaggttgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttatagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaactgtgtgtatgtcctgtgtcattgtcatttgggaa

SEQ ID NO: 13053 - DNA, 30337 bp, Human
  misc_feature (1)...(30337): n = A,T,C or G
acagaggctcagagaggtgcagtcctttgcctgaggtcacacagctagtaagaggcagagccgggatttgaaccctggcagtctggccctagagccccagctgttaaccattaggctttatagccccagttataacaacaataataatactaatacaagtgaaccttcactgagtgccatttatagatcaagcactattctaaggattttaaagcatatttaattctcacagcactctgatgaaggaggtattcattttacaattgaagaaacagaggcctagagacattgagtcacttgcgcaaggtcacacagctggccagtggcagagccagcctttgaacctgagccttctggttgcagagctacggcttttaggcaccgtgctgagggcctccagaatgacacagatgtggcctcgagttacacagggaggcaggttgagggtgacccccaccaggcctacccaaggctgggtattaataatcacagtgcatacaccaggcccagggaggttgagccactcatccaagctcacacagcaagctcacagcacactcaggctgtcatgcagcctgggctacccccttaaccctgcctggcccctgcagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcgtgagtagggtggctgggaggtgggagggcacccagggcaccgtcacacttgccagagaggaactccggagcccgggcagggaggaggcagcggagcggcccagggcgccatctctcagtactacccagaggggagtgctccctgtcagacacaggataggggtcgtcagacccagccccttcctccctccaactcaggagcccaggctcccagccagattcctcaaagaccctgaggagtccacccatagactccttctctctctaactaaggagccctgtgtacctggggtggagaccgctaccttcccccatcccccgggggttgggtcggtctgatgatggggtcactgtatacctggcctttcccccacagctcggaatacctggccatcacctctgaaagcaaagagaactgcacgggcgtccaggtggccgaatagccctggtaaggcggatgggctggcagaggggaaggggattgggaggggccgaagtcccccaggtccctaattccccctctcttgctccccttcaggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggcggtgaggtgggggcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtcccccctccctgtaatgcactcctgccccggcccaacctcgccctctctcaccagccttgaactgtggccacctagaaaggggcccattcagcctcgtctctttacagaagtagttttgttcatgaaataaagactcttggacttgatgcatagtttcgattgtgagccccgtcaccttccccccattcccgtccccgaatcttcgagcccgctttccagggaccctacctgagggcccacaggtgaagccacttagtgcctgatctgtgtcggggttgggggagccatgggctcaggggtgagggagagtggaacggagccaggaagggagggggtgccgtggagggaagagaatcgaggctgatgctggggtgcaggggtggcatggggtgtgtggtgtgcccagcagtgtgagtctctggagaggtgggcgctggggagaaggagagggaaggagagacgggtatggatggaaaggcagaggaagccaggctaaaccagcgtgtcccaatgaggggccctgggctgagtggaggaaatgggtgcggtggaggtgggtttggctgggcacagcgggcacgtgtgggtaagcgggtggggccggttgtgcgggtggcctatctggggcaagcagccgaggccgactgtgtccggcgtgtggttgagcacgggcaggtgtctggcggtgaccctgcacgtctggtgtttacctggccctgggtctgacgtgggccgcgcctggctgctggcgggacagtgtgttatctgcctgcggacgcttccggccacttggcctgggcctctgcccttagcgctgtgttttcccggccaagccccccatcccccctatctagtgctaggactttctggctccagaggtcaccgcggccgggcggaggctgccaaagcaaaccagccccgtgacttgtaggaagccagcgggggaggggccggggcaggatgagcagggcaggcgggagaggctggggctggggttggggcccaggaattgggcagggaattaggcagaggtgcagcaagtggcgggcacagccaggacctggggctggaggacgcagaaagggcggggggaagggttcgctgggtgagggtggagtgggcttagggcagctggggccctccatctgatctcttctggtcagacccccacccttcagcctgcactttctccctaaacccccagcctccggccaggcctgtccctgttcccacatccccgcagacaggcacacctgggtccccctggaggtccaaggcaagccccgtagctgggcccgcctggtccagcccccacaagcccggccccatcagccaggtggcctccagtgctgccaatcgaatggtccggcccctccccgccccttcacccgcccctcgcccagccccctcctcctcaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtgagtccccttccctgagccccagctttggctctgcctggcgccccgccctctgtgctcttttctctaccctctactcttcggagccccctctctctgggcacccctcccagatgcatccccaccccctgttagtcctcctccacctgattaactattaaccacattttctgtgcagctgtgccaccaccagcctcccttctaccctatgtgaccttcctggcgtgctgcctcagtttcccctcatcccccagtgatttctcagctaactctggacttgtcctctgctggggctgaggcggggaagctgtagctgtcatggttaaggacacagatttggagtgaaacacacaggcttgcatttgaatttgctcttgccatcttttttgctgtgtgatctggtgcaagtgacattattcttagggctttggtctccctctgggtcaagcatggataccagtcctccctctgtgaggttgctgagtgcatgacacacaccaggcactggtctggggctctgcatataagacgcatgccatcaagcagagctgtcatgacagaggttggcaaactcggagtcccagagacccaggacccccaccgatcccagacattcctccacctcctggctctgtgggcaaaagagcagagggaggactttggactgggcctggatggatggagaggggagagacggcagagaaaccaccataaggatgagagagagagactgcgtcatggagttgctggcccttgggagtctctgggcagcccccagctagcctggcttcctttctacctctcacacatgggacccagctggaggggcgcatggaggggcgtcctgttctttctgccttcccctagctggggctgactccctctcttcttccgcaaccaggatagccgggctcagtcctgggcagtagcactttctagctgtgtggccctgggcagacggcgtgttctccctgggcctccattctctcatctgtgaaatggagagggtgacagtgcatgtccaacagcgtggggcgaggcctgaaatgccaggatgggcaggaagcactgagcgtgttggctgaaatgattagttcagatctctggcctcctcgggtctcggcacagctggcaattcagaccccaaaccaatcagctgcagtccagagggaacccaggctcccagttactcaggagaaggcattgcaccctagccgagcaggtggatgacagaatccagctccttggggacaatctctttcctggagctgccggaaggacagccccagggcttgggcccatgggtgaatgagccagggaagaaaagcagaaaatgcccgaatggacagagatggcctgggtacaaagagaaacagacacaaagtgggctctggtgcctccctggcagctccgggctggtcttggaggggagtcctgctgtcagggctaggggtgtggaggtcgaacctggacacagatgctgaagggttccgattctgcacttacttgccgggtgacccgggtttggtggctgccggactttgggcctccttttctcatctgtaaactgggggtgatggcaatggcgccttcctcgtgaacagctgcaaggatttaagtaaggatgctgtgcaggactggacggggttagggtagggcggtgcgtccgtgtgtgattcagagagccgttgtggctgcagcggctgctgttgttggtgtcactgttattgctgctggcttcttggtgctgcctggaaacttggaattggaggaggtgatactggagttgcaattccaaggatgccaggcagagggaagagcaaggctcttgctcttctctgggaagctgggaggtgacacagcactggtgtgcacgtagccaattgtggtatttctggaggtgaagctggaagttgagctgggtgggagaagaggtgtgcaagctggaccaggcaggggtgggactgttttggggaagagctggccaattccttgcagtaccaggtctctccacaaggtggcgccagtggttagtccctgcttctcttgtctaacttgtattttacaagttctactgtttgggttgctttttggaagctctctctggtacctgatagtgacccacatggttgtctgagaattgggggaaacatactcccaaatctctgaaagccatgcttataccctagtggggctggaaatgccaggctgagggacttaagctgtctggggggtactagggagtcacagagggttctataggtaaagaggggacaggttggatttggtgtctcagtaggttccccaagcctccgtgtggagggtgcgctagaagggagactgagcccagcggttggatggggccggagcaaggtgcagatggagagaaagaaggaaacgggggaaggagagtcactcaggaggattggcaggctgtcgggggaggggaatgttatgcagatggggatggtcctaggagtgagggcctctgagacaggaccgggaggaagaatatacttggggagacattggggagacattctgggacctggtaggggcaaagggactaggaggtcccagggaaaggtatttaaaaggtatttaaaggactgcaggagccctgacctgggacctggaagagggtctagggctggggacagaggggaaactgagtccacagaggtgggtgagacagacttaggggcaaggaggagcagggggaggctgcggccagccctacaaactctggattttacggagtaggtagagggtgggtgaagacagcagcctcagaggcgggaaggaaaatcaggtgcgcctggtgtcccagaagtccaaagaggagagcatttatacaggaagctgcagtcatgtaagatgaggcccgagacacggagccaccagttgagtggattttcagagccagagagccaaaggtgttacgcgtgggggtctttgcagccaaatggtggaggcggaagaactgacctatgagaagacccaaggcatccagaggggcctggagaagcaggggcagagagtctcagggagatgtaggggtgggggaggtctggcttaccaagggaaatagccctgctgctgggatcaaagaattgatgttgacgtgccgcctgtcccagtagagacacgcagggaggatgaggatgcgtcccacaccctgggccagatgaggatgctgcctgtcccagtagagacacgcagggaggatgaggatgcgtcccacaccgtgggccagatgaggatgctgcctgtcccagtagagacatgcagggaggatgcctctcatactgggggaaccccaggatgcagatgcttcctgtcccactggaggcgctgaagtcctctgaaccacacagcatggaaggaggttcttcctctcaccctaggagacacatacatagtggcattgcttcctgtcccaccagatgtgccaaggcctctaggctgcattctgcatggcctagagccctggcaggcacagctgaaaacaaagcaagcaagaccagcccagtggctgtcgggagccaagacctcctgctggaacctggagagtggtcctgggcagagttggggggcaggcctgagaacccctcgcaggacaggcaggggtcagccggcagtagttgggctggtctggcccactggggcctcttttggggaagagagtgtttcctcatgccttgatgggagccactgagctttcaatttttttttttttttaatacagagtctcgctctgttgcccaggctagagtacagtggtgcaatcttgattcactgcaacctccacctcccgggttcaagcgattctcctgcctcagcttcccgagtagctgggactataggcgcccgccaccacacccagctaatttttgtatttttagtagaggcggggtttcaccatgttggccaggctggtcttgagctcctgacctcaagtgatccacccgcctcagcctcccaaaggaccgggattacaggcatgagccaccatgcccagcctgagctctcaaattcttaagacacccagataatggccacaccaggaaggtcctagaccactccctgctctgttccaggtgctggcctggtgccgggttcaccagccacatcaccatgggtgcagatgggcgagctgggagctcctgccaccttggggtgctttgcggctgccaagggcagttgaacccaagccaggcccagctgaaggctttcagcagcctttactctttggccttcttataatccctagtgaaggggttggcttttatttatttatgtatttatttatttatttattttttgagacagagtctcgctctgtcgcccaagctgaagtgcagtggcgcgatctcggctcactgcaagctctgcctcccgggttcaagccattctcctgcctcagcctcccgagtagctgggattacaggtgcctgccactgcgcccggctaattttttgtattcttagtagagacggggtttcaccgtgttagccaggatggtctcgatctcctgacctcgtgatctgcccacctcggcctcccaaagtgctgggattacaggcgtgagccaccgagcccggctaggagttggcttttaatctccaggacctctttgccctgggaataaaatcccttttcctgtgccaccaggcctccccagctggccccagccttggttcccactaccttccccaagctctggccatctggccatctcgatggcctctccagcctctgacataagagagcctgcttattcttgcctcaaggcctttgcctgtgctgttccctctgcccacagtgcccttccttgtggtctgtgtgtggctggcacctcacctttcagagcttagctcagaagtctcctctaggggaggccctgtgatccctgatcccctgcagaagcccacctgctgccccagcctgcacggttttcttcacagcctctgccacaatctggaaattattgggttcatttacttgtttccttgttaatgtctcccactccccacctacacgcatgagaacgtgaacccctgagagtcgtaaccttatctgtcttctttgggttatgttcccggaacctagaaaggtgccaggcacacagcggatgttcagtaggatggtaaacaaataaagcttctttaggctgatgaaaaaactgagggtcaggcgcggtggctcacgcctgcaattccaacactttgtttgggaggctgagacaagcagataacttgagtctgggagttcacgaccagcctggtcaacatggcaaaccccgtcaatacaaaaaatacaaaaattagccatgtgtggtggtgtgcgcctataatcccagctactcgggaggctcagaattacctgagcctgagcgcttgagactgcagtgtgccatgatcgcgccgctgcactccagcctgggcagcacagtgaaaccctgtctcaaaaaaaaaaaaaagaaaaagaaagagagagagagagaaagaaagaaagaaagaaagaaagaaagaaagaaagaaagaaagaaagaaagaaagaaagaaaaaaggaaggaaggaaggaaggaaaagaaaaaaactgaggctgaggctcagagaggggaggggagttgctcaggcccacacatctctgatgatttataaagcatttatagagaacttgctatgtgccaggcacttccgcacagtgagagccaggatggcttcgtggctgtacacaggggacctggcatcaaacctgcccagggttctggacgctgctctgcctcttccaggctgtcactgtgggcacgtgaccccacttctctgagctatctcaaaaacaggaatcatagttgtgggattgaaataaggactaaatgagctgatgtatttagaacggtgcttagcacctggaggcatcaatacaatttgagctattcttcttcttcttgaaaataactttaaattattatttttagaagtaggtgctcagtggatgcccatttaatagataagaaagttgaggctcaaagatatgatggcacctgccttaggttccagctaggaaggggtagggtcaatatttttaaatgaggctggccagacgcagtggctcactcctgtaatctcagcattttgggaggctgaggaaggaagatcgcttcagcccaggagtttgagaccagcctgggcaacatagcaagaccacgtcgctaaaaaaattaatacataaaataaaatgaggctggcagattttcaagtggaggggcaaatttgatcttgcaactgggtaccatgagagaggtctgatttagggggtatctaggggcaaagcatctagaacagcagaaacgactgaggcagcgaggaaatgccagcggcagggaagagagctaccaagagggcaaaggttgggggtcacagtcccaagaagagatggcccaaagcaaagacagcaaatacaaaagcacagtgtcactggggaggagacattccctaagtgccccaaggaaaacgtgacaggcggtcgggaacgtgtttgggggaaagaccccgttggcaaggtggcccggccatgccctcccagctgactgggactggacctgttgttcacacgcaggaacaccttcaatctgccccggaatgcctgggagacatgcttggcataataatacctgggcaggcagatgctcgcccagacctccgcaatgagacaggctgctctggcacccagcatgtgtcttgcagtgccgcgcatcgtcaacaagtgcagtctcatgcggactgtactttacacatcgcggcactnnnnnnnnnnnnnnnnnnnnggtcagctcggtatcccctcccagctggaacctgggggagctgggcacctggttgttcacacgagcagggaggaacagccctgtcaactgctggccccgggaaactgggcctggggaggacatgcttgggcataataagttagccctgggggcagggcagagctggcctcgggcccagaccctgccgcaatgaggacaggcctggctgtggccccagcatggtgtctgttgcaggtggccggactgtgccatgctgctccagacccaaggtggcagctctcactgcggggaccctgctacttctgacagccatcggggcggcatcctgggccattggtgagagcggttcctgtgcctctgacctcccctggcccctgcagcctccagcctgcctgccctcacccctcccttctctgcagtggctgttctcctcaggagtgaccaggagccgctgtacccaggtgagtggagcaggctgggaccctctgggggagccctggaggacacgtgtatctggcgggagctcaacaagcgtatttgttgaataaatgcacaaatgcatgcagaaatgctaatcataatagtgcatttgtattgagtgcctgctatgtaccaggcactattctaagcaccccacatgtctaacccagactttttcagacaccagtgtattactcatgagtgcctcataaaattaaattagtgagttggaaaaccatgttttttttttaagtatgaaatagattcgattacagactatcacagtacatctctcagtaagtaaaggttatgctaatttttgtttgttttttttttttttgcatccatatacatgtaatcccactgcatccccacactctgagggtgggactgttattctccctgttttacagatggggaaactgaggctttgagcaatgcggcagtttgccccagactacagagctatgggctacatcaggatgtaaaaatgtgtttcttactgcgtggcatggtgaaaacatgttggggaggcatgatataaattcagtggacccttctaactctcctaggaggtagtttttttgtttgtttgttttaaaaaagaaaaaagtcttgctctgtcacccaggctagagtgcaatggtgcagtctcagctcaccgcaacctctgcctcccaggttcaagcgattctcctgcttcagcctcccaagtacctgggaatacaggcgtgtgccaccatgcccagttaattttttgtatttttagtagagatgagatttcaccatgttggccaggacggtctctatctcctgaccttgtgatccacccgcctcggcctcccaaagtgctgggattacaggcatgagccactgcgcctgtccctggtattagctccattttacagatgtgcaaaatgaggaccagagaggacatgcagctggggaacgaggggccaggaacagctcttagacttatccactgtaagtgtgtctgcaggcatgtggaatgaatggccacacaaataaatagataaagaaactaactgtgggatgaatgaatgaatcttcccaaatgccaacttcaagctgccattccctgatgcaggacagcaggaaaaaaggggaagttgggtggtgggatgtatttttcatgtctgtgagcctcatctaattccataaaggattcagttcacactaaaatcagaaatgaaaatccagacaagaaaagccaacatcaacattaatcatcattaccagcacttagcatttgtatgcaccagccaaggccttgggaccttatgatatcaactcattaagtcttcccaacaacctgttgtttttcttttcttttttttttctttctttctttctttctttttttttttttttttttgagatggggtcttgctctgtcgcccaggctggagtgcagtgacacgatcttagctcattgtaacctacatctcctgggctcaagcaatcctcccatctcagccttctgagtagctgggactataggctaatgccaccatgcctacacaaaattattttgtcaataacaaattattgttatttttatctttttgagccagagtctcgctgtgtcgcccaggcaggagtgctgtggcgcgatcttggctcactgcaatctccatctcccaggttcaagtgattctcctgcctcagcctcctgagtagctaggactacaggcacgtgccaccacacccagctaatttttgtatttttagtagaggcggggtttcaccatgttggccaggatggtctcaaactcctgacctcaggtgatccacccgtctcggcctcccaaagtgctgggactacaggcatgagccaccacacccaacctcattttttaaatttttagtagagatgggatcttgctacattgcccagtctgatcttgaactcctgagctcaaagcagtcctctcagatcagcctcccaaagtgcagggattacaggtgtgcaccaccacaacccattttcctatggggatgctgaggcacagaaaggctgagtgacttgccccaggtcatggagctagtcagtgtcagggctgggatttgaacccaggcagcctgcgtagtaactgtatatagtgtctacacttgattgcttgttaaaaaaaaaaaaaagaacagctgaattcattgccatagtaaagactgacatatgccaggccctggcggcagcctttacccagcaggcctatgaagttagggctgttacatcccaacattttgcatttgggggaaattgagtcccagtgaagcaaactgacttgcccgaggctgaccacacatcagagacagagcgaagggatcacgcccctgtcaaaagcccctccgtgacaacacgtggcattgagataaaatcccaacccatcacaggctccaagcctcctagtgtggaggcccctctccacccccacctcacactggcttctagcaccctcagggcccagtcccttgctcaaatgacctgctcacacagaagtctctactcacccacttctttctagctcacacccagaggcagatttcagttctgcacagttccttctgagctgtggggcctcccaccagtccctactctctccaagactcaatttcctcatctgtgagatgggggtaagaagaatcagtgggaataagaggagataaaaatctgtgtagtacttgggcggggtgcggtggctcacccctgtaatcccagcactttgggaggccgaggcaggcagatcacctgaggtcaggagttcgagaccagcctggccaacgtggtgaaacctcatctgtactaaaaacacaaaaattggccaggcgtggtggcgggcgcctgtaatcccagctactcaggaggctgaggcaggagaactgtttgaacctgggaggcgcgggttgcaggttgcagtgaactgagatcacgccactgcactccagcctgggtgacagagcaagagtctgtctcaaaaaaaaaaaaaaaaaaaaggctgtgcagtacttgcctcttagccagcacagtggacattggcttttgtatctcactcctgaaattctttcttgaaatttcttgagcaagatcttcctggacttccagactctatggcctctcaccctatggtgtgtccctgccaccccggtaaaaccctcctcactcattgtgaattatttactcctggcgaactccaggaaggcagggaccttttgtggtcagacggtgcctggcacatagtaggttctcaggaaatccttgagttatgagtgcacccaaagccaaaacactgggatgaactagagagtcatgggcctccagctggaaaggagcgaggccaccactcacacccggctctggccagcaccacgccgccaccctgcagaggtatttgggtttttcaacaactcagggaaatgatgaaacaaacaaacaaacaaaaacaaccccaagcttgtatccccacctcgctttttttttcctgggattttcacacttctaaatatatccaacaacttggcaggcacaccaggtgacccagaacatcctttttgtgttgcctgaaatgataggaacaagaataaagaatttaaaagtgagaaacagcagcagagagtgtgactttaaaaatagccagaggggacatttgatgttctctccccactcccatctcccccaacacacatctataaagtgattttcccccctaaaacctcacactttctggaaatcacatttccagagcagttaacagtcattttaaaataagaatccacccctcttcctgccccagctggtgtttcaaactccaagccttggctttcatggggtgatgaggaccccccagctagaggtgccaggcattccctgccccaaccccagagcaggagaccgtaattaaggcaggccaggccggtgcggtggctcacgcctgtaatcccagcactttgggaggcccaaatgggcagatcacttgaggtcaggagaccagcctggccaacatggcaaaaccccatctctactaaaaatacaaaaattagccgggcgtggtggctggtgcctgtaatcccagctatttgggaggctgaggcatgagaatcgcttgaactcaggaggcagaggttgcagtgagctgagatcgtgccactgcactctagcctgggagacagagcaagactccatctcaaaacaaacttaaaatagaataaaataaaataagaatccgcccccctccccgccccagttggtgtttcaaaccctgagacttggccttggaattcatggggtgatgaggaccccacagccagaggtgccaggcgttccctgccccaaccccagagcaggaggccatcattaaggcaggccagccaggtggcttttcagtgccagccgtagctgaatatattaggcagggagacaggcaagggtttgtatgagacccacagaaggaacagggaatatgctggtctgggttcaagtcccggttttgctggttagccgtgtgcctctgggcaagtttattcctctgaggcttagttttcccatctgtaagatgggcatagaagtggtcactactggctgggcacagtggctcacgcctgtaatcccagcacttggggaggccaaggcaggtggatcacctgaggccagaagttcgagaccagcctggccaacatggtgaaacgctgtttctactaagaacacaaaagttagccaggtgtagtagcatgtgcctgtaatcccagctactcgggaggctgaggcaggaggatcgcttgaacctgggaggcagaggttgcagtgagccgagatcatgccactgcactccagcctgagcaacagagcaagattatgtctcaaaaaaaaaaaaaaaaaccgaagtggtcactatctccgaggatggttgtgggattcagagagccacttggataggatgcatagcatggggccagcccactgacaccccccagtaaacgtagccagtgctattattactgtgctgttgtttaaccctccagaggggaagtctcttgagaggctgtccagggcaatgttaaaagcttggggtttgaagtcactcagacctgatttcgaatcctctctccctgcttctcgtgcatttggtgacgttggggaagccaccccacctctctgagcctcagcttccccgtctggaatttggggatgatcttcgtggctcctggggtgtgcgacgaggccttggttgatggtggggcagaggtagcctagccccaggaacacagtaggtcctcagctggggagagttctacttggaagtcttgcttctccttgtcccaacctgcggggctgtgggaagacccctcagctggtgtgtggcctcaccaggttccttctaagaggatgcaaaagcaagttttcatttgactcggtttcccagaatgtgctctcagagcccaggccaggcaggaggctcttgagaaaaggacaaaaagacatggtggctcacacctgccatcccagcactttgggaggccaaggtgggaggattgcttgaggccaggagtttgagatcagcctggacaatatagcaataccctgtctctacagaaaaaaataaatttaaaaggcgtttttagctcaggctttgctgggttctaacctggctattgtcactcagctttatcctaacataaaaaaataaacaaattagcagggtgtggtggtatgcccctgtggtcctagctacttgggaggttgaggcgggaggatcgtttgagcccaggaggttgaggctgcaatgagctatgatcgtgccactgcactccagcctgggtggtggagcgagaccctgtctcaaaaaagaaaaaaaaaaagtggcagggagaaggaaaggaaaggacaaagaggttcacagctgatctctccctgaacctgctccttccgtccccatctctgtcagccccatcttttcaggctcaggccaaacccctcggttaccctcccagttcctccagtcacccatgaatcagatcttgcaggaaaccctgtcagctgcacctacagaacctctccaaaatctgaactcttctccccgtccactgcccccaccctgctccagcccccttcccctcccctctggacatcccagagcctcctccctggcctccctgctcccatccctgccccccaatcatatcccacaaaggggatatgactcactcacttaaccggcaattctggagggtcttaaaacctggctgcctcaagaggctttaaaatgttatcagatgggggccaggtacagtggctcatgctggttccccacttgcagccagagggagctggtgaccacctgagtcaggtcagggccctcccctggctgcacctcacaccaggtgccagcaaagccctgatgttgctctatttctagctcccacctgatctgcccctccctggctcactctgctctggcctcccactgttcctggagcactccccccagtcccccacaccagccttgggatctttgcatctgcaagtccctctgtctccgtgctgatctcacacacctcctgacactttctcacctcctgcaggtctttgttcctgcaccaccttcccagggacgctctccttgcagcgactgaaaagtgcaacctcaccccaccctccacgccggcactcccctccctcggtggcattttatttttctctgtggccccttcctatcttgtgacacataatatatcctacttatttgtccctttcttgatttgtctcacctactgagctttgagttccacaggggtcggggtttttgtctgatttgttcattgcagtggtgatttgttcactgcctaaaatagagcctggcaggtacaaagtgtttggtaaatagaaatcaataccccagggtctgtgacctgacttaggtgttaacaggttcctctgaggtgtgtggggaacagactgaggggtttcaggggacatctgttctcaccacaaattgccccccaaccagccccagacatgaacagtctcccgggagctccctctagccttctcgtatatcccagccctgcctcatgtcacaatttgtaatgatgtgtttggctgggtgacattttatggccatctgtctccctatcccctataatgtggtttgccgaaagcaaagcccaggactgtctcggccatctgtgtctccaggatcacccctcactgggcatggagtatgtgtccagttaacgcttgctgagtgaatgaatgaatactccatcctctgcctggagaattacgcactttagcatatccaaggctctgacaagtcctgcataaaagagcattattgttttctttctttctttccttctttccctcttcttttctttctgactataggatattgattatcaatctggcaatagtcaagattggcagtctggtgtattagtcaaaggttttcagcctacaaaagacaaaaagaaaaaataaactggctaaaaacaaaaggggatatgatttactaactcacttaaccgacagtcacagaggttcttcaaacctggctgtatcaaggggctttaaaatgttatcagatgggggccaggtgcagtagctcacgcctgtcatccagcactttgggaggccaagacaggcagatcacttgaggtcaggagttcgagaccagcctggccaacatggtgaaaccccgtgtctactaaaaatacaaaaaattagccaagtgtggtggcatgtgtctgtagctccagctactcgggaggctgaggcaggacaatggcttgaatccgggaggcggaggttacagtgacccaaggttgcaccagtgcattccagcctgggtgacagagcgagactctgtctcaaaaaaaaaaaaaaagttatcagatgggaaatgaattccgatattaaaaattgatatgtatttatactatattattaaagttatttttcataaaacatagaagggtaagtttaagaaatgagaagtatttataccaaaatgattaaatattatttaatttaaagatataaatgtcttgttggacaaataattcaaaatttccattagacaggaaaaataagttcaagagatatattgaacaacatggtgattatagttaataacaatatattatatacttgaacattgctaaaagatattttaagtgttctcaccacacacaaagggtagtgcatgtgttaattagcttgatttagccgttccacaacgtatacatatttcacatcatcttgtacaccatcaatgtatataattttgtcaattaaaataaatacatattttaaggccgggtgcagtggctcacacctataatcgcagcactttgggaggccgaggcaggcagatcacctgaggtcaggagtttgagactagcctggccaacatggtgaaaccccatctctacttaaaatacaaaaaaattagctgggcatggtggtgcatgtctgtaatcccagccactcgggaggctgaggcagaagaatcgcttgaacccgggaggcagaggttgcagtgagctgagattgcaccactgcacaccagcctggacaacagagtgagactccgtctcaaaaaaataaataaataaaaataaaataaatacatatatatttttgagatggagtctcactctgtcgcccaaactggagtgcagtggcacgatcttggctcactgcaacctctgctgcccaggttcaagcaattctcctgcctcagcctcccgagtagctgggattacaggcacctgccatcatgcctggctaatttttgtagttttcatagagacgaggtttcatcatcttggccaggctggtcttgaactcctgaccttgtgatccacccatctcggcctcccaaataaatacatattttaaaagatagaaatcactctggaaggagagttaatctgtttgatataataataatatattaatattatattataacaatatattagtattatattctaataatatattaatattatattataataatatattattatattataacaatatattaatattatattataacaatatattaatattatattatgtaataatactactactccatatagctatggaaaagttcatatgaagaaaccaggctatgatctacaaactggcaacaaatttgttcttctattttccatatgctgtctgtgtacgtataaagtgagaggtctttttatatgagttaagggtgtgaccaaagacaaatggaaaaagacaaatgacaaacatactaataaagagcttcggtttctccacaaaaaatacaataataaaataaaatgttatcagaaatctcttgactctcctccacgttagctcactttttccctcaagagggtgaacatgacccttaacagatccagcctcaagtgctggattctcttgggaacttggttaaatggttttttttcttcccgaatgtccaagtcaccttccagacctgcagctcctgagcagccaacttaggacttctaatggagagtgaagttcccctggttcgcggaggggccggccacagcctcaaggctgctgttgattggtccgacctgagtccttgagtctggcagagtgccatggtgctctgtaatcccacctgtaatcccagcattttaggaggcagaggcaggaagattgcttgagcctaggagttcaagaccagcctgggcaacatagcaagacccgtctctacaaaacaaaacaaaacaaaacaaacaaacaaaaaaattagccaggtgtggtggtgcacgcctgtggtcctagctactcaggaggttgaggtaggaggatttcttgagtctgggaggtcaaggctacagtgagccaagatcacaccactacactccagcctgggcaacagagcgagaccctgtctttaaaaaaaaaaagtccttgagtcatgattccagatgcaatcgcagatgtgggggctgcaaccctccgatgggctggggttcacgtctacaccacatggctggagcacaggccaggaggggctccggctggggaagcatgtggggagcctggctgtgggacccaggcggccccgggccctgtcgccctgcagtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtggtgaggagggcagcgggcaggtggggcaacacctcagacccccaaggcactccctctccccgttttccttccacctgtcttaactggtctctatttcctttctttctgtgtctccaatcccatctctcccagtgattgccccagaggccgtttcttggccgccatctgccaaggtgagatcctaaaactcagaaccctctcctttaggcccttggggaggccacgtcccctcaagctccccaggatggggccatgtactttcagaccccctagggcagggccaagcctgggctctggggacctgggctccagtcccctgtcgccgccccctgctgacccttgtcccacagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagtgagtgccccccaatggcgctgatgatggggaggcagaggagcggagagacagtggggaggagggcggattgtgcccaggcaggtggccaccctccacccctttccctggtaggcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacaggtaagtctaagggctgagccatggggcttgaggacccgaggccaggaggacagaggaggggaccaggggcacaaggcaatcaacttatggctcaggcatccttggcaataaggggaatgatctcgagggagcacaaagtgggccttaactatcaatgatcagtgcagccaatttggaaaatttgccagcatttccccaagaagtatacataaagttaccattggacccaacacttccactcccaggacaggaggtatatacctaagacaaatggaaactgtgtctgcaccaaaactcgtacatcagtgttcatagcagcattattcataatagcccaaagatggaaacagcccaagagtgtttcatcggacaaatgcataaagaaaatgtggtatattgaccgggcgcggtggctcatgcctgtaatcccagcactttgggaggccgaggtgggtggatcacgaggtcaggagtttgaaaccagcctggccaacatggtgaaactccatctctactaaaaatacaaaaattagcctggccaacatggtgaaactccatctctactaaaaatacaaaaattagcctggccaacatggtgaaactccatctctactaaaaatacaaaaattagcctggcgtggtggcacacgcctgtaatcccagctactcgggaggatgaggcaggagaatctcttgaacccgggaggtggagattgcagtgagccgagatcacaccactgcactccagcctggctgacagagcaaggctctgtcatcttgaaaataaataaataaataacaaaaaaaatgtggtatatccacacaacgggagaatattggaccatagaaatgaatgaggtactgattcatgctaccacaaggatgaaacttgagaacagtgctgaatgagacaagccagccgcaaaggccacatactgtaggatgccacttgtatgaaatgtacaaggctgggcacggtggctcacgcctgtaatcctggcactctgggcagctgagatgggaggattgtttgtgctcaggagtttaagaccagcctgggcaacatagcaagaccccatcacttaaaaaaatgagctaggtgtggtgacggatacctgtagttccagttactcaggaggctaaggcaggaggatcacttgagcccaggagtttgaggctgcagtgggctaggattgtgccactgtactccagcctgggtaacagagcaaaaccttgtctgttaaaaaagaagaaagaaagaaagagaaagaaaagaaaggaaggaaggaagaaaagaagaaaagaaaaggaaagaaagaaaagaaatgtctagaataggcacatcggtagagatagaaagttgattgatggtggcagggtgggaggtggggatgggagattgggaggtgactggtgaaggacacaaggtttcttgtctgggtgatgaaagattctaagtcgatcatgatcatggttgcacttgtctgtgactacacaaaaagccagtgacttgtgcctttaaaaggaattgtctaatatgtgaatagtagttcaatcaagctgttaccaaaaaactaataaaatgaaaagaaaatgtgttaaaaaatgaatgaatcagatttagaaagtaagttaggagtcattccctctgcaattccctggagtattcccttggtcttactgagactcacttaggtgccaacatgtccttaacacctctccaacacgtacatcttccttttggattaaaagcaggccctgggcttcagatttcagcaggctgcagtgtaataataataataaaaataggctgggcatgtaatcccaggccaaggtgggggtatcgcttgagctcaggagttcaagtctcgcctgagcaacatggcaaaaccccatctctacaaacaaaaaaaattagctggctgtggtggtgcgcgcctgtggtcccagctacttgggaggcggaggcaggagaatcacctgatcacccaggagatcaaggctgcagtgagccatgatcacaccactgcattctagcctgggtgatagagcgagaccctgtctcagaacataataataataatgatgatcatgaagtactaatagcgagtagtattcgagttcatgattgagtattcgagtatagcgagttcatgatcatgaagtagtaaaagggaataagggagtacatgatgagtgtacacaacacagtaaaataatctggtaaacatagcagtgtgctaggcaccattccaaatatgtcctgtgtatggactcacttagttctcacagcaaccccagcacaccctggtaaggagggttctcttaagatcctgttttccacccaggaaaaggtcccaacccaaagaaggcaaacaatgccccaaattcgtacagctggtgaacggcaaagatttgtgcccaggtggactggcactggaatctgtgcttgtggcccccacgctgtggtgacggagaatccagggccatgttggggttggcattatgtttatttttatgtttattttatttttcatgatctgtggtactggtttcccattgaagggagtgatacatgcttttctttaaaaccaaaccctgtcctgacatggtggctcacgcctgtaatcccagcactttgagaggctgaagcaggcagatcacttgaggtcaggagtttgagaccagcctggccaacgtggtgaaaccccatctctactaaaaacacaaaaattagccaggtgtagtggcaggcacctgtagtctcagctactctggaggcagaggcaggagaatcacttgaacccaggaggtggaggttgcagtgagccaagatcgttgccacacccttctccttagtgaaaagagtgagagagttaatattgaagtaaggacgcatctttgaggacaggtggacaggtggaagcggctgggatttcagacacagggctgagggggtcacagcatgggctttggggtcagattcagatatttgccaactgtgtgatcttggacacatgacttcacctcaccgtgtctcagtttcccttatctgtaaaatgacttcctagggttattgagacaattaaaagggttaatatgagtaaagagcttagagaactgccagcacatagtgaacactggtaaatgttagcaattgctactattgttgtttaatacttttactagttatatgaacacttgctgtttgcctggcatgcaactcaatgactcaccaatttctcactacaacttctggggataagtgattattatttccattctacatctgagagctctaagactcaggcaggtgatgtcatcagcaggcagcaggcaacaggcagggctgccaggaacccttgcataggttgtgcactgcacaaggacaccacatctcagggttaccactctctctgtagacctgtgtatttattattatgattttctgccaggtggaagtcaaatgtctcaagataggagtgtctctctctctctctctctttcttctctctctctctctttctttttttgagacagagtcttgctctgtcacccaggctggagtgcaatggcgcaatctcggctccctgcaaactctgcctcctaggttcaagcgattctcctgcctcagcctcctgagtagctgggattacaggcacctgccatctgtaatcccagtgctttgggaggctgaggcaggaggattgcttgagcccaggaggtcgaggctgcagtgagccatgttcctgccactgcactctggcctgggtgacactgcaggcttagaaatgaaaacaagctgtgttaaaacatacatgttatgaaactttggacacgtgacttggcctcattttccccctctctaaaatgggataatatagaccctacctctctgggctgatgaaacattaaagaaaatggtgcaggaaggcgcctagtatgcgatgagctcttggtacgtggcgacttccgttgtggcttttttgtttgtttgtttttgagacagagtcttgctctgtcgcccaggctggagtgcaatgacatgatctcggctcactgcaacctccacctcctgggttcaagtgattcttctgcctcagtctcccgagtagctgggattacaggtgcgtgccaccatgcccggctaatttttgtatttttagtagagatgaggtttcgccatgttggccaggctggtctcaaactcctgacatcaagtgatcctcctgcctcggcctcccaaagtgctggtattacaggcatgagccactgtgcccagcctattgtggttttttttttaaagaacagagagggcagggtgtgttaggggccatggtagcagctggacagaggtttgtaccaggtggggcaggccagcaggggctggaccagcattgtctctctcacagaatacatccagcctgtgtgcctcccagctgccggccaggccctggtggatggcaagatctgtaccgtgacgggctggggcaacacgcagtactatggtgagtcctgtcctctgcctctgatgccaccatttgggagactctgaactgggctggggatgggcagtctggctggttggatgagtcttgaccatgaggagtagggacgctgaggggaatggggtgggcaccaggagggaaggggggtgtgtacaccccccagctctggccagccttgcctgcacacccccaggccaacaggccggggtactccaggaggctcgagtccccataatcagcaatgatgtctgcaatggcgctgacttctatggaaaccagatcaagcccaagatgttctgtgctggctaccccgagggtggcattgatgcctgccaggtgagggactctgtaggggcagccccctggtcgctgccaccccagggatggagacgcaggggagtgggtggtcgggctccccatctaaaagcctgagggctctggggccacagcccatgtcatcccgggggggcctcctgtctaaccactttggcctccagccagacctccctctcccctcccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaatgtggcctccgagcttacaaatgtacacagcaatgaggacattttgtcaggaaggaagagaagaattaggacctggcgcaaatcagacagagagtgtgggtccctcagttcccactgatttgagatttaagattttaattggttcacttaactggaattttcctggagcaaattggcttcaggtacagctggatccagctgctctctcaaatctgccttaggctgtgttagcttcatttccaagcagcctctcctacaaccagagagagagatgtccccttccacacaaactctttcccaatcactgcagaaaaagacccaggcaacaacaacaacaaaaacccaggcccagctcccattgtacagatttgggtcacgtgctcatcccttggcaaatcactgtgcaccggatgtacgcggtaggggtggagcggggtggagtgggaggagctaggccttcaagaatcgtgtgacctgagtgtgggagtcccaaaggaaatagggtgctatttccagaagtggaaatagatgctcagtgagcaaaaaagacatctaccttgaaccaacacggaaaacggggccctgtaaggtggagatagggagacgctgggaacacagcctgagaccctcccccaacccctttctccatctgggcagcttctggggaggaacccccttctgtagagcctctgcagagcctcatgcagccccgatggccaccagggggcactgctgccccaacattgtgacacattaaggggtttcctgcctggagtcagccgcatgttgctgaaaacctgctgttctgctgaagaaaggctcagcgggggagcctgttcaccatgactttaaataataacaattatcatacatcacccatggaccacagcttccaagcaatttcctttttttttttttttttttttttttgagacagagtttcactcttgtctcccaggttggagtgcagtggcgtgatcttagctcactacaacctccgcctcctgggttcaagcgattctcctgcctcggcctcccgagtagctgggattacaggcgtgccccaccacgcccagctgatttttgtatttttagtagagacgggctgtcaccatgttggccaggctgctctcgaactcctgacctcaggtgatccacctgcctcggcctcccaaagtgctgggtgtcacgcgcatccatgtgaagagaccaccaaacaggctttgtgtgagcaataaagctttctaatcacctgggtgcaggcaggctgagtccgaaaagagagtcagtgaagggaggtaggggtggggccgttttatgggatttggataggtagtggaaaattacagtcaaagggggttgttctctggcgggcaggggtgggggtcacaaggtgctcagtgggggagcttctgagccaggagaaggaatttcacaaggtaatgtcatcagttaaggcaggaaccggccattttcacttcttttgtgattcttcagttacttcaggccatctggatgtatacatgcaggcttgggctcagaggcctgacactgggattacagatgtctgctgccacacctggctaatttttgtatttttagtagagacgggtttcaccatgttggcaggctggtctcgaactcctgacctcaggtgatccgcccaccttggcctcccaaagtgctgggattacaagcctaagccactgcacccagcccagcttcctaaaatatagatgatctacaagagctcctttgagaaactgacaaactgtgcatttggaaaacgatcccagcgtcactccccgatccccacacccctggcgaggttgagccccaccactgctttgttggtcaggagcccccaggcccacatcgtgttagcagagcctcagtgcagtttccccaaacgtctacctctggctgtggtgttctacccatggcatgtgggatgtaatttgagacctgacctacggcttgctttgttagaaacgtatt

SEQ ID NO: 13054 - DNA, 13644 bp, Human
  misc_feature (1)...(13644): n = A,T,C or G
cagtggaagcggataagagccccctctcgaggccgaggtcagaggccaggcagggtccacaggccaggtccgcactgtctggagctgctctccgcagacggctcttctggctgaagctgccattcttccagaccctcgggcccaaagcctggaagccctcacggggctggcctcataacccttctcccggtccccgacagcctgagccttctcccacccacccccttccccttcttcctgcccaagtgttgcctctgcctgggcttcctccgcgtggcgcctccagtggagtcgggccacccaccgccctggaccaagcctcctgagtcctgctctcctgcccactccttggctgtgaagccccctggtttgcaaggccctgccctccgcctcaccatggcctttgtgtgccctctctcctgccccattggccccttgctcatccctggacatactgtcccctgcctgttcccacgtctaccgacccccctggcttcgccagctgccgagatcccacttgcactccaggaacccagtggagttccaccttctccacacaggctttccagacccagaggcctcctctccttcccaaggcttctgcacacgctgtctggtatcacaggctcagaaccatgccctgggcagggctgtttggagcagggggtggctttggcatgaggtacacagtgcctcaggggtagatgtgcagcgggtcctcgtgaccacagcctgggtggccagtccgaccagccctgggctgggctcctaggggcaggcagggccggggtgcagaaaggcaggggccatggcaagcacagagaacctggacttgcggatccaaatctccaccagctgcagtcatttcacgggaggcctgctggtggccccatagacctgcagggccatgtgagcgtgacatgggctcaggtgtgttgtcccttcaggcccccagccttgcaatgccctcagcatggcagctacacgttaccccaggagcccagactagtgaggaccagatgcaggcctcagctggctgttgggacagaccggcagggctgggcttgaggtgggccaggagagggcaggaggggacagtaaggtggtatttgaggccgggagtgtagcctggtgtggcgctcccagacagcactcagtgtggggtgagataaacagggtgggggatgtcgggttgggttttgagggtcacaatggccaggccctcccctatggccataccaagcaacccagggcaggggtcacattttatatccaagtactagggacacacgaaccaaggcatggccttttcttacaatttaaaaaattgagatgcaattcatataaaattcatcattttattatacaatgtagtgttttttagtacattgaccgtgttgtgcaacccttaccccaaaaagaaaccccgtccccaccgcagtcactcctctccctctctccagcccccggcagccacggatctgcgttctgtgtccgtggatctgttcatatgagtggaatctcacaatatgtggcaaccctttgtgactggcttcgttcagcctcatgttttcaaggctcatccacgttgtggcccctgttggtgccttgttcctttttacagccgagccatgtgctgctgcgtggagatgccacatgtgtgtcttttcatccgctcacaaaccaggcttggcttttgtgacttggccaagttcccaaagccagccggtggcatcactgggacgagaccccacaggcggtgggcctctgagcagggggccacctgccggccaccctggcctttgaggacacagcctggcgggggcggtgcaggcaaaggcttccttgaagccttctggtctgacctgtggctgggataagtgagtaggcctgacgggctggcctccttcctggagggagtggcgacaccaccacagtgccctcagctcgcgtttctgggcctgcagcccccacgggctctgggggcttctgcttactgcgcccccctgacccacagcatccgcagtgtcatgcagaagtacctggaggaccggggcgaggtgacctttgagaagatcttttcccagaagctgggtgagtatggcagtggctctgccagccaccggacttaacttcttgcccctaccccagccagcccagctgtgctccccactctccagagatttggcctcccatccactcagggtggagcagccagcgagaccccagggcttgctccaagtcgctgcgaccctgcgtgcctccttgcccctggctgtcggcccagggagccccgtggtgggggtgggggcccagagtcttccagggccgccagggaagttcctcctttggggtttttgtttttgagagttgcagcttccccttggcgcggccgcagctgctctgggccgttggtagaactgacaggaagaggcggggcccttcctgtggcgcctgccgagctgtggttggccccgccccaccccatgggccctctttgtaagcaacctgcctggtgttggccctccattcctcctccagctggtgtctgatgcctgctgtcagaagtttcatgtgacccaccctgcggacctggcccggagggcaggcttggggcaggtctcgggaagcaggctccagccccacatggctctgatttggccttcccgagaacaggagctcagctctggacagggggtatcctggcctgatgggatcaggcattgggggtcagcctgggggagtcggtgtgtcaagaagcacaaagtttgggtcccaggcctgtgccttttgtccttgggcaagttgcttcacctctctgagcctgatggtgtcctcatctgggagatgggactcatgagtccgactgtgcaggcctgtcagagtcagatgggagcactgtgcccactgtgaagcctggcccccattcctcaaaggccctgcactaaaggccaggcagtgaggactgaaatgatggccgcagctctgacccaggtgcccaggcagtgcccccgaaggcatgagaggccacccagctcgagcctggttacccgtgtcagactggaggcctgaggagggcctctgtcccctggtagtgctcgggggccggggtccagggtccaggccccttactcaggcatgaggacaccctatctggggtcccctgagagcccctcccacagcccaccttgcctctccagttccctgtggcttacacccgttccatgccccctgccctgaggccccagccccaacctctttcccagggacctgccatttggtggagtagccctgagttccacttgagcctctgccacagacagtgtgtctgaccagctccctgagccctagtttccccaactggacccaccctccctgcctgtttctcaggctgctgtgcaaatcagccagacactggagtggggcagggtccagaggagtggtgtggcctcagagccccctgctaaccttttccccatgctgcagcctgacctggccccggtggccacagcatcccagggcccccagactgaatcgtgttgcacctgcacagcccgccccggtggggggtatcggcctcacagagcaggcgcagggccctgggctgcagtgagtgggggcccaggtgctaagccagggctccctgatgccagagccaaccccgctcctctgcctcaccctggtgcccatcgccgtccagctaccacctggggaaacagatttcaggaagagggtagaaacacaggggccccaacccagaatccaggaatcttcacgttggcagcagccttagcagctgcctggcccaccccttgcctggggccgagaccacctttgccacctccatagccagttctgcccagggagcccaacccacaccatccacaatgatgggaaggcctctgagagaggcgtggctctgtgaccttacactgttgccttcagggtacctgctcttccgagacttctgcctgaaccacctggaggaggccaggcccttggtggaattctatgaggaggtgagacccagaggcccaagccctgctctgcctggagaaaggggaggaggttggggcggctttgtggaacccacaagctgcctggtgtgggcatccccattccctgctgggctctagatgacctgcaggaatcctgtcctccagatcaagaagtacgagaagctggagacggaggaggagcgtgtggcccgcagccgggagatcttcgactcatacatcatgaaggagctgctggcctgctcgcatgtgagtgtcctcagctggccctgtgtgctggcccagagtcacctgcagattgggaggggaagagaggaccctgctgagaattcatggccacctctgtcttccccagcccttctcgaagagtgccactgagcatgtccaaggccacctggggaagaagcaggtgcctccggatctcttccaggtgtgtgcctcccggtccctccccaggcaaggtcaccttggacagcccctggtcaacaagcctggtcagccaggggtggggcctgggcaaccacggtctctcggggctcagtcaccaacttccagcttcctcccttagccatacatcgaagagatttgtcaaaacctccgaggggacgtgttccagaaattcattgagaggtgagagcagggaagtgtgggagaggaagggggagggaggggccgctctcagaaggggtatggctggcgtggagggcagaagccagccttcattaggccctgagcaggcaggtggctggcccgtcagcggcccccttgcaaggactcctgagaagtcagacaggctgcaggtcatctcccaccctgccctcctcagcaccaggcagctcaaagcccatcccaggcagtctcctagctccagggagctaggagagctgtgccacctgtgcctctttctctcccgtgggctgtatagcaccttgctggcccacctggactgagaagcatcagagtcctggtaggggtaggcccagtagagcgcatggcccccgtgaccctcacagccagagttggcgcggtgggtgggaattgtaggtagatttcagccagctttagggagcagctgttttagggtcactgctgcccagccatggagtgagctctgtgtcactgggggtatgcaagcagggacaggagacgtacttgtcaaggatatggtagcaggaagtctgggttagactggaagacctcctttctgtgcggatctgattccagcaggaagccacggccaggtggccgagggccatgctgggcacccaagcagccctgactggtgctgtgggcgggcaggccctcaacatatccttcctggaagaggacattaacgctcgtgatgtttccacacctaccctcacgggaccccagggagtggcggctgggtggggaggctcacgacagcatcatccttcccacattctgagtggcccctgagccctgattcttcttttccagcgataagttcacacggttttgccagtggaagaatgtggagctcaacatccacgtgagtgggcttgggtggggcatggaaagccacgcaccctgctgctcctctcccgggagctgggcctgtggcttggctgggagggggaggtcaggggatgtctgtcctttagcccccagggccgtggctatgggggtcagggccgggatcccagcatggggaggccggagcaggtaaatatgtggcaaggatggccaggacatgggtatggggaccctggcatggggccagcccctgctgcccaggtgcctctgccccagggctgggcagaggcagcctgtggtgaccgcagctgtcgctgcccctcagctgaccatgaatgacttcagcgtgcatcgcatcattgggcgcgggggctttggcgaggtctatgggtgccggaaggctgacacaggcaagatgtgagcaccctgctcggcgcggtgggatacctcggggagccgggctcctgggggaccctgacaggccgggttccacacagggccacctgctgctccatgcactcctgtcttgccgtgctgttacccccgcaggctcctctggccccagccctccctgtctctgatttgtgtcacacgctggtcctgggtctagtctttccctcaagcgccccctgaggcagccctgggcccctgctctgagggtgggtgttgactgccgacctctgccccgtaggtacgccatgaagtgcctggacaaaaagcgcatcaagatgaagcagggggagaccctggccctgaacgagcgcatcatgctctcgctcgtcagcactggggtgagctgggtgggccgggctgccgctgaggctctggaaccccgggcgcccctgctaactgcccgccccctcccctcctctcccctcctaggactgcccattcattgtctgcatgtcatacgcgttccacacgccagacaagctcagcttcatcctggacctcatgaacggtgagtgctggccgggccctagggtgggccgggcccaggcacgggaggctggggcaagacactgagtgctgcctgtgggactgcctccctcaggtggggacctgcactaccacctctcccagcacggggtcttctcagaggctgacatgcgcttctatgcggccgagatcatcctgggcctggagcacatgcacaaccgcttcgtggtctaccgggacctgaaggtgagcgcccctgctgtccccaggctggacctccgtggctgtcctctccttcctctcgacatcccggccaccaggcccagaggagtggggctcctgggacatggccgccccgtatcttcccatctccgcccctgcccttcccaccgagccactctctgggtccaggttgtagctggggacaggagagaggacccccacctttgccctttctttgggtacccatcgtcctctccagtgaagcagtgacccagctggcatcttgcctggctgggccccatcctgagctgccccaggcagctcactgggcttccttcacagccagccaacatccttctggacgagcatggccacgtgcggatctcggacctgggcctggcctgtgacttctccaagaagaagccccatgccagcgtgtgagtgccccccaccctctccctccccaccccttgccactcccgcttatggcccccttgctcccacaggggcacccacgggtacatggctccggaggtcctgcagaagggcgtggcctacgacagcagtgccgactggttctctctggggtgcatgctcttcaagttgctgcgggggtgagtggcccatcccaggtgggcaggtgggttggggctaagagaagttcctccccaatccaggtgggatgccaaaggaggggagcccatagctgccttggtggtagggttggcaccgtccctgactttggccacagctcatccatgctgcctgcctccctttccccattcctgtcctttgacattggtttttggcctttcttgcccaggcacagccccttccggcagcacaagaccaaagacaagcatgagatcgaccgcatgacgctgacgatggtgggtgcaggtctcagtgcagggccgcagggggctggggggagctcctgtgggtgccaggccatgactcttgcttcccaccagccagcagagatctgggccactgacccctactctggcctctgagacagacctcctgccccataggctctcgccctccccgtgctgttggagcatgactgctgggcgagctaggatgctgtgccccatctgtccctctgcgggggcctggacccctctctcccctgagctgggatggggtcaagggctcttcctaagcccctgctaatgtcccactcctctctaaaggccgtggagctgcccgactccttctcccctgaactacgctccctgctggaggggttgctgcagagggatgtcaaccggagattgggctgcctgggccgagggtgagtaccctggcgccttgggcatgctgctggctgtgcccccatgaggacaagggctgtgtcccgtcacctggaaccccctccaaggtcccagcctccttggaggagctcataagttggggcatggccagccctgtccaatgttctcagagtggaggggctgccctgggagttggagctgctggaaccagctagtaactggcttccagaggggcccttgtcacagatgatgatgatagcagctttttatgtttatcaaacatttattaagcactgggcatagggttgcaaaatttaccagtgttaaaacccacaaccctacgatgtaggaacttctgttctcccatttgagagatgaggaaacagctcaggcttaaggaacttgcccaagttcacagagccagaaagtggctcaatcaggagttaagcccgggactcagggtggggctgagcccagatgactggcctctccccacagggctcaggaggtgaaagagagcccctttttccgctccctggactggcagatggtcttcttgcagaaggtaacagtctgcggcagggactgggggtgctctgcagccccacccccgagctaatgcccatgacccctgttctgctgcagtaccctcccccgctgatccccccacgaggggaggtgaacgcggccgacgccttcgacattggctccttcgatgaggaggacacaaaaggaatcaaggtactgggccttgcctggcctcttgtacctaggctgtgatcctggcctggggaaggatccctctcccttcttatcacctgtgagaccctgtgccagccctgccagcttgtaggcctcagttcctccttggccaacttccctggggggtggcagttgcactgaccatccctacccagggccctgggtctgggcagcctgtggctgatggtattccggcatctctgtccacccatgtgcccctgccccatccacctggtaaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaaggtgagggtcgccggctgctgcggcaccaggcccctgcctgcttagaagtgagcagctggctcgggtttaaggaactcaccctggatcacagccagaaagtggcggctctgggattcaaactcaggctggggccgggcatggtggctcacgcctgtaatcccagcactttgggaggccaaggagcgcagatcacttgaggtcaggagtttgagaccagcctggccaacatggtgaaaccctgtctctaccaaaaaataccaaaaaaattagccgggcatggtggcacgcgcctgtactcccagctacccgggaggctgaggcgggaggatcgtttgaacctgggaggtggaggttgcagtgagccaagattgtgccacagccctccagcctgggcaacagagtggagaccctgtctcaaaacaaaaaagaaacccaggtggggccggctgagtctcctctgtctctcgcctcagactacgccctgggcaaggactgcatcatgcatggctacatgtccaagatgggcaaccccttcctgacccagtggcagcggcggtacttctacctgttccccaaccgcctcgagtggcggggcgagggcgaggccccggtaaggagcccgtgcgggggtccgggagccgggcttccgggtggctggccggcccggctcttacctgcaccacccatccctggccctgcagcagagcctgctgaccatggaggagatccagtcggtggaggagacgcagatcaaggagcgcaagtgcctgctcctcaagatccgcggtgggaaacagttcattttgcagtgcgatgtgagtgggggctgagccagggatgggagggccgaggggccaggccaggcaggctggggagagccccagctgacagagctgggcttggcatgtgcagagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattcggctgtctcagactctttttgtacctggtgaccccttttcagcttctgctgggctggggcctgatggggagggtctcggtggtaccaggtctcctccaccgccatggcttccaaggtggtctgctcgggcccaggccatcttccaggtggggtgaggcagtgggtcccacttcccctcctacccctcccagctgacagtcctctccacctagtggctgtccagtgcccattcctcaccttttcccggggaggagagagcagcttctgccacttcccaggtaagcaggaggaggtgccaacagtgttaggcctggcacagtgtctgggctgactgggaccgtctcaggcccacagaacacccctgcacagcaggcaccaagctgaggcccctccccagaaacagtcacaaggcacctcttccctctaggtcacaccgcagcctctgggcccttggccatctctggcttcagcctcctctctggcctcactgcacagccctagtaggggtccctgaggcctgaggggaaccccagcactaggcctctcctctacccagaggcttctggtcaacttccctttccccaggtccctgccctagccccgcgggtgactaaacagatacatgttgctgcccactccacacagggctttgctgggcatggctggggcccatggccaaagcacagcatgccaggcagagaagggaggcaggcagctgggcagggtactcagggctgaatacaagagtcaggggcaatggcctttgagccaggcctccagcattggtgtgggaaggagggaggacatttctgaggcagggaagagccagggactcatgagtggcccaggctggccggaggactataggaaggagccatgcctggaggcactgaatgccaggcttaacctatcccggagccaggtgtgtgctcagggcctgcagaatgaagatacaaacgacatggagtccagacctgccatgctcagggagcccttgaaggtgcggaacagggctgagagtggtgagagctggctctaaagtgattgcctggttactgagtacaggatgtggggagggaggtgaaggacaggaggcagggagacaaacctccgcagtgggagaggaagagatgaaaagaggccagacgggaagaacgtggtccagcagaaacaggctggacttggggctgagtgaggcgggagtctggggaagagggtaggtgtggttgggttggcttcggacatactgatgggatagcatgggatccctgggcacagagatgtcctggagtaagctgaaatgtggacctgggggtggcatcagggtgacaatgggaacggacagtctctctcccagggatgtgggggtcagggagagagaggaggccgtggaagagggttgagaaggcactgtcatggaattaagtgccagtggggagctgtgttcaagatggcagaaatcaggagaggctggaaccaagaaagtcctgtcggggttgagtttggagagggctcagggaagggaccgcctctgagaaaaggggtggccagggagggctgcagtagtggtgagcaggtgagctctgggcattcagaagccttcgggctgctaccaaccccaggacctcacagattgacaccatagcgtggggtggcaaagtgaccccagatggcacaggcgccatgtgactacagggagaaggcagggtaaaaatggcaatcaggccttccagcccagagtctcagaactgaggacgccctacagcaggaagtgatgctcaagctagctggccctcctcaatcatgttccacgtagggaaagggagaatagagggtcagccttggccacctagcaaaaccagggccccagaccccaggctgggcctccagtaatcaagggccggaactgagctgacggaggcctgcaccctagttccggtgtgggtggaggggccggccctgatttcgaaactcgccttcctctcctgacgctggcagccaaccgcagcctctgcaaaagggactcgtgcggcgggcgaaggcagccgttcgccgcgggcggtcctccgccgggacggctctgccgctgcctgggcctgcgcccctctctccccgaactcctatccctgacttcagggccccgggggccgcctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13055 - DNA, 27767 bp, Human
tatcaaacagagcatttcaacaggctggctaatgtgtaggaagctagcttttctttgtgatataatttgtcatgtaaaatcataagctattttacaagtgtatttcattcactgtatcttaaaattcatatggttttatttaaagataatttcatcaaacagctgaattctaaaatcctacctttttttcaaaatcatttttcagaactttgcaataacaggaagtaaagaatcagaagggtgttaaaaaattgacttggggggaaaaacatttggacattttgctggctaggtttacgaaatatacacatccagcaaacatgtgagtccctttagggtacagtgcagtgaagggagaagtggaaatactcaaggttctggggaaggtcaaatgaagggtccctcacattggctgaggccaacctggcttcagaggtgtgcagaggcaccaggccgagaacagggctttgcagtggtgagggcaaaacatgaacacaagaaataccctaagttactgacctggttgtgcctggtgacagatgggaccagctcttttctccatttggtaattttggaaaatttggcagagttaataaagaaatccccttggtgcaagattgctacaataagaatctattatagatggcagatgtgaagttcacagtcctttttattatcctaacctagtaacatgactagaggtaaaattaaatattgagttagatgattgtttaatattttaaaaccagagggaagacatacaaatagattgagagcagtttctttctaaagataatcagaatatatctcctatattttaaacactgcaggaacagtcaaaattttaaaataaatggtttccacatttttttatccccatctctccccctgactatatagtaaaatattttatttggcaaccacgttttcctacttttaatcacacatcatcagagcttttcatcagcctaactagtcttcctactcactgagttgtgacgaaagcctggtctaggcacttttaccacggccatgtttttgttaagatccctgcagactgtgaactatgaaaaccagcccctggccccgcttgtgggtgctgcagagccgcgtgtgaactgctcctaggaaaccgcgtctctgggcagggtggctctcgggccgtggatccgcctaaaagcttttctgccagtgacgcccttggtctctggatgtgttcacgcctcagtgattttactctctggtttcttgtgtgtgcttgagattcttgagagaaagcgtgctgcagatgaaaaatgcagcctacatgaaaaagagaaggggaaagccattttaaaataacttccatgtaagttactgtaatcaaagtgctgctgcctgtgtgttcataaaaaaatatgtgcaagggcccggagcggtggctcatgcctgtaatcccagcactttgggaggccgaggtgggcggatcacttgaggtcaggagttaccgagaccatcctggccaacaaggtgaaaccccgtctctactttaaaaaaacaaaaaaattagccaggggtggtggcgcgtgcctgtaggtcccagccactcaggaggctgaggcagaggctgcagtgagccgagatcgcgccactgcactccggtctgggcgacagagcgagactgtctccaaaaaaattaagaattcaaatgtgaacccggctttcatggcgccccggccacggagagcctgggggagtgggataaaaacggtgctgggatgggagggcggcttgtccgcgaactcctcccaccacgcccggaccaaagccgccggcgccccgcttccggggccgccctaaaccgcggccgccgctccctgaggggccgcctgacccggcggaaagccaggctgtgtggccggaggtcaccaccccgaccccgactagtcccgcagcgcctgaccccttcgtgggcggccccgaccgccgcggctcgaggaggggcggggctggggcggccgagctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggggacgggggcggggcgcgcaaacctcgcgaggagaggacggccctgagtggagggaggggagggaggggagggaggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgaggtgaggcccgccccgaggggaggaagagagggcggaacccagagctcggcggcggtggccgtctcgttgccttacgttccttaccctgatttctcctatatgggagtcgtgtgagctttttgaataaatacatttcagtaaaacgtgtccgttccgtcaaagaaaaataccaccaacaaagaaacacagatgtggtttacatgaaaaatgcggatgattttcagacggctaacgcttaggaaagcgggtgcctttgaaaggaccagcgttgcccgcccggcgcctcccgggcttccctgctcgtccgcggacggggcgctgcggggccggggggcgccggctcttcctgtggcctccacgctggtgccgcagccagtgcggttttaaataccggagaaggtccccaagtcaggagagtctctcggcgccacgggttcctctgggagtgcgccctggccttgccttagggtttcagcctcggaggaccggttctgggcagtggagaagggacctgagttctgccttgtaaagttaacgttttgcgtttgtttttgctaaagaatatccaagttgttacaattaactgagatgatttggcacaaaagttttatctaaagtagtttgttgtgcccagaaaaggaaaaagaggctaaattaatggactattgtatttttcactgaccattttcactgttatctcttatttcagtctttatcctcatctctactcaagagcatacattaattttaggaatcctgatgacatccttctttttagagatcgttttgatggatatatcttccttgacagcaaaggttggattattggtttttaaaaatctattataatctgtaggtatactaatgaagtattgctagaatattcgtgctttttaaattattattattttttgagacagggtcttgctctgttgcccaggctggagtgcagcagccgcaatcacggctcactgcagcctcacactgcggctcaagcaatcctccagcctcctaggtagcagggaccacaggcgtgtgccaccatgatcggctgatttaaaaaaaaaattgtgtagagacgggggtctcactgtgttgcccaggctggtcttgaactcctggcttcaagtgatcctcccacctcagcctcccaaagtgctgggattacaggcgtgagccacagcatccggtctatttgtgcattttaattaaaaagttctcagactaaaataagtttataaattttgattatgttactgtaattatgtgcagatattaaaaattgaaattatttaattttattatttaatccaaaaaaattccagaaattctgtgtaatagtgacagcctatttatgtattatcatcagagaatgaaggttttcatgagtgagtttgttgcatgagagaacttgatctttttaggttctaaagctaaactattttacctgataggaattttccaaaatgtacactgacttctatcttcctaaacagcatccttcatgactgtaccatttatgataatgtcaccaggaagtcactgctgttaaacagctttgcctgcggagacagcagtcttcaactctactctcaatagttcccttatcagtacttctagggttctgctttcatctttttccttctcttctcctgtcaggctgtctgctgttgtgttcctggctgtcaagtttgtatacctttcacagcaagttgttttctgccctcccctccccagccaccctcttccgactccacgtgttttgacactgatgagtgttttctttttctccaatgaggggtaaggactagaaagattgttaaaaaaataagcattagccaagctagttcctgtgactagaagcaaatgtgatgcttgaactgacctttgtgttcattgctcatttattcagtaacttactgagtttccctttttcacttaaaaaatattggtgggccgggcacagtggctcacacctgtaatcccagcactttaggaggccaaggcgggtggatcacgaggtcaggagttcgagaccggcctgagcaacaacgtgaaaccctgtctctactaaaaatacaaaaattagccaggcatggtggcaggcgcctgtagtcccagctactcggaagactgagacaggagaattgcttgaacctgggaggcggaggttgcagtgagccgagatcatgccactgcatcccagccggggcgacggagcaaaaaaatatgtatgtgtatgtacgtgtatgtatatgtgtgtgtgtgtgtaaaatatgtgtaacatggccaggtgtgatggctcactcctgtaatcccagcactttgggaggccgaggaatgtagatcagttgaggtcaggggttcgagaccagcctggccaagatggtgaaaccctgtctctactaaaaaaaaaaaaaaattagccaggcatcatgaggcatgcctgtaatctcagatacttgggagactgaggcatgagactcacttgaacccgggaggcagaggttgcagtgagccaagatcgtgttactacactgtagccttggtgacagagtgagactctgtctcaaaaaaaaaaaaagtcacaaaatttataccatactgttttccacagtgactgcgccattttaggttcccacctgtagtgagcaaggggccagtcgtccttgtttccggttatctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatttttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatacttcccagtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgcccacccatcaagatggatgtactttgggaggccagggtgggcggatcacaaggtcaggacttcgagatcagcctggccgacatggtgaaaccccatctctactaaagatacaaaaaattagcagggcatggtggtgcgtgcctatagttccagctactgaggaggctgaggcaggagaatcgcttgaacccagaaggcggaggttgcagtgagctgagatcgcaccactgcactccagcctggtgacagagcgagactccatctcaaaaaaccaataaaattgatgtgacatgacagccacattgtttatcatttattttcctgtctgtctcccaccacataaactcccttcttgttttgtctccccagtggaactatattttcatcttcatggttgtagaaaagttcaggaatttagtagatgttgattgaattaataaaaaaagattaatattactgaaatagtccgttcactttcttcatttatctagtaataaagctttttttccccccactctgttgcccaggctggagtgcggtggcacaatctcggctcactgcaacctctgccttcccagttcaggccattcttctgcctcagcctcctgagtagctgggattacaggcacccgccatcatgcccagctaatttttatatttttgtggagatgggtttcaccatgttggccaggctggtcttgaactcctgatctcagatgatccgcctgcctcagcctcccaaagtactgggattacaggcgtgagccaccacacctagccgtaataaggcttttgatcactaaagtaaacaaaatatgctgaggctgcatgctgcctgggcactgactctgggcctcagcatggggccaagtggtaagcaggttgcacaaggcctctgcctaccatcgggatgacaggttggaagcaggagcaggaatagtccaaccagggcacctcagtgtgtaatcactgccactgatgtgacaaagtggaatatgggagggaaagaggttgggagactccctccaagatagtggtggagctggagctgagactggctgcgggagggaaagaggtcaggagatgagctgagcctggccgtgctgagcagtggaggaaggaagcgccaggggcagggccggctgctgtcgcttttcactgcaggcgcagagtgcaggcttgtggggttggcacacatgggtgagggcagcgtggttggaggttcagggcactgcaagacatttagattcattccagggcaactggaagccactgggggagtagcatggtctgattatttgtccccgtcactttggtggtgtcacatgggatagactgtggatgccaagagatgagcgtgtgttttggaggtgggctggacaggaccgacagacggatagggtgtgggaggtaaggggacaggaagaattaagactccagtgcttggcttgaacagatgggtggattgtggcaccattatacacaagggaacatgagggtaggacagtattgggggcaaagtcgagatttcacttaagaacttgataaattgaagaagagctagaagcagcaaattagacgttattacaggcctcatctccctgcccctcccatttccatctcactttgttttaaatgtccccttgcaaaggatcggtcactttagggctgttttgagacatacctttttggggcagacacgtggctcctgccggggtggggagaggggggcatgtcctggcacctccccgagagtctgctgcacagccaatgcttcacaaaagttggctgaatgaatgaatgaatgtggcttagaacccaccatccctgatgggagcgattaattcattccaggacttggctgtagagtcttccttgtttctgtgattgctgtttctatgtatgaaaaattgaaacttggccgggtgcggtggctcacacctgtaatcccagcattttaggaggctgaggcgggcagatcatgaggtcaagagattgagacctttctggccaacatggtgaaaccccgtttttactaaaaatacaaaaattagctgggcgtggtagcatgcgcctgtagtcccagctacttgggaggctgaggcaggagaatcgcttgaactcggcaggcggaggttacagtgagccaagaccacgccactgcactccagcctggcgacaaagtaagactccatctcaaaaaaaaaaaaaaaaaaaattttaggcaattcatggcagattacctttttcttttctaagcttttggcctccagtggattcttctgcacaggtctgagaagcaagtgttaaatggaaatactaataagctgtttctggcaaggactctggagttgttgagttagtctggtgcatcggcctttagcatcggcctttagagcagacaggcctgggttcagctctgagacttctgtttacttgtgttctgttgcatggttgtgcgtattctgtctgataaataacatacttttatgatgtgtagaacactttcttattcagggtctaacgtactttgcccgtgatccctgtgggtgatagggcagacattttataggaagaggaaggtgggcaagcggagtctggggtcagcctccccacacatccaggtggtctcgcccggctcctggctgacaagttcaggctttccacagagcagagcagaaccctggctgatttgagataatttgcccattacaaagagctgaccatttacctgagccagtgtgctgtactcaccctgagccagagttcatggtcagcccagggacccctgggggagtgttctctgtggcaactgtgtctgccacgaaatgtggcatttgtacctgcatcagctcttccctacaaccactgtgcctggggcagggctcctgggacaatcggctcttccctacaaccacagactgtccctggggaagggcttctgggacaggtgccatttcatctatgatgtcagggtgtcaggggttctcagttccaagtgatggatccctggccagggcttctcctatgattcctgattcattcctggtcctcagaattccagagatgatgtgtcagttttcaggtacatccagggattcttcccagccctgtttagtctgagatcttacagacccacagagtagaccccgtcttcccccttcccatttgtgtccttgtgttggtgggatgtggggcctgtccatgtcagcgcaagtccctctgaggtggggcctgtggggcctctagcttgcctgggcacccacatccaggtcagatctgagaggtcgggcatgaaagcgaaggaccaagatagagtctgtagaaatgttcattccctagtagttggtgccttttctgcaatcagcagcgccatatggagtcattttctttttcttttcttttttttcttttttttttttttttgaggcagagtttcgctgttgttgcccaggctggagtgcagtggcgcaatctcggctcactgcaacctcctcctcccgtgttcaagtagttttcctgcctcagcctcccgagtagctgggattataggcgcgtgccatcacgcccggctaattttgtattttttcagtagagacggggtttccttaggttggtcaggctggtctcgaattcccaatctaaggtgatctgcccgccttggcctcccaaagtgctgagattacatgtgtgagccaccacgcccggcccatgtggagtcattttctaaactacaatccagagttgtatgtcttatcattgggattttatggagtatatattgtaagacattacaagaatccatgttattttaaaactgttgcttggagaacggaaaacgaaaaagttctcagaatatgcgatgtatcaaaataaatatatgttatttaatgatttaaggcacctacaaaaatatcatcttggaatattttaagcctcccttaagaatcaggaattagatgtctactatgtatgaaattgttgatactttcaaattacttgacctgacagtaatggaataaaaactcccctggagacagtgtgtaaatttaaaaagtaatgatatggttcccgtatttattttaaagattacattcaaaacaagtatttaaaatacatctttctttaggagttaaatacaatattacaatttttgtgttttagctagaagaaccacacctcttttggaatatattaaaaatagaaaattagaaaagcaggtaggtctggcctttacctgatgaacaccctccctgcttctgccattctcatccaggcagtttatacacacgctcttccatgtctttagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaaggtaattctgaggaaacatttcctttttccaaaaatagctctgctatagtaattacactttttacatatcttagttctttagaattttgaaaacattctgaattaatctaatattgtgttgttatttttttccatcttttccatctttctttccatcctacagcagtggttatcacagtgcgtcctgagccctgggagtcctcaggctgctgttgggtgcctgtcctcctgggtgtgcagtggggagcacaccccacaggagccccacgctggcacacgttgggctgctgctgacgctcttttttttttttttttttttaaactttccaactttcattttcggctcaaggcgtacatgtgcaggtgtgttacatgttcattgtcagctcaacgcgtacacgtgcaggtgtgttacgtgttcattttcgactcaaggcgtacacgtgcagatgtgtcacatgttcattttcagctcaaggcgtacacgtgcaggtgtgttacgtgttcattttcgactcaaggcgtacacgtgcagatgtgtcacatgttcattttcggctcaaggcgtacacgtgcaggtgtgttacgtgttcattttcggctcaaggcttacacgtgcaggtgtgccacatgttcattttcggttcaaggcgtacacgtgcaggtgtgttacgtgttcattttcggctcaaggcgtacacgtgcaggtgtgccacatgtttattttcggttcaaggcgtacacgtgcaggtgtgttacgtgttcattttcggctcaaggcgtacacgtgcaggtgtgttacgtgttcattttcggttcaaggcgtacacgtgcaggtgtgttacgtgttcattttcggctcaaggcgtacacgtgcaggtgtgtcacatgggtaaatcaagtgtcactggggtttggtgtgcagataattttgttgcccaggtaatcagcacagtacctgatgtttttcagtcttcaccctcctcccattctccaccctctacattttcctttaaaaaaaagttttcctcccagcactttgggaggctgaggcgggcagatcacgaggtcaggagttcgagatcaccctgactaacatggtgaaaccctgtctctactaaaaatacaaaaattagccaggtgtggtggcggacgccttaatcccagctactcaggaggctgaggcaggagaatcgcttgaacccagggagcagaggttgcagtgagccgagatcgcgccattgcactccagcctgggcgacagagcaagactccctctcaaaaaaaaaaaaaaaaaaaaaaaatttcctggccgggtggggtggctgacacctataatctcagcactttgggagaccgaggcaggcggattacttgagttcaggagtttgagaccagcttggccaatatggggaaaccccatctctactaaaaacacaaaaatgagccggacgtggtggcgtgtgcctggaatcccagctactcaggaggctgaggcaggagaatcacttgaacccaggaggcggaggttgcagcgagccgggatcgcgccactgcactccagcctgggcaacagagcaagactctgtcttaaaaaaaaaaaagtttccctgattaaaaaatacacatttgaaaaccactggttttgcctttctgtgtgaaggctgactcagaaccgggttttatcatttctttggcagtagcactaatgagtttctgtatttcttgctgagttttttctgtgactgatacattcatttatgagggtggtttaatacatagagggaatttttctctgtgtgaaatgtgttggccagaattgggaccagccattatctcctcagtactaaacctagatttgaacctaaggtatcactcattacttattatttattgaataccttatattcaataatattgtacaatatgaggaaaaaaatgaaatgtcaggacttggggaaagaagatagcttaggaaagggtggggaagagatcattgaaccatagatttgtttctgatatggtcagcagtcaaaaacagaaaagttggctgggtatgatggctcattcctataatctcaggactttgggagaccagggcaggtggattgctctagcccaggaggtcaagaccagcctgggcaacagagagagaccctgtttctgttttttgtagagatggggttcccactatattgcccaggctggtctcgtactcttggactcaagtgatcttcctgcctcaccctcccaaagtttggggattacaggcgtgagccaccatgcctggcctggtttagcttttaataagtatctgtgctcagtatgggggtctttcacttctaaatcatgtggaaaattgaaattcttttaatgcctgaaaaatggaatctgtggagaaatgcaaaagaaggtgtatcaacagcttaaagaaagacagatggctcatggctattttgctatttttttgtttggttttggtggggggggggtttgagacagggtctcaatgtgtcacccaggctggagtgtagtggcacagtcacagctcactgcagcctctacctcccaggctcaagtgatcctcccgcctcagcctcccattacaggggtgcaacatcatacctgaatagctaatttaaaaaaaaatttgtagaagtgggggtctcactatgttgtccaggctggtcttgaactcctgggctgaagtgatcctcccactgctggggttagaggcatgagccaccgtgcgtagcactcatggctattcttaataaagagaaatatggtttgggaggccgaggcgggcgtatcacgaggtcaggagatcgagaccatcctggctaacacagtgaaaccccatgtctactaaaaatacaaaaaaatagctgggcgtggtggcacacgcctgtagtcccagctactcaggaggctgaggcaggagaatcgcttgaacctgggaggcagaggttgcagtgagctgagatcacgccactgcactccagcctgggcgacagagcgagactccgtctcaaaaaggctggaccgcggtggctcacacctgtaatcctggcactttgggaggccgaggtgggcggatcattaggtcaggagatcgagaccatcctggctaacacggtgaaaccctatctctactaaaaatacaaaaaattagctgggcgtggtggcgggagcctgtagtcccagctacttggaaggctgaggcaggagaatggcatgaacccgggaggcggagcttgcagtgagccaagattgcgccactgcactccagcctgggcgacagagcaagactccgtctcaaaaaaaaaaaaaaaaagaaaagaaatacggcacacagaacagctcagctgtttaatgttcctctgaggatgctaagcagtgagcttatgtgtggccacatgggtgaacacacacaggcgagggctgggagggagcacagctgcccatgcgctccgcttggcctccggaagccttgcagggcgtggcagagctggcctgctccccagctcgtctccagcagctctggcctgctccccagctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagctcgtctccagcggctctggcgtgctccccagctcgtctccagcagctctggcctgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctgggccctcctcttcctgcgtctctgatgctttactctcccttcatgtctgttcgtagcttttgatgctacctgaggttatcttattcctttgtttcctttttcatatttttgccactgttcacagcattcccccttgaccaccgttgcctcaggtggtgcatcaggcgcaagttccttcgaggcaggggcacctcttgtctcattcacagccattccctagtgcctagcacagggtcttaggccctggttcctgcacacagctcctcagacctcgggaatctgcagtaatatgagtgtcttatatgccaatgagaggactaggggctgggggccccaggcagcttcaggatggggactagttggccagaaagccaaggcaggactagagggttgggactttcagtcccaccctagcctccgagagggcagagggcctagagagaggtcaccggtggccagtgacttaatcagtcacacctacataatgaaaccttaataatgcctaaagacagggcttccaggggccaggcacagtggctcacgcctgtaatcccagctctttggggggccaaggcaggtggatcccgaggtcaggagtttgagaccagcctggctaatatggtgaaaccccgtctctactaaaaatacaaaaattagccaggcatggtggcgcatgcctgtagtcccagttactcaggaggctgaggcagaagaatcgcttgaacccaggaggcgaaggtacagtgagccgagatcgcgtcactgcagtctagcttgggtgacagagcaagactccatctcaaaaaaaataaaaaaaatagacgggccttccgggttggtgagcacatcaaggtgctgggagggttactgcatggaagctccaagtaccactacaccataccccatacccaccttgtgcattttttccgtttggctgttctgggttgtatcctttatgattagccaataatcgagaaaacagtgcctttctgagttctgtgagccatttcagcaacttaccaaatctgaggagaggccatcgggaacccctgaatttattgctgactggtcagaagtaccggtgacacactgggacttggaactgtcgtctgaaaggggggcagtcttgtgggactgagcccttgacccgtgggttctggtgctaactccaggtcgatgatctcagagttgagttgaatgtggagcacgcagctggtgtcggaggggtggtattgaaaaagacgtgcagtgtcagaaatgtaagaacagttcctaggcacacagaatatttgttgaatgggtggatggagatttgcacttcctatggttcacatttattacagacatgttactgttgcaatttttataaaagatgggcagttaccagaaaggaaatgtttaagttcccagattccacataggcagaataagaggatgttcacagctgacatggggcccacgcttgatgagaagcggcttccaatgctccaccttgcatgatgcgttgtgttcccaagtgaacacgtgtgattgaatgcatctgtgtatggtcttgctatgctgcaattatgagtgagaacagaattctcagatgtacaccttccatttctgttctacaaatgatctgtctgtggtgcttccgttttttttttttttctcccttttctcaagttagctgaggtgctttagtttcaaaaactatacagagagcagggagaaaggccaggggcatacagggcagatgaaatatgtcgtggcgacttgttcattaattctgtttcaggaaagagaataatcagtgttttgaaaactataaactattctaaaaatcatcagtaggaagcagccttttaaaaatttttttttccttattacaaaactaatacttgtctatgtcaggaaaactagaccctatagatgaaaggaaataaagtcatttcagttctgccatctagaaataatcactattggccgggcatggtggctcatgcctgtaatcccagcactttgggaggccaacgctgggggatcacaggtcaggagttcaagaccagcctggccaacatgatgaaatcccatctctactaaaaatacaaaaattagccaggcacggtggcaggagcctgtaatcccagctacttgagaggctgaggcaggagaattgcttgaaccagggtggcagaggttgcagttagctgagatcaagccactgcaccccagcctgggtgacagagtgagacgtcgtctcaaaaaaaacaacaaacaaaaactacaaaagttagccaggtgtggtggcacgcccctgtagtcctggctattcaggaggctgaggcagtagagtcgcttgaacccaggagacggaggttgcagtgagccgagactgcaccactgcactccaacctggacgacagagcgagactccatctcaaaaaaggaaataatcactattaatacagtgctgcagagccctttaggtggtggtgtgtgtgtgaacataaatagaagtgggggctgggcacggtggctcacgcccataatcccagcactttgggaggccagggtgggtggattgcctgaggtcaggggtttgagatcagcctggccgacatactgaaaccccgtctctactaaaaatacaaaaaattagctgagcgtggtggtgggcgcctgtaatcccagctacttgggaggctgagacaggagaatcacttgaacccgggaggaggaggttgcagtgagccaagatcgtgccattgcactccagcctgggcaacaagagtgaaactccatctcaaaaaaaaaaaaaaaaattagacgggtatggtggcgcatgcctgtcgtcccagctactcaggaggtggaggcaggagaatcacttgaaccttggaggcggaggctgcagtgagccgggagtgcgccacggcacttcagcctgggcgacagagcgagactctgtctcaaaagagaaaagtgtaagtgagattgtggtgcatgttctgttttttagccctttattcattacgtgaacatctttgcatcacattaacctaccttacttttcatgactaaaaaatatttcattcactgaatgttccaccacgtattaaaccaaaaacctcatttttggacctttagctttaattctttgctgtgcaaacatttggcttcaatattggggtatatttgtaattatttatttaacagcttcttttaaaatatgctctcaaggtgatactttactaacattgtaatttctcagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtgagcgtgctttcattgttatgaccacgtcagctcccagtcatggtgacgtaggctttgtcagtacgagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcgggagtttcttcctgttgtttgctttgcttttgcctccatgtcctccttttactcctgagccgcctcctggattcctgctgttgcatgtcaggtcttcaggatctgtcttcccagtctttctttttgttttttgttttttatttttctctgtgtttgtgatatcttgccctttgctcttttatcccccttgcaatttatctacagaattgcatatttgggaaccccctcttttaggtctggcagatcttttgtgatagagaaacagaattttaagtgctgtgatcctttggttgaagctgtccctggctcctctggctgtggatcttgaccagcagctttggctgtgcactgtgggtcctccctttttcttttcctttgctgcatatgacagtgcagctctatggagggagctcatctgcgaaagggacagacacagcattatctgcccggtgggccagagagaccagccagatgccagtcaggagggatcctgtccctcttgctcctggcatccaccatcctcagggccccaggcacctgggcttaccttcccctccgggactcctgcccactcactgcctctcgccacccacagtctcctggtgcccagggccacttggcccacaggggatgatggacgtggattttaggtgggaagactaatgcgattaggctgccggcttcccagagccatagtcgtaggtgtgatttctcactgcctttcgttcagagttgatgaagtattttttctacttcttgggagttttggtttattgctttgtttataaaatttatatatgattatcaaatccatgattgtgaagcactgtgatgatgttaccggtgttgttactgtgacagttgatgacacagcaggacctactgccacgtgtctgctgtgaattcatacttggttacagatccttatggtccccaacagccctggcaaatgagcgaagcagccatttatttactattcatttaatattctgataaatgcataaagataattaatctgccattattaaatgtcagttaattttactctgcacatcatgatggatgtgcacctgggctcccaggacagccactggaccactttagtctcagtcattttatctgtagaaaagaaggtttattttattttgttttattattttattttattttaattttatttttgagacaaagtctcgccctgtcgcccaggctggagtgcagtggcacgatctcggctcactgcaacctccgcctcccaggtttaagcaattctgcttcagcctcccaagtagctgggattacaggcacccgccaccatgcctggctaatttttgttttttttttgtttttttgaaacggagttttcctcttgcccaggttggagtgcaatggtgcgatctcagctcaccacaacctctgcctcctgggttcgtgcaattctcctgcctcagcctcctgagtagctggaattacaggcatgcccctccatgcctggctaattttgtattttaagtagagacagggtttctccatgttggtcaggctggtctcgaactcctgattttaggagatctgcctgccttggtctcccaaagtgctgggattacaggtgtgagccgctgtgcctggcctaatttttgtatttgtagtagagacaggatttcatcatgttggccaggctgctctcaatctcctgacctcaaatgatctgcctgcccctggcgtcccagagtgctgggattacaggcacatgccaccacacctggctaatttttgtattttcagtagagagggggcttcaccatgttgaccaggctggtctccaactcctggcctcaggtgatcccacccaccttggcgtcccaaagtgctgggatttacaggcgtgagacaccatgcctggtcaaaagaaggtatttactttggagggttattgagaattagaaaatatgtataaaaagtaccttagcatggccaggcacggtggctcacacctgtaatcccagcactttgggaggccaagatgggcatatcataaggtcaggagatcgagaccatcctaactaacacagtgaaaccccgtctctactaaaaatacacaaaaaattagccgggcgtggtcgcgggcacctgtagtcccagctactcgggaggctgaggcaggaggatggtgtgaacccaggaggcggagctttcagtgagctgagatcccgccattttactccagcctgggcaacagagcgagactccatctcagaaaaaaaaaaaaaaagtaccttagtataaggcatattgcctatctgtcactcaactgaaatgacagatactattactatgatttattcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtcttggggaacgcagtgctttgagcattttcaagagcagtttttcctgaaagtcagatcccagagtgagactagtcatcatcttttctcagataatcaaattatttttcaccaggaaaaagaaagattttatttagtataaaactagcacgtttatatgattcacttgagaataagattattaaatttacccttgagacaggaaggaaagttttaatgatatttcatggaggtttcttccacattattaacaacattctgattattggtgaatattcccatggctcacaaacacctgtaagttagatctgcacggacggtgagcacaggactgtggttacccccttagccaagcaaacaacttttttttttcaggagctaatttttgttcaggttgcattttcccagcgcagcactacagatggcatcacctttctgacagcaccaggccccaccctggcctcctagcaaactgagggctgcctagggttccagttcccactcacctccctccccatgtctaacccctggcagccactgtctgttctctgcctctgtgattttgtcatttcaagaatgcttgataaatggaaacacacagtatgtgagctttgagagtggctttcttcactcagtctaattcctttcagatccttccaggttgttgtgtgtatgaacgatgttcactttgaaactgtttcagtgtagctgggcatggtggctcacacctataatcccagcactttgggaggctgaggcgggtggatcacctgaggtcaggagttcgagaccagcctggccaacatggcgaaaccctgtctctactaaaaatacaaaaaatagctgggcgtggtggcgcgcctgtaatcccagctactcaggaggctgaggcaggagaattgcttgaacctgggaggcggaggttgcagtgagccaagatgatgccattgcactccagcctaggcaagaaaagcaaaattacctctaaaaaaaaaaagtttcagtgaagtcaaggctgaaagccagaggagagccttcttgtcttcacccttgaatgaacacctctagaatactccagttctctggggttgcctggacctcggggtgcacaaagtacagccatgcgtctttttgatagggcgttgctcataggagtcctcagtcttcagttggcttattttagcagtggtgaatggcctggtgtttcccccgacctgaggtgggggagcatttgctcctgtgtttagcctcacagtgctgtggtgggaatgaggcgctgtgtgcaggagctactttcccgggagcctggcatttgtcatgtacttctaaggtcaggctccatgctccatctgtgtatacaggtattgccctggtaagaagcagaattgtcggcccggtgcggtggctcatgcctataatgccagcactttgggaggccaaggcgggtggaacacctgaggtcaggagttcgagaccagcctggccaacatagtgaaaccccatctctacggaaaatacaaaaattaagcgggcatggtgacacatgcctgtaatcccagctactcaggaggctgaggcagaagcatcacttgaacccaggaggcagaggttgcagcgagcccagattgcgccattgcactccagcctaggcaacaagagtgtaactttgtctcagaaaaaaaagaaaaacaaacagagctatgcgtgctggctccaggcagcctgtccaggggcctgctgagcctgttcccacccctcccattggtcaggttcataccaaggaaaagaaaattaagttaaaccccctggtggtaagcagatgtgggcttccacacacagtccaggaggaggtagaggtgagctggtgaatcctggagaaggagcgcatgagatgtacccacatggtcgtccttgcagcccacacttgggctcctggtggctgttggaggctaaggctgcagctctgcagggagaataggcagggagcgggaggcgcgtggagcaggaggctcacggaagctggaagccgccttcctcctctgccaccccttcagtgctggggcagggctggtggccccatcaggaggaattgtgctgctgtcgctgctgacactagccttcagggccactctatgcttccctggctgttgccttcttcaggccctcaacagctgcccttcatggacttcatgggtcatttttattgcttcacctccaggagtttaataaaatgatggggtgatgtcttctaaaaagggaccagttcagtctccctgctggtacatgctaggcagggataagccccatggaaattgcttactactcacgttaataagttttagttggcagatctgaaaccatctgtgagggtccacatctcattttgttcacttcccaactcagagggggacgtcatgattgtactgttcccacagattacatgttcttgtttgagcaataacatttgcccagataaccagtgtttacatggcttttttaattgccttagaatgcctggtttctgagatagtgctgtgaaaaaagggctgatttttagctgcctagttgattttctttggacaattcatatcatcaagttctagaaatatagggagatattgacccttctgtgttgctacctcttggaagagtaacatgccctcttatcctggcaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaagtactgaaatattctttgaatctgtgtcagggaaattctgatttgttagttcaaatgcctgacagcataatcatacagatcttctcttgtcttggtttggatgacagtgagcagctgtcagaaacgtgcaaaaaattccaaaaggtaaggccttaaaatattttactggtaaatattacacagactttcaaaaggacagagaatgacttggaaaatcttttttttttttcttggagatggagtctcgctctgtcacccacgctggagtgcagtggcgtgatctcagctcaccgaaactcacgcctcctgggttcaagcaattctcctacctcagcttccagagtagctgggattgcaggtgtgcgccaccacacctggctaatttttcttaaacaaacactgtctacatctgccctatcagagcaagagagaaagacaaaacactaggttatgacaagcaaactcacccacccactctttaaaaaaaaaaaaaattcagggccaggcatggtggttcacgcctgtaataccagcactttgggaggtcgaggagggcagatcacgaggtcaggagatcgagactatcctggctaacacggtgaaaccccgtctctactaaaaataaaaaagtaaaataaaattagccgggtgcggtggcgggcgcctgtagtcccagctactcaggaggctgaggcaggagaatgaacctgggaggcggagcttacagtgagccaagatcgtgtcactgcactccagcctgggcaaaagtgcaagactccgtctcaaaaaaaaaagaatactaaacacaattcagaagagccacccagagggagacaacaatgtcacaactacttgtgccacacacacagactgtgctcttgtctattggttctacttgacatcaaagggaggctagttgtttgtttcatcaatgaaccacagctgcaggtggatttccacaccaggatgaatgaagactcagacatcaccttccatttccaagtgttctttggccgttgtgtggtcatgaacagcgtgagaatggggcctggaagcctgagatgaaatccaaaaatatgccctttcagaatggcaaagaatttgacctgagcatcttggtgctggacagtaagtaccaggtaatggtcgatggccaatgcttttagagctttgaccatcgaatcccgcctgagtctgtgaagatggtgcaagtgtggagagatgtctccctgaccaaagtgagtgcctgcaattgagggtgataaccagacttcctgttgacaaag

SEQ ID NO: 13056 - DNA, 16134 bp, Human
catgtatatataagtacaaattttcccaaggagcaatggttcagtgtttgccaattcattgtttgtggagattttatagaacataatatcactaataacaagaatcaactggctgggcgtggtggctcatgcctgtaatcccagcacttcggaagggcgaggagggtgaatcattttgaggtcaggagttcaagaccagcctagccaacatggtgaaaccccatctctactaaaaatacaaaattggctggatgcggtggcatgtgcctgtaatcccagctactcaggaggctgaggcaggagaattgcttgaacccgggagatgaaggttgcagtgtgctgagatcgcaccgctgcagcactgcactccagcctgggagacagcatgagactccgtcaaaaaaaagaaaaaaaaaaaaaaggaatcaactataacaagatatgtatgtgtatatctggagagtttctttttatgcatgaatgcacaggtctatatctattccctttttttggcattataaatggatacatactgtaccttgctttgtaacctgtgtttttcatctaataatatgctatcaacattttctattactgtgaaatattgttttatagcatgattcgtgacattcaggaaatatgttttgagcacatactgtattgccactaggtggggagacagacatgaaacaatcgcccaattacaattggctgactacaatttttttttttttttttgaggcaaaatcttgctttgttgcccaagctggagtgcagtggcatgatctcggcttactacaacctccatctcctaggttcaagcgattctcctgcctcagcctcccgagtagctggaattataggtgcctgctgccatgcccggctaattttcacatttttaatagagatggggtggatttcaccatgttggtcaggctggttttgaactcctgacctcaagcaatccccccacctcggcctcccaaagtgctgggattataggtgtgagccaccctggcctgattacaaatttgataagatctgcaaaggagaagtacaggttcctatgagagtgtataatgggaaaatctaacctcttttgggatcctcagaggaggcctatggggtatttgcatttaagctgggaactgcaggatgtcagtgtagagtgggcaagagtggtggaggctgggagtgtgtagattacccactttcctactgacccttgcttggtgagcattgaataaaaccaagctttgaaggaaccgttgaataattttttcacagttcttggatataggctagtctttgtatatatctttaattccttaggattagccattccagaagtagaattacttgggcagatggttagcacatattttgaggtttctatgagatattgttcaaatggtgtactcatttcttctactttcagtgacataggaaattattattttaatgtttgctttagtcagttttttttttttttttttgagacaagagtctcactgtcgcccaggttggagtgcagtggcgcaatctcggctcactgcaggctccgccccccggggttcacgccattctcctgtctcatcctccagagtagctgggactacaggcgcccgccacgtcgcccggctaattttttgtattgttagtagagatggggtttcactgtgttagccaggatggtctcgatctcctgacctcgtgatccgcccgcctcggcctcccaaagtactgggattacaggcgtgagccaccgtgcccggccgtttagtcagttttaagacacagatatagcctattattttatttactgcttccatattgcttatcttgttttagaatatttagataacctttgtacttttaaagtgttacaaagagtacctttttacactggaaaataacttcattagatacaaagaagctaaatgtatacaactattagaaaaatatctctagtggtatatagaagataattatgttataattatctagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggtaggtcttattttttttcttctttcttgaactcttttaagggttcatgttttaaaactttttgagtattctatttatctttttgagtattctatttaaaaaaaaacagagttagcaatgagataatttaaattagatttcattttaaagacttaaatttttacattaagaaaaaaacctgtgtgtgtgtgtgtgtgtgtgtgtgtgtgtgtttatagtcatgataagtaagaattagtcctgaagttcaagaccagctggacaacatagtgagaccccatctctaaacaaaaacaaaaacaaactgggtttaagtgcaagcctattaccctgggcaggttacttaacctaagtctcagattttatggatgttctgaggagtaattaagccaatgcaggcctggcctatagtaagtgctcaatgaatggctactgttattagtattattttaataagttattaaaatgttattttaattaaaataaatttttattattagaaagtcatggttaaagggtttttaacttgatttgtagactagaaaagtattgttcatttactcttttattgtttaggttattcaccagcacctccaacctgctttattctgtgtggtaatttttcatctgcaccatatggaaaaaatcaagttcaagctttgaaaggtattaacgatctatttaataagaagtgtttctatagtcatataaactaaagtaataagaaattatccataatattttaattaagaatatacaggattgtatctaatcaaatataattttatggcattatatgcaaatttaattcaatacctttttaaaattttagattccctaaaaactttggcagatataatatgtgaatacccagatattcaccaaaggtaatgatctctagcactatatattttttcaccgttttacttaaaaaaaaaacaaaaaatgaattttgttatatcagcaattattacaaaactaaggaagaaagataaagttgagaaaattaaaagaactaagagataaagttatcctcacattgtactagaggtttataatgaaaagtattgaaagggatagaggtaatttcagccatacttggaatttcttcgtggcattactcttaagagtctagagcttcactctccgatatgatagtcactggccacatgtctctttaaatctaagtttaattaaatttaaatataaaattcagtccatcagctatgctagccacaattcaagtgttcaattgggcagtgcagatatagaacttttctatcatgacattactagacagtgttggtctggagacttaatagttcatttattataatgcatgaaatttaaatgttttttaattttaaagagaaaacaaagggaataacttgcttttaagctattggatagtgttacaataatatttttaaatgaattgtgttgaattttgctacagtagtcgttttgtgtttgtacctggtccagaggatcctggatttggttccatcttaccaaggtaagttttgttcagatttttgcaacagtgtagaaaattttgtaaaacttaaaaagataaactatatcacataaattgtttttataggccaccacttgctgaaagcatcactaatgaattcagacaaagggtaccattttcagtttttactactaatccttgcaggtaagaattagtattttgtgttatacatttttcctttcatttaaaaattagccaggtgtggtggctcatgtctgtaatctcagcactttgggaggccgaggcaggcaggttgcttggagttccgagaccagctttggcaacacagtgaaacccatctctacaaaaagtacaaaaattagctgggcttggtggcacgcgcctgtggttctactgaagaggctgagatgggaggatcacttgagcctggtaggtggagaggttgctgtgagctgagaatgcactactgcattccagcctgcagcctgggcgacagagcaagaccctgtctcaaaaaaacaaaaaacaaaaaaacaaaaaaaacaaaaaacaaaaaaactaacttgattcctaaaatgtgtctctgaatttcgactgttatggaataaatataagaagaaaatttatttttgttttaggtttctcaaaactttgaaaatagtttaactatatttaaataatttattggtagtcaattcagactcttgaataatggatagcagtttaaaaatagatattattactacatatcctttaagaaaggttacaaaggaagaatacaaagattacttatttactgttcgtattgctcattgtaatcataagttcttcctgtgggaataccatcagaggcagccttggttcgcctcttttctgcctacattcactcctttgctggccttctccagtgtcctctggctttaagtatcatctgtgtattgacaccttccacatttatatttccacttcaacctaccttccaaactccagactcaggtatccagttgcctacttatcaccatcccaacctaagtgaactcctgatcttcctccccacgagtgtccctaacctcttctgtagacttctccatgttagttcatgacaccttcatggtctgaacaatgattattccagttgttcaggccaaacactttggggtttctctcacatgttttttcaggaagtcccattaacttcaaattatatccagaatctgctctctctctatacctctacctccacaaccctctaccacagtggtccccaacctttttggcaccagggactgatcttatgggagacagacgccagggggggtgggggtgattttgggatgattcaagcgtattacacttattgtgcactttatttctattattattacattataatatataataaaacaattatacaacttaccataatatagaatcagtaggagccctaagcttgttttcctgaaaccagacggtcccatctggggatgatgggagacagtgacagatcatcagacattagattcttataacgagtgtgcagcctagatcactcacgtgtacagttcacaacaggattcgtgctcctgtgagaatctaatgcccctgctgatctgacaggaggcagaggtcaggatgtaatacaaccgatggggagtggctgtaaatacagatgaagctttgcttgcttgcagcctgctgctcacctcctgctgtgtggtccagttcctaacagaccatggactggtaccagtccatggcctggaggttgaggagccctgctctgccatcttctcggcctggattattacaatagcctcctaattggtctccagcttttactccttcccctccgtattctattcttaacgcagtgtgaaagtgatcctgtaaagcataaggcatatcccatccaccttcccgatcctggaaaaagggaccctcattggaaaaagggacccctcgtgatttagtgacagccgtatccttgcagtggtaatcaaggccctgtgttatctggctccgttacctctctgatttcctctcctccccatttactccagccacactagcctcccttctgttcctcaaggatgccaggcgagctccagtctgagggcctgggctccatctgttccctttgcctgcagtgcgcttcctctgggtatctgcttgactaagtccctcttccgcttcaagcctgtgctcaagtcacactaaattatgagcccggcctgttctgatcatcctattaatatgcccgccttctaggctctctcttaccacatatgctgtccctcttagcctgtctttttctttttctcttatgcttaattatcttaaaacatactatatgattatgttcgctttttattttctcagccccaccccctactagaatgtaaactgtatgagggctgggatcttttggttctgttcgctaatccctagaatggggtaggcatatattaagagctcaatacatagctgttaaatgaatagatgaatagacagactctggttgaagttttgtgtggtgaacagtgaatgtgggaatggggttgtattgtaagagattttacctttaaaattaatatcatttttttctgagaagtcaaattcaactactgttttcatttcagaattcagtactgtacacaggaaattactgtcttccgtgaagacttagtaaataaaatgtgcagaaactgcgtccgttttcctagcagcaatttggctattcctaatcacgtaagtgaaacaacttttttattaaactgccttacatgttgcattatataaaattttattaagccacttaataatttgtccttgggttaggacatttatttatggttcaaaatagtttgaacgtacttttgtcagtaagttaatttttgttagtgaagtcagtgtttctcagctttctacctaagtgtatgtcctttagaggacagagaaaagctgagaataagcatgaaatttctttcaagcttcgtgttttgccttttaaactcttaaattatacttgaaaatatatgtatatttgttttaataaactgttcttatttatcccattggttacatattttatatagtatgtccatatcacaagaatgtgcagtatttatcttgtagcttcgaggttccctgacaatagttgtcaatcacaggttacatacacccccatttgagaagtacggaaatagatgttacagagcatttttattattcattttataatatttaaagtttatggaccaggtgcagtggcttatgcctgtaatcccagcactttgggtggcttgcttgaggccaggagtttgagaccagcctgggcagcataatgatgtatatgttattaaatgaaaactcatagattttttttcctaaaatacagaatagtttatttcacttttaaattagtgtctcccaaagctctgtgagtcaaagctttcctagtttctcaaattttctggttccttttggtaattaatatttaatttgaaattatttgtttagctattttcacttttgcaaatgaactgaagtttgctttgttttgtgctcttttgtagtttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctgtaagaatgtagttaatcttatatagtcattatttatcaagattagagtgcattttttaatttaaaaatatatatttaataagattattgtcgaagtaaaaatatgctattagtgaaacactgaattaagtttctatacacagaaagttggtatacacagaaagttcttaaactttcagtatagtgactataaagtaacatgacttaaaaaacaaaaaaacaagcatacccacaagcataccaaaacataaatccaaaagagtaattttctcctcttcagaacttatcttgggattcctttctgggaattgcttcagagcctgcatattggtggtacttgtcctttgagaatgattttgatttttggaaattgcacaggtcccaaaaatctaagcctgattaatatagaaacctcattggtacatattttattacttaattttatgtagaaccttgaaattgcttcagaatcttgaggttgcttcagaatttctgcagaaatataattgacttttaggccaggtatggtggctcacacctgtaatcccagcactttgggaggccgaggtgggtggatcacgaggtcaggagttcaagaccagcctgaccaacatggtgaaaccccgtctctactaaaaattacaataattagctgggcgtggtggtgcgcgcctgtaatcccacctacttgggaggctgaggcaggagaattgcttgaaccagggaggcagaggttgcagtgagcggagatcacgccattgcactccagcctgggcgacagagcgagactccatctcaaaaaaaaagaaaagaaatataggccgggtgtggtggctcacgcctgtaatcccagcactttgggaggccaaggcgggcagatcacgaggtcaggagatcgagaccatcctggctaacatggtgcaaccccgtctctactaaaaacacaaaaaattagctgggcgaggtggcgggcgcctctagtcccagctactcgggaggctgaggtaggagaatggcgtgaacccgggagacagagcttgtagtgagccaagatcgcgccactgcactccagcctgggcagctgagcgagactgcgtctcaaaaaaaaaaaaaaaaaaaaaaagggaaagaaatataattgactttttgaacttggagaataaatactgcataaacaatgacataaacacagttatgtcaaacaaaatattatctccactagagatttttaatatgcatgcttccttgattcttgtgaattttagactttactaattttttgtttcatctgagtaatttctagaaacatcatgccttatttttggcatgatgctgggcctgtaatcccagcactttgggaggccgaggcaggaagatggcttgagtccaggagttcacaaccagcatgggcaacatagaaagggcctgtctctactttgctttcctcaaacacacagtttgtccagcttcttctaagacatggcttatcggccttggcacttttgacattttggaccaagtaatttttggtggtgggggctatcctgtgcattgtaagctgtttagcagcatccctggcctctgtccactaaatgccagtagtattccccagctgtaacaatcagaaatgtctccagacactggccaaatgtccccctgagggacaaaggaaccctggttaagagcctctgctttaagaatgaacacagttaactgatttggttttattgcttagaaatttatgacctgatttttattcacattgaaatagtctttcatggtgatgctatttccttacttaaactttgggcattctcctagttaatgctctatttgaatataccttatttctgaatttttctactttttcatccctgtgagtaaaccaccacctcctacaccatcattatatcttttttaccttatttataccttttgggcaagctcaaaactagccttagacattacttcatcctttcttgatatttattcacattaacgaatgcctgccataggctaggtgttgggttcggtgcttggggcacaaagactgaaaagacagggcctctgctcagccacgtgagagtttcatagtagacaaacaattgtatgtgtgattattgctcagttgctttacaggcacataggaagggaatcaaacaggtacataggaatgcaaatcagttttgcattagagagaggggcaggaaagacttcttgaacttgctgattgtctcacatgcatatttggcgttacacagtctgtttattttttacactaagtagagctcctcctaagcatttccaacctcatcttttagcattaagactgtctagccaactcaaaagacttttgcttcaagtggagatattttatagtaacaactctgtaaaaagatcgtgtaaaaatctgttgtgttactttatagtcacatcttgtcattttaagtcacaaccaaggacttttaaaaaacaggaattattttataaaacttgagtattcggctgggcacggtggctcatgcctgtaatcccagcactctgagaggccgaggtgagcagatcacctgtgcccaagagttcaagactagcctgggcaacacagtgaaaccctgtccctctttacaaaaaatacaaaaattagctaggcgtggtggcccatgcctgtggtcccagctacctgggaggctgagatgggaagatcgcttgaatcccggaaatggaggttgcagtgagattgccccactgcactccagcctgggtgatgagagtgagaccatgtctcaaaaaaaaaataaataaataaaataaaaaataaaaaatatacatattgtgtttaaaaaaatttattttaaaaaaagtctgagcattcacttacaggcatttttctcccccaaagggctcttttccaagaagtggattttcattcaaagttttttatccttctaataagacagtagaagataggtaagtgtgtgcacagacacagcaagaaagatctttctctaggtgttaaattactgaaaatgagatgttctatcagtgtgttgggatttttgaaaatgtctacagtggcccataaagaaatattattggctgagcttatcacggttatgctgtgtgacacagaattgtgggtacatgatggtacgtttgtgttgaaatagatcaagaactgttttctgggggaaatctcaggccagctgtggaggtgagctagttctcttacaggccaactcctgacgatggtctcactcttctgagaggtcagtcctgccctccgtatggttgcttcttaggtactttcccttaaattgacagtgagggagctgtgtgtgagtttggtgatggtatggggttggagttacggaaaggtcttgagaaagaagaaaataatcacctagtgggtagtagttttcacagggtgatctacatagatcacccacatcagaatcctctggggtccttgttaaaaatgttaagttaggattttgccccagactcatcaaatgactttctaattgtaaagaataggcattttaaatattatttcctgtaatttcaggcatcctaacatgtgatttctcagataactgtattttgaaaaagttcccaccactggttaagaacaagtgcccaggcagggcacggtggctcatgcctgtaatcccaggactttgggaggccgaggtgtgtggatcacgagctcaggagtttgagaccagcctgaccaacatggtgaaaccccgtctttattaaaaatacaaaaattacccgggtgtggtggcgtgtgcctgtaatcccagctactcaggagaaggaggctaaggcaggagaattgcttgaacctgagaggtacaggttgagtgagcagagatggcgccactgcactccagcctgggcaacagagtgagactctatctcaaaaaaaaaaaaaaaaaaaaaaaaaaaaaaaaaccaacaaaaaaacaactgaccaaatcaagtaactcccctccaggttattgtcagagaatataatcttgaacacagcccagttgtctttttctttttggaattaacatatttatttaaaataaaagtgaatataaaatgaataattttcaaaacatgcttataaatataaaattaaaaaggaggccagacgctgtggctcttttccagcccacttgtctacgctggatatcctgagggcacttgattttgtgaccccaggactaagtcaactctgagggctgtcagcctggagcatacagtcttatccactgttagaatgtcttttactgaaataacatttggcataaaacttgtagacataaaacagtctgcagccattcgtggtggctcacacctgtaatccagcactttgggaggccaaggcaggcagatgacttaagtcaggagtttaagaccagcctgggcaacatggcaaggcctgttctctacaaaaaaatacaaaaaattagctgggtgtggtggcccacacctgtagtcccaggtactggggagactgaggtgggaagatcacttgagctcacttgagctcgggagtcagaggttgcagtgaactgtgattggtccacactgcactccagcctgggtgacagctgtcaagtaccctgtctcatggtacttgcagttgatgctcactctttgtccactgaaatagttgcttcctttatctgctgtggcctcagatgctgaaagccttgacataatttccaaactataattttgtattggtaactggggaatcttttcaatgctagatcaaacaaactgatgtaagtttatgttttaggaaaacagaaaagtttcaagatatattgaaataatctggccttcttgccacttagtttctcctaagaagccttctgttagaatatttgtgaaatcatattgtggaattagtcacagaaatgtagtcaaagttgataaaattaaccctgtttaaacatgactttcaagtagttttatttaaaaacacaatattggtgatgttttggaggaaatacacattctcacatgtagttggtcagaatgaaaaatggcagaaacctttatggagggcaatttgacaagatttattaatgcctacaccaacaattccacttttaggaatttattctataggtatacttaagcctatgcatacaagtaggtacatcatgtataggtacagctggctttttactgcagtgtttttttttttttttgtgagacggagttttgctctgttgcccaggctagagtgcagcggcacagtctcggctcactgcaacctccatctcttgggttcaagcgattctcctgcctcagcctcccaagtagctgggatcacaggcacatgccaccacgcctggctgattttttgtatttttagtagagatggagtttcaccatgttggccaggctggtctcaaactcctgacctcaggtgatccaccggtcttggcctcccaaagtggctgggattacaggcatgagccactgcgcccagcctttttactgcagtttttataccaagaaattttaaaaatgtatatatatctaaatatttgtacttattcagaactttctgatttacttaaatttctaagcctcaaagaagtaaatataatgtatttactactaatggaaaaaaggtgtagaaagtatgcataatatcctatcacttctgtatgtttttaaagcataagcccacatatacatgtgcttatatatgattagaatactttttttttttttggagacggagttttgctcttgttgcccaggctggagtgcaatggcgcaatctcagctcactgcaacctccgccttctgggttcaagagattctcctgcctcaacctcccgagtagctgggattacaggcatgcgtcaccatacctggctaattttttatttttagtacagatggggtttctccaagttggtcaggctggtctcgaactcctgacctcaggtgatccacccgcctatgcctccaaaagtgctgggattataggcgtgagcaaccgcgcccggctactttttttaaaaattagtctacctttataaagaaaatatagttgttggcggggcgcggtggctcatgcctctaatcctagcactttttgggaggctgaggcgggtggatcacctgaggtcaggagttcaagaccagtctgtccaacatggtgaaacctcgtctctactaaaaatacaaaaattagccaggcatggtggcaagtgcctataatctcagctactcaggaggctgaggcaggagaatcactcgaacccaggaggcagaggttgcggtgaaccgagattacgccattgcactccagcctgggcaacagagtgagactccctctcgaaaaaaaaaaaaaaaaaaaagacatacatttgctttttgggagcagaaaagggggcatgagaatgacttattttttagagtctccttttgaatttgaaacagtatgtatgtattgacctgtttttaaaaatcaattaactatacctatttaaaaaaattaactacaactattagtaagtatacaacttaggtttccaaatatttaatttttttttctattttcagcaaacttcaaggcttttgagattcttaaagatcatctgaagaaaattcatcagttttctgcttaactctatatcttatgtgattctgatattacaataaaattatggtaaactttaggatgttctgcttaaatttgtattttgtgaaattttgatactaagtgataaatatgatggtatacttgagaaagttttctaggaaaaatattttctgcatagtcttttaagaaaaatatatgggggccaggcgcagtggctcacgcctgtaatcctagtgctttgggaggccaaggcgggtggatcacctgaggtcaggagttcgagaccagcctagccaaggtagcaaaaccctatctctgctaaaaaaaaaaatacaaaaattagctgggcatggtggcgggcgcctgtaatcccagcttctcgggaggctgaggcagggagaatcacttgaacctgggaggcggaggttgcggtgagccaagattgtgccattgtactccagcctgggtgacagagcgagactctgtcaaaaaaagagaaagaaataaaaatatgtggatatgtatatactttttttttttttttttttggagacagagtctagctctgtcacccaggctagagtgcagggagaatcgcttgaacctgggaggcagaagttgcagtgagccgagatcgcgccactgcactccagcctgggcgacagagagactccatctcaaaaaaaaagacaaaaaaccccccaaaatacaataattagtcgggtgtagtcccagctacttgggaggctgagatgaaagaatcgcttgagcctgggaggcagaggttgcagtgagctgagatcaggccactgcactccagcctgggcgacacagtgagactctttcaaaaaaaaaaaaaaaattacgaagagcctggactggaagacattgctttcaaagagaattagcttttgagagaaaaggtactaataaaaaaatataaaaatgacacagtgaaagggaaattcctcaaggaaatttaatatgaatgcagtgataagttaatttagcagcaaagagaacatgacaatctgatatgtggtttggggatggaaaattggaagaatgttagaaggggcctaatgttagaagagcaaggtttaactttaatttcaagaataacctggtaaaatcaaagtttaaagatgaaatcaagacataaatttaaacagtttgggcctagaaagtggcagtaaaatagacatgcaaggctgctggtgcagttatgagactcacagagctaaatatgaatgatgatgggcagaagtttataaatggaaattgaaatcaaggtgtcctctcattcagtggatacataattgcttctataattaaagcagaggtattttgagatcttttcaagaacacagtgaaagtagggtgcatttaggggttaaacaagatgaagtgaagtgaaacaaggcagtgtaaattgccagaagcaggccatcaatattagaataaggtaaggcaggaactagaaccaggtgaggatcaacatcgtccagagatggaaaagaaagccaaggtctgtaagataggacagcagaggagccggtgtgaaagagtggactttgctttagtaaagaacagagacagtgtgttcccagctgggtgttcccaactgggtgtttaatcagctgaagcccggctgatctcactgctgcaatctgtttacgaggcaccattaagtgaaggtgcacctcaaagcaggagccagattgttaacacacagagatagtggtaagatttctctactataaaaaaagcaaacacgtggtttctgtagggaaaccacagaatgccagagactggacagaccgaatgaagcattcttcagccaggggcagccatgcaggaaaccaggcctatggggccattttagagaaatctggatttttcggtacaatatcctgacttcgcaagcactaatttaaactgcagtttgcaaccaagaagacatgcttacagattggattgtgctcatgaactgttttccctgccttacaggcataggaatttgattttgtagtccataagagatccttattaagcaaaatcaggtgagccccagtc

SEQ ID NO: 13057 - DNA, 17479 bp, Human
tgtggtgtgcctgcgcggttggggtgtgtagatgtggacccttcgaggcccttctgcgttttcttcgttgcgtacgattgtgctccgttggtgttctcagcagggatctgattctgtgtgtgggggtgtgtggcccctgcgactgtgtttgggtggtgtcgtcgttatgtcgggcgtgtgtgatcccgactgtgctggattgtgtgtccgtgagccgctgcgtttgactgatttcgttgtgtcctgttgggcagtgtgcggggctgaccaagtcggcttctggggcagtgctaggtggtgtttgtttgctgcccttctgtggggctggaccctgtgtggtcctgtccgcactgagttgtatgcctgtgtgcctgtgtcctttagaggtgcgtttgcaaatcgctgggggcgggagtggggggagggcgagcgagagatcgaggcgctggtgggggcggcggcatgggggcggggagcgggatttcacattttattccaaattatgatgtattcgggagccagttgttggcttgggtgggcggacagcgcccggtcggcggctgctctgcccggaggcccgcctgtgcctaggtgtttgaggggttcgttggtgagtgggaggctcctccaggcttgaagctgagcagcgctcgccgaggccggcgccttcgagccggtagctgcgggcttcggttcccgctgcactccggcttcatccatttctggtcagtttcgtgggtgcggccgccgggctccaagggagaggccccgaaaggacaatgggcacattcaccaggcctcgagcctcgggtggggacattcgggatcacctcctgggaagattttcccgccccctcttcgggtgagcgacgttgccgcttgggtctgatacccgtcgcatccgagaccgaggccgaatccgggctctgggagggaccgggttagtggggccctagctcgggttgaaagaattttgttttgtcaattattgtaattgctaatgccatcaccatcacaatcgtcatcattaacatctattttaattaaaataatcatcccagagcgcagcagtttgtcccttttggctcctttggcgggagaacaaagcagcgggtttttttccgctacagccgttttctaagttgctgggtttgaggtaggaagagaaaatggagagaggcacggacacagagacttggtcataaggcaaacattaacccccagcgaacacgcaacattaaccccccgcgaacacgccgggaatggatggattcccctcttctttcctcccctcccctcttttggattagaagaggagaaagaaaatcttccgcattgtattgcaatccagggaagaattattcctatatgtccaccaaagccgcggcaaatagaaggaggccttcgcagttaatccaagacttcgatgtgtgatcataagcctgacgatttaggcaaaacaaattaaacaaaatccactaggaaaaaataaaagcaagctcaatcctgctacatccttgaaagtagtgtcgggtttgtttttacctcctttccttttaccttgtttattgctgtaacaaatcattagaattctcccttactctgtctaaaccccgaaaaatcgaaaatcatttcgtaggggtggtggaggggaaggtgggggacttttcccctttgtttctttctttccccctttgttggtctttatttccttttctttttctgtctctctcttcctctctctttcttctttctcttaatcagtagggagacgagaaaggacctgaacagatcagatatctctctccaagcccccttcccaactccatttctgtaggaaagtacagcccctggaattgggttctggtttcgctttgggctggaggtgggtggatgggggtcagagagagaatgaggtgggggggacttcaaggttctgtcccaccgaccagagtctgaagactattcgcctttcccaacacggacctccgcccatccaggcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggtgagttttcaggggaatggtgccggtggaaacggtgtctaggaaggccttgtgttccggcctggggtgaggaaggctcaggacagaggagagcccattctcagattgggggtggggggaggggaggaccagccagagcttggaatcgggatctgactgctgtagctgcctctgtggcattcagcggctttttcccttttccacccagggtaaaaccagctagttggacttagtcgtccaggcctttcccattggtcccggttctgtggacgtttcccaaggccggtaactttggggcggctgtatccgggtggtacagactgtgcctggagctcccgcaggaggaaggcggcagccttcctggctagtgcagtcccagctcgagtgggccctgatcccaggcctgaggcctagggtggggaggcaggaacacccctcttctccggtagaggcgaggatggtggtgctgttccctggtgggtttggtacttgtgcaggcttggggcttctccagggtgttgtgctggtgtgggcccagaagagagaccagaggctgggtctaagggcctgaggctgttttcatctaagaaattctctgtatgggggattgggtctgcttgagacctgtccccaggaagaatctcctggggtcttctgtcttgttctggcacaggtggaaatattctggctgtctggcaactgcagatgaggatttcctgttgggggctataagcagggtctccgtagtacaaagagagaggagctgtagtcgtcaaatactctagaacgattcagtctaaaatctccctcctccttcattctccccaaataaaaacaaacaaaatctctcgggcgttcctttctgtaatccaaatcaagtgatgcagcttagtcgccaacaaccatcagtgtttgtgagtggcttctttggggcatggacctctggctggtaatcctaaaccggcaggattttcctaaaatgtggggaggagccgggagaggtcctccacagatcctgggatccaatcatatatttcttacaaggaaccttggcgatgggatatttataggtgtctggagaggacatttgtggccagggtcaattcatctggaatatgtactcccattgcctctcaggaatccaccgctagagcaggagcctaagaattaattggagggtaaaaatgtgtcataacagagcttgagctcagtctgcaactgcagtgcacactgtcactcggttagaagctggggcttaagcatggatcactgggctcacaccggtgtgtcaggacggagagcagtgaggtagggaaccaataccttgaagcttgtatgtttcccaggggttggtatatttctggcacatttcgctgctgctgggagcaagaggacctggctgatatacttctggtgcatttccagtggccttggtgtcttggtggttgcattctatggatagagacctattgtctccaccaaaatcataaactcacttccaatgaagtgtcagggacctactgcctttacagcttgtatacaccaggacttagggaattttgtggtttctgtgccagacctggggggctggcattcccaaagaaggtgtacagcagtctgaatcttgactctctgtcatcctgggtgtctagtggcaattgagccaagctccagaggaggctgcagatgatccattctcccttctggggtgggagggatggttcctaggatgactcctgtccagagcattgcagtggcagtatgggagctcaatggctgctatgtatgatttagatggactctgcatgggggtaaattgtttttttgtatttgttttcttcttttaaatacccaattatataattcagagagcagaaagcttattttaaacaacttatgtggtgttgatcatatatgtacaactcacaactcacaaactctggcccttgagtctcctgatttttctgttttggttcttgctggtgcccagctctatctggatgaagccaggtgatggaagagccccagcacacctgtgggaagtagagtggctgtggtcatctcggagtatgcttgtgggggcacaaggtggtttcactgctctgggaatacaggagggttgagcaaagtgagattattgctctggtctggctctctcacagataggctgtgagtgacttgacattcggccaggcagttttctcactggcccattctccttgttaataatgtttacttgaacgtttgcacagcactttcaaatgcataaaggaggtattcctcccatttcccaaagaacaccaaggcaggagatggcggtgaggggggctggaagagttcaagggcctcatgacatcctgtcctgctcttggatgggagtccagaccccactggcctcagggaacccttcaaatgcccagctccattctacctcagccaggcctctctttgagactcgacctcacttcagagtccagctgagcagaacgaggtggactgtgcagggaggttgggccagcaccatcttcttcccttggcgacctctcatctctgtctgagtgggagtaaagatccgctgggcgggcagaggactcacagtggatttgctcagtgtagacagacactccctcactccccagcgggggcgaatgtgtgtgtgtgtgtgtgtggagggagctggttcctcgggattattctctgccagctctggcggagtggatcccagtccccgtagcctccactttctaattccctacttccatccgcaccgggtttctgggtgtgtgcctgtaggtgggctgggaatattgctgagaggccaagggaggttcctaaagcaacgaacccctgcctgacagattccccgctaaaaccaaagagcacgatccggaatttgttccctcctcttccctttaggcctgagaaaggggacagagtaatctctttcttgcctccttgtacatttccttcctcctgatttccccttctgtgtttctgtcgctggctgtattccttttcttccggtgtctctgtcgtcttcctccatctctgtccttttggccctcagtctctgtgtctcccaggcacccctcccttctcccaatccagagaccctctttccctcccaccctagccccaaccggcctcccgccctagccccacgtggcgctaactttgtctgcctcttctcacgtctcggtgcgtgagttcctctctctgcccttctcccctttaccccagcccacgtcggtgggtcaggggcggtcgtcagagcgggcatccgcttgtctgtctgtctgcccacaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcaggtcaggggccaggggccaggggccaggggctgggcgggtgggcagggcgaccacccccaccggggtttccttctacacatcggcggcggcctgccctgggggccgagcgggtggagcgcagggagaggaggtcgttttaaacccagtggctctagagcctcaagctggagcccccgagtgagtgccagtgagggaggggccttctgtgagagagagtgtgcgtgtggctgcggggtgcatggctgtgtggaagccgagaggaggacgtggacaccttcgcgggtgcaggcatgtggctggtgtgcttggtggtggtgtcgtgggggacggagaggaaggagtcccctgagcgtgggtaccaggaaagagtgtgcctgcatgtgctttgctgtgagcagaggtagatgtttgtggtgtgaaattcattcggaaactcagcgctagctggacaggcaagagataaggatctgagggtggtggcagaggcaccctcccccgaatctctgctggagggcccgcctgaggactgacctgtccctccactcccagcccctctgctcctagccgtggtctctggccccagcctgtactccggttggtgtcagggcatccgtttccctgctggcgctactgtgatgatgagggagagaagccatagggttggaatagaaaccggcagatggggcagggatagagtgtggggcagtcaatgaacctggcgggcacccgagacagagctatggggagcttagggtgggtgagggcagagagctaggcggagcatttcagctgaggggagtcagggtttcctgtctgttgtgtatctacagccccttatgggtggggtgaggtggggagaggggacagtgtgcccctttgtggtgaccaagatgcacaccatcaggtgtgaaggttacatttgcctgagtgggcatgtgtttgggagtggaggtgtgtgtggattatgtgcttgtttctggggcgggagaatggagagtgtttctatctgtgaagtgtgtgtgtgtgtgtgtgtgtgttcatttttgtgtttattccatgtgttattcacctctgcttctgcatatgtgcctgtgtttgtgtggagggatgtgtggttaggtgtcttttcctccctttgcttgttttatgacagacagagtgagggcattccgtgtgtatgtgtgtgtgtgtgtctgtgtgtgcctattcccagctcaagtgtgaagggaccagggttgcccagaggtggggggctcaagacatgtggggaggatccctaaggaagctctttctcccctcccctcaacatgggatcttgtgatctgcccgttccctcccacagcgggttctttggggagccggatgccttccctatgttcaccaccaacaatcgagtgaagaggagaccttccccctatgagatggagattactgatggtgagtctgccccaccccaccgttgtacctgcccctcacgctggttagagccctctggaggagggaacatctgggactactccgtaggtatctcacaaagatgggcgggccactttccaaacccaaactgccgaagcccttcaccctgcagctgagctagggctaagtaaagtcctggatggggctagcaggaccacactcacagtcctgcaaagaggaggcatgggagagagacacataatggcgcttagcccaaacctctggagttagttcccaaacctttggagttagttccagtccccagtccgggctccattcctacactttggcaaggatcccaagtgggcgcagaatcacacagtgtcccccgatcccccattctaggcactgaccctcagggattccctgcacttcctcccaagtcttccttagagtctggagtctgcttcctccctgcaatggagtcatcaagggttttctccgaggtccctacacagtaggctccccttgtctcccgttaacacattctgggcttagacctggagttcccttcctgacatcatggattctaccttgccccctggattccccgagaagggccttggcactgctcctttgaggtacttgaatattccctgaacttgcaggggtggtttggacaaatgggagatttggaagaccctcgccatctttccaaggttgaccttgtatagtagattggtcccagcaccaggggtaggagagcaggcacttcagagctgagggactttgagccagacccagatgcccccagaacttcagcttggctgtggcctggggctcctgtaggaaggctgcccaaggcctcagagcaaggctgggatttatgctccaaactggtgggaggaatatgagtatggagctggagcctctggagtggagccctctgtggtgttctggagaggagcggggctgggatctgcacaacagaaaagacttcaaaagacccaagcagcctggggcacaggtgtgcagggctgagaggcaggggtgccttctgctagattagagaggagttctctagtctaagagaggtgggtgtaccaaacaggaagaagacaggaccagccctgaagttccccagggatgaggcattttctacaataggcagaagaggcagagcataggggcgagggtttgtggggtgtgcaggagtgtagggcagtcattatccataagtgttggcaatatttaccgagcacctactcagtgctggccagagagaggcagaggacaccaggaggggtagacagactcaggaaagaggaaggtgaggagagggggtggttctctggaataaaaccagagaggaataggcagacatgtaggcgaagggtagggtatgagtgtgcaggatgtgtctaggggacactgaaattagagattgaacccaaaaagagtccatagaagtagaactaatgcaagatctagagttaggacttgatgtggattcctgttgctgaattgctactaccatgtattggacacctactatgtgccatggactatgtgtgcttgatttctgtttattccttaccacaagctcatgagggcaatattattgtttacatctcacagataaggaaattgaggctgagagaggttacccagcttgatcaaggtcacacagctaagtcctgggtcacacagctaagtcctggaccaccctcataacactggtcttaagctttggaataagtcctgaccacttccccaccatctccccttctggatgtagtctagctccagctgtgacagcagtcataagtaccccctccccaactaggagctccctcaagatcaccagcattagccatggtggagggactgtcctccctatgtcactgctgagggatgctctctgtctggcctggaggcctgaaagcagcaagtaatttcctcagaggccgcccagggtagaactgccctgcagttgtgctgtgtttttcccaggctgggtctggcctttggcaaacagtcagctgggctagggcctgctatggtttggaaaggcagcttcagaggtaccatgggcaggggatggtgatccttcccattaaaagtgtgtgtgtgtgaacacccacacatgcatgtgcatgcctgtgtgcgtgtaggagagagaaagagatgatcaggcagtaagtgtggcatggatgagctgattcacagactgaccactgaggtgaggtctgcttccatcccagcctcagtctccttagctataaaatgggcagtgggacttaggtgaggtcttagctcttctcctctacctcggttttcacactctgaggtctggttccaggggttactagaagagggaaaataaatatcctaggactggcagttccttcagtgctcagagcttcctggactatgtgaccctggcttgtgcctcgatgttagggagagaagcagtctcctcagcccagaagttcaagagcactagtaggacccttcactgtcttcccctggctttacaaatccccagtgagtcttgaacacagcacagtgctttgcacaccataagtgccctagacatgtgtgctggtatccgccactgctccataagtctttatacatggaatgttagtgactattgggccaagccatagtcagtggattgtagacatgaggagactgaggcagccttcagaagcctgcctagagctataggccatggctgtgcatagctgtgtcttcacttctctcctgggtatgagagcccttctgcatcgatctctgctctcccctccattccccacctgccaccatgatgggtcagttagcagacattttctaagcccctactctgtgctttccatcacccttaggataaagtccccccgccttactgcaaggccctgtggagtctggaccctgcctactctgatcttgtgcacaggactccagccagcctggcttcaggccttgtctagtgcagggcctgtgcattcccttggcttggatactcttcttcctctccccttcttgtgcctggctgtttcttcacagcctcagacaagccttcccagccactggagctaaacatggagcttcttttcattacaattcagccctggtttgtttgttttttaatattcgtttccccattaacatgtaagctccatgagggcaggcactcaatttagttcaccattattcctcagtgcctagcacagtgcctggttgttagcaaaaaactgatacatggataataatagctaacatttattgactgctaagctgaggcaggcattgtcttaagttctttacctgtgttaggtactagacccatgtaacaactcatgacttagtagtattacctccattttgcaggtgatgaagccaaggcacttcacaagtttttatgtcacttgcccagagtcattcatttaggtaggggtagtcaaataggaatggagtctgtctccttagacatagctgtaaggcctcttggcacaagtgaatggatgaatgaataacatacggtccctgtcctcaaatatatcacagcccagggagggagacaagcacagaaacataagtaatgatcaagagtgatggaactccagggattgcggtatcgtggtggttggttacatctgtctggaggggttgaggaagttcccatagatgaggaagcacaggaacttgaatttgaagggtggatgttttctaagtaaaaggaaagtaggcattctaggcttcccaagtttcccaatgtatggagatgcctttggggaaggaatctcaagcccattctcctaactcttgtcctcctaatctccaggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggggccttaggactctgtgcttgcattgcacccctaggcctgagacgggatattgaaagaaaagtcatggcaagaacctgtttctcctgacatggggagcctccaagactcagctgtagtcttaggaagtgggattccaccctcaaccctgaaggcaggcctggtggggaggagacagccttcctccccagggtttccattctttctctccacaggcctcatagagggggcctgtccccttggcttcatgcacccatgcttgtatctcaggaagcctcagcagacatcccctctttgtgttggggtgagcttccatggctgggacagttgtatgtatcctaggttcaggacagattaaggccataccataggagggccccaggttccctgatgactcaacggctgcagcggcggctgcagctcttatgcctggctcttaaggattggggactcagagatgaagtctgaaggtaatggaagtcgagagtggaggctctgtggcaggctccatatcatctgggaggacttccctggaggctcaggaatggaaatgtggtttagatgatacaacccttattcttttccaaaaataaaacaaagggcacagcacctgggtctgggggaagccactgcatgtggaccatttgatcctcagggatttcagtaggtcatgcaggcacttctaatgaagtatcatgccttcctttctttctttcatttatttatatattttttcaagatatgggatcttgcttcttctagcctttgcccaggctgatcttgaactgagctcaggagttcaagggccatcaaggtgaaaaagaaacaaaaggtgcaaaaaccagaaggtttttgtctcagtcccttgagtagttaggactacagcatgtggaactggcaccctgtttcatttaacaaatatttattgagcatctagtatgggcctggtattgttctacgtaccggggatcccacactgaataaaacaaagatccctgttcttgttctggtggagcttaacttctagcaggggagacggtaaacacacagacacacacaactgtaataaatatgttgattctgtagtaagttacaaagtgattagtattaagaaaaaagttgtgccaagaggtgagttcaaggacctcacagataactctggcttttttggggtgagccttgttcatcttgctaggctctgacttggctgctcttgtcctcagggtgcttccaaccacagataggagggcagaggcagggtagtccttggggaccatgctctgccctgtagagaagctccttggtttttggaagctcccaggtgtgcctctccctggcacaggacaaggaggtacctgggatgataggatggtgagatttagccgtggggtgagctggctgtggatctcagcagtggtggtgttggcctggtctgtgctcacaggtgagaggagcagtatgaggaagggacctgtggttaagggcttgagggagagaaatgagaaagagcaatcagagaggaaggagaaaaacagagagtgtgctgttttagagactgtggcgtttcagaggaaaagggtgagggaagtggttaggcaagtccagcgcagctgagtggtcaggcaagaaaggcctgcaagtgttgattggatttagcaatatggaggtcactgatgacttggatgacagtgacaccaggggagggatagaggcagaagcctcactgtcctggactaaagaatgggaagagaggagcaccatttccagaaggatttttcccaggagagggcaaggcattccacgctgaggtctggaagggcccgtgaactctgcggccagcaaggcagaaacgatgaggtgatagaatgtccaggttggcctgaccctggggggccatgtgggctagtgtacatgtctccagaagaggagacagggccagagaggaaaagagtctttccagggccacacatcccatagtgatcggcaggggaggaccagacttcc

SEQ ID NO: 13058 - DNA, 103712 bp, Human
  misc_feature (1)...(103712): n = A,T,C or G
aacccgggaggtggagcttgcagtgagccgagattgcgccactgcactccagcctgggcgacagagagagattccatctcaaaaaaaaaaaaaaaaaaaaagaagtaatcactaagcttatctgatgaccagtcccctaagtacttccaagtcttcattcttggttgtggcatagcggatgaatcttgctggatccttggctatcggctgttcatcttatatcctcttccagaaagggcatgcatttcttaagcaatttacagcaactagttcctgtacgtgtttgataatagattatctatttaataaaatcagtttgctgttaatgatattctacataaaacatgtagtttcacactgtaccttctttagaaaatttaatcctgtctcactgtggtttctatagttgccattgctctttattggtactgtaataatcagggcagcaaattgtgacccacctttgctcccttaggctctaaaataagcctttgggacatcatgtttacaggtacactgaggctctaaactgtggtttcaatcctaagtgcaactggatattttataaacatcaagatataaattggcatctcataaaatgttagattcttacagaaatcctagactaggtcatagacagaacagtgaattatgtaaataaatattttaaacaggtatctccaccttttttgatactgtaaaaaatatgaagggggaaatgtataagaatacttcagaggttctttgtaaaatttattttttccctatttactaacatcttgaaacacttagaagtgtttttttctagctgaatgcttttttctacctgaaaaaataaaatatttccacattatactgttcctgctatccacagatctattctcccaggttcatctcttcaagatttgttcataaattattgattcctcctaatattcacaacctcataggatgtgcatttgtgcgtgtgtgtgcatatgtatgtgtgtgcacatgtatgtgtatgcatgtgtgcacatgtgcatgtgtgtatatgtgtgtgcttgagtgtcctactttactgcccatatagcttttgccatttctttcctcaaaagctaagaggatagtgaccaaaatatctatcagaattaacaggatgcttgaataatcctgccccacatagactttcttattatataggtataatttaagaaacttttaatattttaatgtttctctagtttggttcaaaaatggtttttaagtaaataacagcttgagtaaacagcatagaaaatacatatgtattttatgttaaataataatagcttatatcaaaatctaattataaccatgaataaaataaaagattttacataataataaaccaaggaaaagaaaaggacttattaaagtttagacatttctctctcattatgtctttacttgatttctgaggagaaatgaccgaattaagaaacagccatgaggcatagacacacagtggaaaatcatttctcttttcagtaagttttgggtctgctttaaattgatcatttgtttcatcagctaatccccaaacagagggcacgtccgctctacttgcaaaattcttgtatgtaagttgaattctccctttatcaactcaggccaataagtactttattttgtttttgcttgttgttagggaaaaaaaaaaaaaaacaaagataatcagctcatactacttgcgtagctgtctgcattttaattccagactatgaacgagcgtcagagtgcccttatgatattttgcacaaaaggctcagtgtttatgactctactcagagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtaagactgtgataatcaggcatattataaactacatgcatcatctttaatgagtcaataggtcaaaaagtacatgacaaaatgttgctaggaaaatattctaaaaatattaaggaaaatatttacataggaaataaggaaaatattctaaaaattttaaaaccatgatgtgtacttgtactgaactttctcaaaacacgtatttgtgagaacagttctccatctctgtaatacagattgttggtgttggggggaagttacacctatgttaggatatttaaaacttctcaagtttcttagaataaatgaatcaacctttctttgcatgtctttctttgcacttttttctttgttcagggttttattttttatttatcatgtatttaccatgtatatcaggtaatatgaacaatagagttgtcatcattaagtatatgagaaaaaatatatacagaataaatatgaaaaattttaagtatattataattccaaaaaaattaaaatattagcattgctatgaataaaaacacatatatgcctaaaattgtacaggcatattaatttacctatatgtattataacatttatacataacacaaaaggtaatttctcaaatatgaaagtataaattaagaaaagtataaattaggaaaatgcatactgtaaaagacattttatattgtttcaattctaatttggtacatgcaattttaattgaataactaattataataaaatatttcaaaataagtttaccaaagggatttaataaatctattaaatataaaaacataaaatatttagcaacaaaaaatacctaaatagagtggcaaaggttttctttagattatgtcaatttatattttagctctattaattcatttgttgaattaatatatctgtaagaaagacattatttagataaaatatttgaaaatttagtaatatatatttatgttttagatgtagttacaatattaagtaaaattatatgcattaatatattcttttttcaaattcttaatattgtaattatcagcagtatgcctacttactataatttttgatttcaaagaatttaaatttcaatgtaatgtgaacatttatattgaccaaataaaataactaacaatttatttttaaaaggaataagcatttcattattgtctgcaattattcaaaatttttaaacaatcaatttatgtcatttagaaaccaccagatctcctttcctttacatatgttttccactttaccaagcctttataacagtgaacgaaatgctcatatcattatataaatatctgatttttacagtcttacacattagtaaattctttacttaggctccagtgaaatatttataattttaggcacacacagacacatctgcatatatcgaaaagcatatgtcttctacttatattttttgttttgttttgtttttcacttaggaatgtttgtaaggtacatttcctcaagaaacataaaaaaatttttgattaaattatcataaattgaagatgctttaaaatgatgtgcacagatgcctcctatgcattattaagaaaccagatccatctttcaggaatttctcctaatacagctacatataatctgatacatatcatctataactaaatatcaactgatcatttttgccactcatgatcttagcatgtactcttaaatatatgttatgtttaaaacattacatagcagtattcagcatgttagtgagtagtaatgcattaggaataaatgtgttaaactgtttaaaaggagatattgatctttctatataccttctttacatgagaatttattgctcctaaccaagtgtttgagaaccatgctggtgaataagaaaaatttgttgtcacgacgatttcctttaacatcgatgatcttctatcacctgtatctttgctttggtgaaacagattgaagttgaaacacaactaagtatggaacgtaataataatcccacaggaatcctttctatcaatggtgaagacagcccctgattgacaaaatgagtgtctttgcaaaagtgactagaaagatgtttgccactttaaaatcaaatcaaaacaaaacaagataaactgtacccttacagcgtttttttttacccactctcaccacctttcaattgagagaacacagctaaatgctctaaagcctgtcaaaatgtgtaacagatcaatttccttttcaaatgatgcctgccctcttgaatatgctgatatgattcgttaagagaatgcttgtctgaatttaaaacatactctagaatacatacctttgtcaaaatgtgtcacattaattactcaataattatattcagaatcatccaagtatgtcttaagattaaagcaaaacatcatttttaaaaatcctgccttggcacaacacgtgaaatttgaaatgttattttaggacagtggtttctcaacataccagagcagtagatccagtttagctgttttttaattctaagaagtttcatgataaatgaaatttgcaaatttgcaagatactgtattaaagtggggataattttggcacatcagtcatgtcttaaaataacctaggcagttttatctgtgtgcaaaatttagaaatgtcattcctgtggaaatgagcaaatcataaatacatcacagaaaagaagtcgctatttttttgactttaagttgttttatagttaaattgtgtcagagagtttgccatctattttattcctaaaaaggcctggtggagaatatatgactttccttgatgtagagataatactactaaacataaagataaacataaaatgtaactagaataataataaaggcaaagagaaaaggtatagatgcatctctgaattttcaagagagtagtgtcatttgtcactaagcaaatacttcttgacagtgcttgaaattgctcttgaactggtaaagcaaaatgtaactcttcccccatagtatttgatgagaaataaatgggctataatgtcactcgtcaggtggatataattccccttcttctaaataacacttttctttgggagactatgtaagacattggtttatttttgattattttctctcttttatcgaatgcttatagaataacccaaccctgtaggcatatgaggatttgactccaaatttattggttaataataaataagcgtattgatgttttcacacacatatgtgtacctggctacacatttctctattaacagataattttgaatgcatgtgtatactcctttgataatttcaagaccatgtgaattatttataaaactttcatgtcattttatacaatatggatttaataaaaccacttacatgaaatttaatttaaagtatttttaaagatacaaagcgatgttgtcattttgtgtacgtgtgtgtgtattgcatttttaaaccagtgtttaaaacatacaattcttaactcacaaatatgatttttatgagattataatcatgtcattgagatttttttgtgcataaaaaaggaaaaagcaatagacttttaagagagtgagttaaatattaaaaatctcagcaagacattacttaactgacccttaaatattatgaaacaaaacattagaactttagggttgccagatttttaaaaaataaagtaaggaattattttatataaaacatcatccctttcaacagcatattctagctgtctgtatacttattgacaatttggtgcaggttcagagtccacataatttaaaattttaggaataaagtcacatttatttattcaataatcccagtcacgcatttagattatactaaatgctgttacatttaagtactaaaagaaagtatgtttattctatctggcacaaatttcaaaggatttacatacttaagatatcctatctatctttatttttaaatccagcttgtaacatgaattaactatattcacgactgtttcataaacgttcatgactgttttccttccttaagttgatacatatttttaacccattacatacaacccttggacgtatactttactgtcttctgtgtttaaaaaactcaaaacacttctgttttgttttataccatacacatttttgtttataattaaggtgatattcttgaatttctcattttgggaattaaaaagtagaaatttatttatcctatattcatgccattaatgttaaaacaatttattaatctgtttataggatgttttcaatatttattttttattgaaaattgacaatttataattgaataaatttatgagacataaactgatgttagaattcatgaaaacaatgtggaatgattaaatcaggctagttaatatatccatcacctcaaatatttaacattttttgtggtgagaacatttaaactttgctctcttaggaattttgaaatgtagaatactctactattaactgtattcgccacactgtctaatagaaccccttctgaaacgtgaaacatactcctcctgtctgagatttgaccttcatttcctcatctgccccaccccaccagcctctgtaaataccagtctactttatgcctctatgagttccattgttttagattccacataaagatgacaaaatgtgatatttctctttccgtgctggctgaatattacttagtcattcttcatacacagctcatagcagacaattaaaaaaaatccccaaaatatgcaataatagcattaaacattgtgctaacctagtccatctggcaccacgttttatgttgacaataccttttcatgattaaatactctgaataaactcaacaaaataaagttttacaaatatgaatttaagttaatatgcagaaaatataaaaaataaatataaaacaagtgatacaattttttacattatatcctttatgaaagaggctaaacattcaattttatattatacaatttgaaactaaaataattcttatcttgagattgaattccaaaatattttgtatcaaaataataatatattcttatttaccttttatagcatgtctttgaagtgtactttccattttagtattctatattttattatagcttcaattaaatttttactttctaactctgagtttcagggggtacatgtgctagcttgttacatgtgtaaattgcatgttgctgcggtttagtgtacaaattatatcatcacccaggtagtgataatactacctgacagatagttttttgattctcgccctctcctcaccccaccctgaagtaggttaggccccagtgtctattactgtgctgtccatgtgtactcaatgttaagttttccacttataagtgagaacatgcagtatttgattttctgttcttgcattagtttgcttgagataatggcctccagttccatcctattggggcaaaggacatgatctcatttttatggctgtatagtattccattgtgtaaatgtgtcagatttccttattatgtccattgttgatgagcatccaggttgattccatgtctttcctattgtgaaaagtgctgtgatgaacatatttgtgcatatatctttatggtagaactatatattccttcaaatatatagttaataatccactactaggattgctgagttgaatggtagtgatataatccactactagggttgccgagttgagtggtagttctaagatctttgagatatctccaaactgcttttcatagtggctgaactaatttacattcacatcagcagtgtgtaagaattcccttttctatgcaaatttgccagcatctgttatattctgacatagtaatagccattctgactggcgtgagatggtatatcattgtgaccttgatttgcatttctctaatgattagtgatatttggaatatttttttttatactgtaagttctagggtacatgtgcaccacgtgcagatttgttacatatgtatacatgtgccatgttggtgtgctgcacccattaactcgtcatttacattaggtatatctcctaatgctatccttcccccttcctcccaccccatgacaggcccaggtgtgtgatgttccccttcttgtgtccaggtgttctcattttttaataggcttgttggctgtgtgcatgtcttcttttgagaagcctctgttcatatcttttgcccatgtttaaatggggttgtttgttttttgcttgctgatttgtttaagtaccttatagattctggatttgtcggatgaatagtttgcaaatattttctctgattctgtgtgttgtctgtttgctccgttgatactttcttttgctgtgcagaagctctttagtttgattaggtcccacatgtcaattttaatttttgttccaatcacttttggagtctgttatggaatctttgccagggcctatgtccagaatagtatttcctaggttttctcctagggtgtttatagttgtaggatttacatttaagtatttaatctgtactgatttttttatatggtggaaggaaggggtccagtttaaatcttctgaatatgcctagccagttatcccagcaccacttatttaaaaggagtcctttccccattgcttattatggatggcttcatcgaagatcagatggttgtggatatgcagcctctaggttctctaaccagttctgttggtctatgagtctgtttttgtaccagtaccatactgttttaattactgtagccttgtagtacacttttaagtcaggtagtgtggttcttccagctttttttttttttttttaacttaagattgctttggctctttgggctcttttgtggtttcctgtgaacattagtatgatttttttttttttttttttttttgagatggagtctcgctctgtcgcccaggctggagtgcagtggcgggatctcggctcactgcaagctccgcctcccgggttaacgccattctcctgcctcagcctcccaagtagctgggactacaggcgcccgccactacgcctggctaattttttgtatttttagtagagacggggtttcaccgttttagccgggatggtctcgatctcctgacctcgtgatccgcccgcctcggcctcccaaagtgctgggactacaggcgtgagccaccgcgcccggcctagtatgattttttttaattttgtgatgaatgtctttggtagtttgataaaaatagcattgaaactgtaaattccttgaggattatggtcattttaacaatattgattaatcctatccatgagcatggaatgttttttcatttatttgtgtcctctttgattttcagtaacttttgtaactctcattatagagaaattacacctccctgactagctgtgttcctaggtattttattctatttgtggctatttgagtgggattgtggtcttgatttggctctcagcatggacgttctcagtatatagaaatgttactgatttttgtaccttgatattgtatcccaaaactttgttgaaattttaatgagatctaggaacctctgggcagacttttctaggtatagaatcatattatctgtgaagagagatattttgacattatctcttcctatatgtttgccttttaattctgtatcttgacttatttctctggttaggacttccacagctatattaaataggagtggtgagagtcagcatccttgtcttgttccagttctcaagggaaatgtttccagcgcttgcccattcagtatcatgtttgctgtgaatttgtcatagatggctcttattatatttcaggtatgtcccttttatgcctttttttcagggtttttaatatgaagagatattaaatgttatcagaagcttttctgtgtgtatggacatgatcatgtgatttttgtttctagttctgcttatgttatgaatcacatttatttatttacatatgttaaactaatcttgcatcccaggaaacaaggtaatcttatcatgatggattgaatttgatatgttgctgtatttggtttgttagtattttgttgaggacttttgaatctatgttcaccaggatattggcctgaagttttcttctgctattgagtctctgacagattttggtattagaatgatgccggccttatagaacgagttagaaaggagtccatcctcctcaaatttttgaaatagtttcagtaaaattgataccccgtcttctttatagtatctggtataatttggctgtgaattcgtctagtccaaggcttttccttttgggtaggttttttattactgattcaattttggaactcactattaatctctttcagtttcttcctgattcagtcttgggtggttgtatgtttccaggaatttatcaatgtcttctaggttttctactatgtgtgcatagagtctctcaggttttttttttttttttttttttctgtggggccggtggtaatgtccccttggacatttccagttgtgtttatttggatccttttttttttctttattagtcttctagtactatactaatcttatttattctttcaaagaacaactttggttttgttgatgttatgtgtgtttttcatgtctccatttctttcagctcagctagctattttttatgttaactctgggttggtttgctcttgtttttgtatttcctctaggtgtgatgttacgttattaagtaaagatctttctaactttttgatatggacatttaagactaataaactttcctcttaacactgctttagcagtgttccagagattctggtatgttgtgtctatattttcattagtttcaaagaacttcttcctttctgccttaatttcattgttgacctgaaggtcgttcaggagcaatttgtttaatttccatgtaactgtatggtttgagtgattttcttttttttttaatttaattttatttattattattatactttaagttttagggtacatgtgcacaatatgcaggttagttacatatgtatacatgtgccatgctggtgcgctgcacccactaactcgttatctagcattaggtatatctcccaatgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtgtatcattgttggacatttgggttatttatttttattgttattgcaccgtgttccaagactgtgattcgtatgactttgggctttttgaatatgttgagaattgctttatggccaagtgtgtggttgattttagagcatgtgccatacgtacataagaagaatgtatattctaccgttgtttgatggactgctctgtagttgtctgttagttccatttggtaaagtgtcaagtttaggttctgaatatctttattagttttctaactcattagtgtgtctgatactgtcattggggtgttaaagtctcccaattatgattgtgtggttatctaagtttcttcgtaggtcttcaataccttggtttctaaatcttggttctccagtgttgggtgcatatatatttagtataattaagtcttcttgttgaattgaaccctttatcattatgtaatgccgatttttgtcgtttttgatagttgtctgttttgtctgaaagaagaatagtagctcctgctctttcttgttttctgtttgcttcatagatctttctccattcctctactttgagcctgtgggtgtcattgtacatgaaacagatatttttaattcagcacacagttgggtctttaaaaagtggggcatttagcccattttcattcagcacattatctatcttctaaaaaatcctcattaactccaaacctctcattgctatcatcccaactctctgttttccctctctcagcaacttctttgaaagactactttgaattgtggaacttcattcttaacctccagttacccttcaattcattatttctgtttcctgagattcactcctaaaacttctcttcagctatacagcaaattattaatttttcttaattgaaggccgatataaaagatcagaattggaaacttatggtgtacattagtggaagaaataaccagaattattctttatgttgtggtctctttcagtgacaaattagaaaatatatatatttttgtgttcatctgttaacactagtttattttttaatacaatgtgatgtagaactctactttcttgataccctgaggttttttcgactactaagtttttctactatgcaagtctccaaatatctttgccataatcctatccaacatctttaaacacttaagagaacttatatgtcaaaaagtacatggcttatctcagcaattaggttttaagtttagacacaataaataatacattgataaatttttttgtataagaacattttagatatcaatttatttctttaagatagagtcacagatgtgagattgaaaataaaatgactttcagtatttaacactccagaaacattattggttactttcaaaaatacaattcctatttattttgctgttattataaacaatttataacaagaatttatgaactaaggccaataagtatatggaaaaattttcaacatcactaatcatcagggaaatgcaaatcaaaatcacaatgagatattatttcaccccagttagaatgtccattatcaaaaagtctaaaaaaaaatactgttgtgaatgtggagaaaatggaactccttcattgttgctgagaaggtaaaatagtacagccattatgtaaaacagtatgaaggtttctccaaaaactaaaaatagaactagatagaagtagtatatgattcagcaatctcactactgggtatttattgaaatgaaagaacatcagtatattgaaaatatatctgcattccaatgtgtattgcaatatatgtattgcaattcacaatagccaatatatggaagaaaactaagtgtccatcaagaaataaaagaataaataaaatgtggtgtatatacacaatgaaatactattcagccatagaaaagaatgaaattctatcattcacagcaacatggatgaacctggactgcattactttaagtgaaataggtcaggcacagaaagataaacactgcaagttctaactgttatttgaaagctagaataaaattaagctaacagaaatagagtgaagaattatgattattagagaaaggaaagaatggaagaagaggaaatggggaaagattgtttaatagatataaagttatggctagagaggaggaacaaattcgtcttttctatagcactgtacagtgaatatggttaacaataatttaatttatactttttaaaaagctaggagaggattcagaatgttcctaacacatacacacaaagataaatgtttgaggtgattgttgtcctaattaccctgattttatcatcacacattgaatacatgtatcaaaatatcactctgtatcccataaatatgtacaattatttgttcatatttgaatatgtacaaaataaagattttaaaattattatgaattaagaacttggaggtaataggaggtaaatgaatttacttgagggatttaagacatagaattaatcatagttcatctctagtcaggcttcatgctcaaatgtatgtatatgggaggttagctgaaggaaacattagagaagaaccttttattcaagtgtgagctttcaacaggatgctgatttcattaagggaaagaaggaacataacgattaggtggaagagtgaatagaaagtaagaatttcagtatgcactttgaaatgcctcgtggaaagtagttctgtaggtctggagattagaaaagagataaatatggattgcttagactgttttgtgatgcagtaggcagatactcactgaagccacataatctgaagatattatgtccagaatgtgcaaaaaatgtcttcaaaatagaaccccaagatttaattttcctcaaataccaatatgacttttcaggaatgttttttccattaaagtaaataggaaagtaggtaaatagaattccacttgtaagttgctagattatcaatgattttcaaaatctatattcggacgtgacagtgacaatataaggtaagaattttaaccttctgctaaattaaaattctatctaaactctcttagtttttataagtatttatgatagatttgtactgttgtctactgccaactctgaaaattttacataatagaaactgtgcacactaatcttcggtgtatacacctaaaatcatttgtaaatgatcatagcaaatatttcccgttttcaatcgttctgacttggaaggagccctctcctgcatggcttaaatagcatttatattgagagctgctcctttgatgattcttgtagcaatgggtgattaccagtgattatcttatgcactccaggaactgattaataagcatttatttaaagaagtcagacattataagtatttaaataaatctcatgtttatatgacatgaggacctttattaaacacttgatatattctaactacagtttctgttatttttaatgggatttatccagaagatctagaggttacatttattaaatcgtcttgcagctgaagatactcaatctgagattgtttaagaatcttgactagtgtcatgaaactatggtatcatggaggtacaaatcattacattttatgcagattctacttacgggtcaacattgacttaatgttacaaaatgagaacttaaaaagtaatacataaaaaaaatcactgctgattatcctcttgaggaagaaagggaaaatgatagaccccaaacaggcttaggtggaagatacagacccgcaaaatccaacatgattatgccatgctccttcatcttacaaggaagtctgcaaggaagtgtttatataacacagcaggctcaccatgcttttaaatgaactatggaaaaatatgagaaatttcatttatatttatgctttacttcattcttttgcatttcaattttgagttcattttaggaaatactttacatagtgataacatttgtgtttgtgaatcattagtatataaatacatatacaaatattggggttcaccagcagtatttctttctgataggagaataaattatgaaaagtttgaaaaacactgttctataaataagtgttaaccaacttctacatgcattttcttttttttttttaaagatatacgtattccagaaaatggcttctgcaaagacattggttaaaggtaccagctctaaagaaagcaaaattctttgtcttaattccaatcccaccaattgctttatggctaagacaagttacttaacttcaatatgctcagtatctgcatttataaaatagcaacataatagaacatatactatagaattattgtaagacaagtcaattaaggaatgccattatctttgcatagtaatcatcacagagtaaacactcagtatggttgacaagatgatgatggtgatgatatttcctgaaaatatttaccgtaaagtcatctttgaggcttgttaaaaaaaatacccagctcatgaatcagtagctgtggagtgggattatctgttttgtcaagcttttgaaatgattctgtgtttctgtagaaacaatttccctgaaattgagggatcaaactaacccttatttgtctacatatttatttaaagattgaggtattctccacattcacaataaaattttaaactaaatataatgaggtctaacaaataaaataataatagttttgtcatatttgttcatttgttaaagtcataattactgctattgtcaaataaagtgcttttgcaggcctggatcaaatgatttttatatttcactcagttcatgtgaatcagatttatgtggttctgtgatataattatattaatttttagattttgtactgattctacacaacacaaacatatatatacataaagaaaggcaaattaacaaagtgcatgactttagttttctttttccattcacgaaggattgtgttttataaaatcatgtttatattatatcttttccataacaaaatagtactttctataccatttggcagtggtgcttactaagtattatttttgatagtagagtaaatttatagatattacagttatagagagatgtgctgaaaggacaactgataattggagaaaggaacatttggatgatatgtttgtctaggtattatgtagctactatcacaacatcagcaaaaactgtcaaattgaatacaatggtttatttactatactaagcagtggctaaaaagagtttcaacaagtgcaaagtgaaactatatcttcataatgaaagcataagaacaaagaaataaatactgttagaaattcttgggaaaatgaaatacactgttggttcgaagaaaaatatgtaatccttcatgttgcctttacagatatatatatatatgtgtgtgtatatatatatgtatatatattcaaatatgtatattcattcaatttgtcaaatataatttacgtgataaacatggttaactaacataatgtttgatcattattctgaacaatgttttaggaaaaaatagtctttgcataattttatgactatggaatttcccactctacatgtatggtaattggtggttttgttaaaccatcatgatttatttgaaggttcatgaaattttcagtctaccttattcatcaacctttaaagatttttatttttactttttaaattttttcttgtgttgttattattgttggaagtaggaagcattatttgtttattctctgctttctaaaaagctgttaattcattaatcatcaaaagaagcctgggatgtatgattccctaatcagtagtttagtggtgtatctgcatatattccacttcagtcttcaaactgtaactttaagtgaaacactgtgtaataaaaccaattttatcagaggctaattgagataaaggagagtttagtccctatgacatatttctggtaacaaaaacttcactaaacttataaataaggaccaaaacatttctaatattaaacactgaaataaatctgagctgtatctatatatatatagatatagatatagatatatatgattagtaaaaatgagtaagatcattatttacccaattttgggcgaatcagtgagtgactggcagttgtggtgatgggttaaatcaagaaatgaatgttggcaaaacaaagattgtcaggatcacctctggccactatgaagttcaaacacaagaattaacaaataacagctggctcgctgaactctttcctacccagcatagtttattgtcctgcatttgtatgatgatcatgtactttacaaatcttcattttacaataatttgtattcgtttattttccaacctggttattccagttcagggccatgggtgacaggagcctatcccagaaacccagggagattggtgggaaccaaccctagacagggtgccatcccattgcaggatcaccctcacatggtcacactcactcagactggggccttgtagatgaacaaccagcgtgatgtgcacagctttgggaagtgggaagtgactggaggatccagataatcccatgcagacatggggggaatgtgcagactcaacacagatagtggctctggcagtgaatcaacttttttctcatcaatattacactgaaatgaaattcaacaaaatgacattttttgaggagttgttgtacaagctcaccttgatctttcttctcttttgaaatgaatataatatttactgtaccattgaattatgagacaaattactaagagaacagatgagtaccattatggcattagagacacagttgattttgttagtcggggagctaggctattacagtaaccaattaaccttccatttctcagcaacctcctaccacaaacatcaggtggaagttagtgggggaagtgtatccaagtttcacagtcactcagtgacgcaggcttggtagaggctccaccatccttcaactactgattgccaaactaggaagcaataaagacgagacaattattcataggcctttcagtgtttcagttcgaaaatggtgtacatcacttttactcatatcttgttagtaaaaccagtcatgtaaccttgtgcaattgcaagagacatattggtaaacaattatatgtctaccacagtaaccaaaacattttagttcttcttttttttatttgttttatataccagtcatagccatttcatccgattagtcattcagaatttagggacagtttatgaggtcttaaaaatctgaacctaagcttttcttagagtgatggagtggaaggaagaatatcatgatagcaatcgcagttccttctgagtctggagtaaccagcaccagttagcattgtcacttgtgatttttgaaggtatcttaacctctgcgtttcccaactctcatttgacactcctaacacaggcaatttcttttgacatccagttggtcattaagttttgtcaattctgcctccatgttattattgattctcttacttatattgtcctttgctgaagagcaggattagtcagagtgctgggatgaaatatcaccttcaagaaggcaatagaaggtcatggatctagggtgtttgatggagaaacagaacaattatttcaatgtcctggtaatgcaggtgcttctaagcactgattagaagatccaaataatttcttttaagactaaaatcatattgtaactaactaataaaattaaaatgttaatataagataaaaatagattaaataaaaggataggcatggaagtgggaataaagacaataggtaatacgcattccaaaagatattccagccacaacaattcaagaaggggatttattttttcttaacattgttctaatattaattttcttgcttctgtgtttaactacacagacaagatttaaataaattcacaaaaatacagagtacctttttgaaatgagcattgagacaatgttagtatcattttttaaaatagacttcaccacatagtgtaaaatatgccactaactctccatgttaactcctctatatggtactacagaggtgcttttggaatgaaaggggactgtttatagacactttgtggcttccttcttttttttttcctttttataaagaatctctcaaattagaagaaagataggtaatattctctaactacttccccattttaatattaccactccagtcccccagagccatgtgttcctatttgtttcacacgaaggctttatagtatttgcttgcttcatgtgttcacttcccaagaggagaggtaagatgtgttttttaaattgatgaagagaaactcttattcttattttttagtagcattttcaaaacctttaagtttttctgtttttctttgttttgggaaaggtttggaactctctgatcaccacaaattctaagtctatgatatatcattttggccacgcctactcaatatttttctaaaaatggagacattatattaattgccatctgtttttctctatgagaagctgggcttagttgagctcaatatttcagctttccatgagctttccggaatacattatatttttacaagttttcacagatggaataattagctttatgtaaccaagaagaggtcatagaaaagacaatttctaattagattcagtttcaaactgcataagtgcatagattataatatttttcatcccttaagtcgtaattagtcttctttgaaaatataattgttctgagtcacactgggctcattttcagcttatatatgtccatgcaatatcatgtattgcttcaagcatgataatatgtatctgtcatagtcacttaaccatgcttagaaaaaaaataatgacattcaaataatttgaaaatacatgtggaacatatacatcagggaaaatatatactaaagtatttttgcaatagtcatttacaaagctttttatgtgtgtatatttttagcagaaatgaaaatagctgaatatttcgaccttgagaaatgcagaaatcactagatgcttattattcacctgtcaatagctattttcatgtagctcactaaaaacatttaactcttaatacgtgccggacagtattttggatgcagcaactcatttcatcaagaacacagaccttgagaggcataataattatcctcaattttcacatgagacaactgagacaaccagaggtcgagctattcgtccaaggtgatggaactagcaagtgttggtgttgagttagttattcagccatccttgctccacatgtgctactcttatctccagcaaactgtctttagaacattccatctcaaactatttgggaaaataacccgaaagtcagtagagagtgactctcttggtctttactatggtgcaaaataacatttatttatataaaatcaatttatattatatatatccaggacttcttccctgcatttgtctacaacttttttccttcaattaaagaaattatattgtatgtgttccgtttctttatttcacttgacaattatggcaccaaattatgtggctgctgagtaacaacatgttgacataaattttttaatgtttgtattcaacggttggtcgtttgttcaactgtgagaccaattttatgtacctcctcccagtgaatggattttggctattgagagtgtttacagtgctttttaattgtacatgaaaactaaaaataaagacaggtttatgtgagtttatcttctgaaataatcaaaggaatagtagaatacctgtttagatattagaagtaaaacagtgttttatttttctgtagtatatcttgtcataagaacattaagagaaaaaacacattttagaaaaacatgaaaatattgtacaggtttgactgcaaacacacaggaaagtaataagaaatagcctgtgttcatgtgatggttaagttaaaatcagactgcataatatttcatggtatatgtgtaccacatttcttatccagtctgtcactaaagagcagtgaggttggttccatgtctttgctattgtgaatagtgctgcaatgagcattcgtgtacctttatggtatgtatattcatgtgtgcatgagtgaaaatgcatgtgtcattatgatagaattatttgtattcatttgtgtatatacccagtagtgggactgctgggttgaatggtagtcctgttttcagctctttgagaaattgccttactgctttccacaatgatgacataaatgaactaatgtaaatactaatttatactctcaccgacagtgtaagtgtatctttttcccttcaacctcaccagcatctgttatttttgagtttttcatagtagccattcagagtggtgtaagatggtatctcgtacttttgattttcattcctctaataagtgagactgagctttttgtcatttgcttgttggccaagtgtatgtcttctttagaaaagtgtctgttcatgtatttgcctactttttaatgaggttgttttgtcttgtaaatttttgttaagttcttgatagatgctggatatcagacctttgtcagatgcatagattgcaaatattttctctcattctgtagttttcctgtttagtctgttaatagtttattttgctgtgcagggattcttaagagcagttagattccacttgtcaatttttccttttgttgtgatcgcttttggtgtctttgtcataaaatctttgcctgttgctatgcccagaatggtattgcctagattgtcttccagggtttttatagttttgggtttcatgtttaagtctttaatccattttgaattgatttttgtatgtggtgtaaggaaagggtccagtttcaatcttttgtatatggctagccagttacccaacaccatttatggaatagagagtcttctccccattgcttgtttttgtcaaagattagatgattgtaggtgtgcagtcttacttctaggctctgtattctgtttccttggtctacgtgatttgtgagaacatagatgtagctggaggccattatccttagcaaactcactcaggaacaggcaaccaaatatcacatgtcttcacttataagtgggagctaaatggtgaaaactcattaacataaataagggaactacagacactgggccctacctgagggcagagggtgggaggtgggataagaacagaacaaaacaactattgggtactaggcgtagtacctgagtaatgaaataatctgtacaacaaactcctgtgacatgagttttcctatataacaaacgtgcaaatgtacctccaaacacaaaataaaagttaaaaaaagaaaatcatgtttttattcctatttttctcacacgaaccctataaatttcagatgcccttcatttcattctattcctgtcactatgttttttaaacaaagaatataattatcaatgcttatatgtctgatgtttatttttgtataacactgagagcaccaaaggctcataaaaaagtacaataattttaaaaaatcagactgcaaagatggtaaagacataattaagatctatactgataaaggtgttttaggcaaatcttcaatacaggagcatacaaaaatttacccttgaccaataagggcaaatcatggtctgatagtttgtggaggggaataaaaagtgaaatactgtatctaagaatatgaaatttcaccagcatttatttaaccaattggaatctatctcttttcattttagaacttttgcacactcagtcttaatgttgtcagtgcttaccacttcacatatgctgctcattaatccacagtcctctaccactgctcctgaataaagttcatgatatccagcccaaaaatgaaatggcacttgttgctgtatatcttaggatttcacatcaatagtgaatgtggaaggctgtgtaatgtcaaagagggcatcagaggctccagtatagctattctgactcacactgctgtagctgtcccagagggcttttttttttttttttttttttttggtgacagtaagtatgcaaattatatgcttaatgagagttcataaataaaacagaaaatgatctttcacattttagtgctgtgcaatgaatgtttagagaaagagttgacacatgggttattaaaatttttggccccaaaatattgcttccttttcacttatgtatgcaaactgtatccactcacatttctttatatttcatactagtggttctgagaaagccatttcaaagtctttttatgcatggtgtcattctgtgaagctgccaagtttcccttgattttttaagagatcacaaacaggattaagtttctaaatttatcccatccacatttcccagcttcaacttatgtcttcccccacacagccatcaaatccatcattctgacttattttttttacttgacctcaagaatctttagaacaaggggaaaaattatatactaagaagagataatagaaaacatatattttgtcatttgaagaatggtccaaacgttaaaatgtaatttatagatctttattcaatgtaaacaaagtgaaccattagatatagatgtcacagtgttagatatttatgcatttttttcttccattcaataaagtacagtgtatagaatacacttgatgtctttaagatcagtagttatgaatacatttgtttacaggacaggtcacttaaaattactgaatataagtcctagcatatgggatgtaattaacacattaaataaaatattgtattagggttctttagaggtgcaatgctaatatgatatatgcatatatgaaagggagtttattaggagaattaactcacacggatacaaggtgaagtcccagataggccctctgcaagctgaggaggtaggaagccagtagtcgctcaatccgagtcccaaagtctcaaaagcggggaggccaacagtgcagccttcagtggccaaaagcctgagaggcccccagcaaaccactttgagtccaaaggccgaagaacctaaagtctgatatccaaggacaggaagcatccagcacaggaggaagatgaaagccagaagactcagcaagccagtttctcccaccttcttccacctgctttgttctagccatgctggcagctgtgactggatggtgcccaaccacaaccagggtgactcttctcccagttcactgactctaatgttaatctcctctggcaaaaccctcacagacacaccaagaaaaaatacttaaccagctatctagggattcttcaatccaatcaagttgacacctaatattaatcatcacaaacatactcgcaattttacttggccataatatgttgtttcttcttataataatgctatttaaatatgattataattagtttagtatctaatattgtgctaatataagtgcacttttattttgaaatatatttacaactttgaaaataaatatggattaacattcccaggtattagcaataagagaaaatataaaaacacactaacataagacatagtattagcatttcttcatactgaaatgttaggtagattttttagcatattcatctgattggaaaatataaacaagattggaaatgcagggcaaaatgccactgctggtttatccagggcccatttcaggcgagagcattttttcttatttgcctggtttcagcccagagtgtttctcagtctagcaatgctgacagctgccaccagtcttcaatcagaagtggatcattatgtgaaatgtttttcacttctgctgaaatgtatgaccattatagaaagtttggaatatagaggagtataaacaaagccacagtatttcattattgagatatacctactgctaccattcatttttcttgaatgttttatctaagagtgttcaaattaaagggctttttccttagaattataaatgatgatttttaactttaaattgaattgagaaatatttcaatcatatatttaatagggaaaaatagcacttggtagaaaaatgacccagatgtcatgagtgttgttgtttgtcatatttactttaaactgttttcgaggaaggagaatcttgcagaaacttctaagtttcaacttttagacaaatttcacttatttcaatcattgtaattaccatgacaaattttgtcagttttctctgcctagacttactaacttaactaattgctttatgccaagagtattatgggacattgccttgtaattgtgaaacacttatataattattatcatatggtatcctaatttaaacattcttttttcaattaatccaatttatacttgcttcccagtggaaaaatttgaatatttctctaggtataaaatagtaaaatacaactgctactttatatacacattgtaaaatttattgcttttggccaaattattctccaaaatagtgtccaaattttccattttatgagtgttgtatagttctgctttctatacattgtcatcaatagctggtattacagtaattacttgtatttgtttaacatattgatttaaaagtacgaattgctgtatatttttgttgttgatttaatacgtatattttaagcataagtgaataataaaagaataactatccaaatactcgtgacccgaactcaacaattattatcaatttaccacaatggttttgcctatcttccatttttttgagatattttaaagaaaatatactttttctcaagacaccctgtcatttctaataccaatatgcttcaagtatacacgactaaaaatagggcgtgtttttatataacaagaaagaaacattcaatgaccaaaaaaactggcaatactttctcattatcatctattgctcatctctacattagtatgtattataccttatacagactaaattttttataaatccataaaaatgcaaatataaaaacagttttgtaaagtcatgacccaaacaatgcccacattttacactagttctagtatatcttaaatctttcttaatctagagcaatatctttcctatactcctgctttttttgacatgtcaaataaactagatcaattttgtggtagatcaatgcttttttaaaatttattgtatattcagaccttgtggtgagtgtgataaaatgcagactcaaagtcggtatctgtgaagaagctcaagatttcgcatctgtagtaagatgctgctattccacagattacactgtgggtagcaaatctgtagaaagacacaatttgggtttgtttgattgtttccttttactttgtttactttgtttcctgtttaatttgttcttttattacaggttaatttcccataacttgaaaattagctttcaactttttttggtaaaatactttataggcaatgttctttataaaggtcatatcataacacatcagaaacatctattatctgttgttccacggttagttgtctaatttgtttttctaggttttgacaagtcaagatttttaacaacattaatgaagtataattggcacaataatctgcatatactcaagttgaattgaatttttgacatatttctacttctaagactttcatcacaatacagataatgagcacaatcatcactgccctcaaaagtctcctcatgtcccttcatcatccttccctcctgatcttcctcccacccccattttcccacagttcttagtctgatttcagtcactatgattgttttaaattttctaaaattagatgcaaaaggaaacacacaacctgaatttgttggcaggcttgttttactcattattattttggatattactgtatcagtagttcatttcttttcactactgagtatcattacattgcatagacatattacactttcttagtacattgacttgttgatagacatttgacttttcccagtttctttctgttacaaataaacctgctctgatattcatgtaagcatcttcatatggaaatataattttattttgtcttaggtagatatctagatagatatccttgatatctagctaatatctagaatggctggatcatatggtaggtatatgtttaactttttaacaaattgcagaactgttttctaaatagtcatgcgattttacattcacactagcagtgtatgagaggtacagttgctctatgttctcttcaatacttgataaggtcagtcttttaattatattcgttctagtaagagtttactggtatctcattgtagttttaatttgcatttacccgttgaaactgaaggtgttgattatcattttttaacttattttacatgtcaactctttgtgatatgtctctttaaatattttgcgtatttaaaaaaattgtgatgaatctctgtttccaagttttgaaagtccttgtacactctgaatacaagatatataattaacaaatattcgctcagtctgtgacttgtttcctcatgtaattatcatctgaggtagaccacataatggctcgcagagatatcaaggtcttcacacctaaaaccaaagactgtgatctctgtagataaacatgagattcagttaatggtctttaggtaggaagattatcctgtattatccaagtggactttaaaggaaattataagtgtcgttataaagggagaagaggtaaatttaacacaacaaagagaagccaatgtgaagatagagtagagagaaatttgaagatgctctgctgctggcctagaggtggaatatgaaccaaggcatgcaaggaatagaatacactttgagaagctggaaaatgtaaggaaatagactctcctctagagacttgggtggaagcatgacctttctggcaccctggtttcagtccagtgaaattcattttaaacatctcacctatagaactgtaagacaataaatgtgtatcattttaagacactgagttgtgggaattctttacagtagcaatgggatctgatacagagattatctccattttgatatggtccaatttaacagtttttaacaagtgcactttgatattgttgtaagaaatctttgccaaagaaattacaagtatttcatctaaatttgtattcactttttgtgacctcatgcacggtaaagtatggatgaaagtatctttttctcaagtgaatactcaggtgttttagcacaaagactgttatttctccattgattcaccttttgaactttttcaaaaatcaattgatcacataaatgtaggtgtatttgtacactttgtggtttgttctactaaattatttgttgatccaatactttaccataatgattactgtagcattatgtgttaaagtcagatggcatagtcttccaaatttcctcttcttttaaaatgttctttgagttattctaagccccatgcttttgcatatataattatagaatgagcatgtaagttttataaaaatacctgtttggaattttattttgtattttaattttaatttaattgtatttttaaaattgcatttatacaacactttggagggaattgacatttttaaccattttgagttttctgatccagtatcatcataaatatctccaatcatattgatttttcttgattcctcttagcagtattttatagtgtgcaatagagaggtattgcacatttttgttagatttatgtcccaatctttgaattatttatattattataaaatgtactgttgtataaattttaaattttgcttatgcgttgctagtaaatagaaatataattgattttaatattgaccgtgtatcctccaaccctgctaaagttacctatagattttaccagtatttttatagatttcataagattttctatatgtgtatttatgccctgtgtaaataaacatatttttatctttttaatctagatgcttctcatttcttatttcattggatagaattttcagtataatgttgaatagaaatgaatcaatttgaattatagatttgtgtgtttcttcttgtaatacaataaggttttatttcatcttgtatttcatttattttgaggcattgttattaagtgtataaacatttagaaaagttgtgccctgttaatgaattgacataattcttatgaaatgatattgttttatattatgaaatgacattgtttatcatttataattatgaaatgatatgtttatcacttataattatgaaatttataattatgaaatgatattatttatcactgctaatattctttgtcccaaaatctacattatctaatattatggccattgtagctttcttttgactagagttgagcaagatatatgtttttcattctttaaattcttacctactgtacctttatattttaaatcattttaaagacatatagttgagtctttttaaaaatctaataatcctcatctcatactttgatttttttatcccattaatatttagagtgattattattatggttaatattaaacatactgctttgctacttgtatgtttttttcacctgtcctttgctcacttttttcttttattttttctttagattgagtattctttaggcttcagttttatctattttgtagcctgtagtaaactctgttattttattttagtagttgctttaggtttattatatgcgcatgtaccattattataatctattttaagttatatcataccactttatatatggtttatggagcttaaaatagcatattcctaatctttatgctgttaatttcatacattttacttctgtaaatgatgtatgctccacaatactttgttattatttttgctttaacagccaattctcctttaatgatattataatttaaagaagttctttctatttactgatataccttccatttctggtgattctatttttgcatagatccagatttccttctagtattattttatttcttcttgaaggactcatttaatcatgtatcgtattgtagttccccttgtgtgctgatgctgtacaccagaaagagtcttcatcccactttcctttattgaagattaggaatacggctttggtgtaacaactgtgatttgttcaggcctggtgataggcagctataaagacttgacctggcagtacagtagtcactgcgaaaacattcccttgtcacaccagatttgatgcacaaccagtgcattgcattctctgaagggagttgcagtcaaggacacagtcccttctgttaggtcatgctcttctcatatttgcattactagccccagtgttaaagtgtaaagagggctttatctgtggccttgggcagaggtctttctccagcatttctgatgaggtctccttattgagtaaagtgggtgaaaccttgaagacagtttcccactctgacaatgtacttagtactttttcactcttaacactccccttgcactcccccgaccccagagtccataaaaaatgacttagttttttgtagcactaccattataatgaaatgatccacaggtctgtgcttatcctctgaattagagtgctgttccatggaggaaatgaaaaaaggagatgcaacaatttcttttgttttagcctcttgcttatactattgcactaagtgtctaaaggcttacctcttaatttttttacatgttctttggattagctgttccaatacctgacagctcagtttcttctctttcaattcagctgatctctttacaaaaatcattgtgattggttgagaaattctcagttggattaatttcttttcattttcaatactttaaaaatgtttctgcagtgtcatttggcatgcattgtttgagatgagacatctgctaacaactttatctttgttattctatatataacatatcgttgtctacctttcagattttctcattattaatggttttgagtaatttaatcatgatgctccttggtataatattttttaacacctgtgcttaagttttgttaaacattttggatgtatgagtttctaaatttcattggttctagaaactgcagttatacataaatgagaatgtttgaaattgtctcacaactcaatgatagtttgttcatttttaattttttaacttgtttctcattatgttttttcagaagatttatatttgtcttcagtttaactgtttttttttctcagtgtgaataatatgccattaatcatatgcagtgtatttcatcacagacattgtagtattattctctaaaagtttaatctttattttattttttcaatttttctgcttaacacgttcaacatttcttctggtctcttgaacatatattttgtgtcctagtctactaaagatgtcatgcaataggattggctatgaatatttttgatgaatattttatattacttctaatcaagcccctaaacatttataaaaaatatggaggataaagaaacatactgaatcacacaacagtgatacaattagcaacattcagactatgtgaaactctgtaggacaaataaccttgactcttcagcatataaacggaaagaaaaattggaggaaacctgtagaccaaatgagaattgagaaatgtaccaaaaaactgcattgtgtggacatatttaaatcttaattcaaagataaagatttttaatttgaacactgtatgaatattttattatattaaaattttttcttaattttaagctttgatgtttaaaagtgtgtatacacacttacataacatgtatacttgtgtgtgtgtgtgtgtgtgtgtgtgtgtggcttcagtggttaaaatgatatgaatttgaaattggttttaatattaaaaagtgagcacgtgtagaaatgacacaatattgaccatgtgttggtaattactgaaacagggtaatgatatccaggtgttcattacactattttatttatctttatatgtatcaaaataccataatataaagttcccaaaaattatattcactgaaacacagccagctaacttcatatcagtgttggtaataatttgccaaacttataaaaaaaatctttttcatgaataatattgtaccagttccaaatatttttattcatcagctaccaaaaatatatattttagcaatttctaaagagcagatttatctgaatttcaaatacgtaacataaagataaatttcacctcagttgaatttctctatgaccttcattaagtaaacttttaacaaggaatacatctgcttaaagggagtataccgggaccacagaatccctgtgtactttcttaattaggtgttttttaacaactcctcttaacacgagccaaagacctaaaaaatctctaaggagtcattcaaaaatacaggcagaagattcaaaacacaatcatgtagaaaaagtcctaacatgaactctggcttttctgttgattatatgacattaaactccattgtgaatcttacaaaattatttttcttcataaaataaatcaaatttggctggatgtagatgttggaaatgcaaaactattaagttacatataaggattagaggtacccatcatgaagagagagccttgggtcaatggaaagttttaaatgtaaaactcaatagccagagtcttttgttttaatatttaaatactagaagatacatttcatatcattcttacatattacaaacattcacccattcttacccaggaacaatcattttgtatttattgtcctaagaggattttgtttttgttaagctgataaacacttcttccccatatctttgaaattaaaaaagagtaaatatcttatgcaagctttctattcagtgttttatagtatcagtgtaactgattattgaattcaccagttttaagctgaattgtcattttgtctatttaattactacataaaataccataatttgggaaattggatgaggaagcttatctctatcaaatataaaaaggaaaaataagacttttttcctcctggattgactgttgctttaatgagatagtttgtattttactgagaaagaatggagaaagtaagcaagtcaaattaaaaggaagtctatctcaatgtcagctgtcaatccaggagactcccagagcaatctttcaactttcaggcagatttatgactgcagtttaaaactagcagtgcctgagtggaaatttataattattctaatcaaattattgctgagctacaaatcataattagccagcttaattggaagataaattaaatgtttatttttattccacttttgtcagatgcagaagttgtaacctgtctttagtaattatgtgagaaaatgttattttaaaatgtcaaattttgttttgtttctgacgctttaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccaggtacttatttatttaaaatgttacagtaaatagcacaacaatgtaaataaatatgttggagaagtttggagatttgatgagttccacatttttacagtgaagccattgaaaagcttcaaacagcagcatcaataattgtttcagatttgcaagcacctaaaacatccactaaaatcttgaagagggatagctctggtttttaaatttcacttcagtatcccgtatgaaaatgcagccctcattttcaacatctggaaactttattgcgttatttttggtaatgaatctaagcagtcacagtgagacaaatatcatttaccaacagtatttagcccgattttctgttacgctaagtagctgttgatttacccctcgttcatttttaatgaagcaggttaataccatattctcctacagttaagtagcttcaggagcctacacacttaaattgattagtaaagttaaagtaaaaggaataattatgttcactttcttaaaagaatatattttaagaacaattccttaatgagacaaagcatctcctatttatgtttttggcttgtattttattatttggttttctttaaacaaaggtgattacaatatcatgtccttttccataaggctttttctctagataaatgaactgaaataagtttaaccgctaattaactggcactaaaatttaattgggcccaaagggtgaagcactcaaaatttattaactctcattttctagccctttcaggagagctgcagtgttagcatggtatctggattccatagaacttcacctgtgttatcagccaaatgtatatgagtacattcaaccaaagccttagattaggattttaggcaagtatttccaaacgtgcagggaggagggtgtattgtgaacacacacacacacgcatacacacacacacacattacaagaaatatttctcaaccccttttattttcgactcagactacaggtaaataatacgcacagttggcactaagaaggtccacagttaggtgccgactcagtaactgagtctctagctacctttacagtggactgcacagaacaccatatactctcccatcactgaatggggtgacaggctaaaatcagctattggcttttagtaaataaggtgttatagggaagtgcatcagtgtaattggaacacaggccacctctggggctgtcacattttctagtttgtttgtttctactccccacatgaatctctgtttacctcctttctcacagtgattggttttgcctattttttcatttcagagacatatttatgaaactactctgaaaaatgtttttctgctacacaaactcatcaggcttaaaaaacaagtgaatcactgatttcaaaaagaacaataatgaatgtttaggtgcttgtcaaaagagttagtaaatatacaatttagctgctgcgttcaagataactctctttgatccatttgtttgaaaaatgattaagattgggaagtacaattaagtgaaaatttgaagtgatatttgtttagcaaattgatagtagcagcctaattaggaaaatattttttgaataaaaatatagaaaattgtataatactacaggccatttgattgaaatgtgtttaacatatgcattttatgacattaaaaggctggtgttcaagtaagctttttcgtttttgtttctgtcttcccttaaatctgggtcttaaaaatgtcaagcttacttgtctttgaaaattacactgcacatatacttgcaatatatttacttattactaaacttaatttatcttcattataatatcaaataaattatcaaatcatattgaaatgatataatttaaaaatatgaaccatacattgctcacttgatatattgatttgattgtataatttgttcctcaatttcttacatcatcgcatgaagaatttcttttaggaataattaagaactatcaaaagaagtattaccagaaagacaatctggatgttatttttcattacatagcattgatattcggcatgttattaaaatgcaaaattagttactagtaccttcagattttctccacaaccgcaaagaaagtgtattaatttatccagaataagaaattataacttaagccatcagaaaaatcatgaatttgtttacaactgatttcatgattatctttgtaaattttcagaggaactcttactgtgaataagagcattttcataaatggtgaatcaagaaaatgtggattcacaatgattagggaaccatgacattcttctcttacatacaaataattctgatatgaaaagctatgtgatcattttaactatatcagaattagacgggtttttttacagataaattaaaaattctaaataatacctcaacagtatgaatgatgaactaatttactttgctttttgaaaatatgaaaatgagtgcacaggctgaaagtgtgtatttgagaattaggtagaatatattgagaagaaagttttatactttatggctaaaacccaagggctaaagaagatgtaactgagttgttgtcagtggacagtctgaaatttgacagcctcatagaagatttgatagcctcgtggtgtaaattctatatctacacaaagaccatatgactctgaaaaaagtttgtaaaacaaaatctcacttttcttctctatagaaaaattgatcatatcaataatatgtatttcataatattgatatgagaattacttgagaacactaatataaagcaatttatagattttatgacatgtaataaatacctaatgaacagtcaagattatcattatctttatgaaccctaattttcatcctaatattttcttgtttccatgtatattcatgcaagagatagaacatcagtgtttaaatgtcactaaattgtctttctatctatctcaaggacccaatctagtataaatatttgagagtatagttttagtgactgagaatttaattataaataaaaactgaaccaactatgttgtgcataacttacaaaagaagctttattatccaattatttttgtttctgtttagaataatgaaatgtgtatagttctttacactaaatattcactcttccttctccctggtgatagattttaatcttgatattaatattttgcctcatttaatgtaatgtggaaataatataaaatcattaacttggggaataattaacatacataaaaagaaaatcttgattttgatttgtccatttcagatgtttggaaactaaatgatccctctttccatttgcagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggtattgcatattaatttacatcaaagatatattaacaatgaagcaggtttaaaatttgaaggatatgttttggaagtagatgatttaagggtctatactagaacttccttctacaaatatgtttaagtaaaatatttgaaaaattagactatgcatcaaaattttgagaaaagggtactacatattaatgttattaaaatatctcagccttcacaggaataaaagaagtttagatatgtttatttgagcaattcgtaagtttttagaccttgttcatttactaggttcttaagtacaagaatttctttttcaaaacaaaatatatttttgtatctcataaaagcaaataagataatcctgcaagatatgcataaaaataggaaaagtgaatttattagactctattgtatacatcaaaatcatgaagaaaaaaccactaagacaaaactaagtggttgaacacctgtgtgtggctgtgtttattcaaagatacttttcaaaacccagtgttgttgttgttaatattttaaatataatgcatttaggagagaatggtttccataagatataagaattgactgtcttggaaattagaaatgtctttccagtaaaggggaaattgtgattatgcacaacttctctcagttattcactcaaaaaatttttgtagcacaatatactggaaagtttaattcaaaaatttacttaacagtgacaaataaatgtgacttgataatggccattttaaattacggtaacatgcttataactactttacctcattacttgattcattagccaatgattccaaaaatacatatttcatcatataattttctgattcttgatttttaacattccaggtaggaatttaaagatgtatttctacattgtttggaacataggtctttaaatacagcagaaacaaatttgcctgtgtaatatatatcaagacaaattattatgagatgtaaatagcactttaaattactctattttggtaggtaggcaaagaaacagttcaccttcctcatccctccctctcctcctcccccttctccaccttctactcctttcccttactgccctcccctctgtctccttattccctctcttcctccttcctccctctgcttcttgcttttcttcctctgccactgcttcttcttcttcttgcatatattatgatgtaacatgctaggaatcttcctttgaaactatagataaaattgtaaaggagataaaggagttacctgctaatatgaaacacattttagttatatacaaataagaaatagttattttaattaaaggaggtaatatatgatcatgtatagtataaaagtgttatgtatgggtgaggtatgatgattattaattgtctggaggaaacgggacattttaggaggtgatatttgaggtgaattatacaaagaggccatccataccacattctaggaaaaaagaatccatagcagagtgctcagggctgtatacatcaatatggaagtcatcaacatataacacgtatgtcaggcatggcaatgaatgagatccctttggcagagaacgtagctggagaagagaaaagcatccaggctgacttgactgttaagcaaaaagcagtcggctggcaaattagaatgagtgggattggcaagcgttgtaggaagaagggaaaaatatgagaaaagatgttccaaaagaagaaatccctcaaccgtgtgtaatgctgctgtgaggctaagattaagacagagtggtgacttttgatttggtaagttgaagacccctggttttttgataagtacaacagtttaatttgtgctattacagcacactgaagactattgtatggcataaaaggaagaataagaggaagtaataatgatttaagccaagtctaaaaggtgttacgccacagggagaaaatgaaatgtgagatgctaggtagaaaaagatgaaggtcaagaggactttttgcttgtttacgactattcaattgttttttaagaaaggaaattgaacagcactgttatatactatggggaatgattccagagaataatattatttgaagcaaagtaaaaggacataacttctaaaacactgttcttgaaaaaaaaaaaaaaaaagaaagggtcatggaatccattgtacttatagaagggacagattatatgttaacatatttgttcataaccaatcagttaataaacgtttctattttgtcagtgaagcataatgcgaaggcagtaattgagagagcatgggtaaaattttagagaagaggaggtacaatactgccattttacagagttgggtagtgaacccatgagagaattattggtatcatggtatcagtgcagccccactgtagatgttcagagagattgcaaaagatggtttggtctgtgcaatatctagcaagcacaaatctctttgtgcattgcaatttgagatagaggtacaaattatcttttcaatttgtgtaatcaatacatactgtgtgagtgccagttagggtccaggctttgtatgaaatcatgcaagaactaatgagcactttgtgtaacctttccatgagagggagaggccagctgagtgatggtcagttgctattagaagtgttatataatatggaaataggggaatatttctattgctttgccaaacttctagcaacggtttccttctgaagcattcctgcatttttgttgactgtgaagtaaataaatcaattaataaaattatatgtgatttatcttttttcctcaatctcagtattaaattaatgaatactgcgggttttattacctaaatataacttcaattcttcattatctttctatatccacggccatttaagtttttgaatattgaccttacttccaaatttcctagccagctactttattcttcaaaaacaactattgcaaacattttgctgtttctttttcttacatatatttctgttgtattgaagtgaactgcctattattatatttgaatctgcacttgaactcagaatttggtttgaattactgaagggaatccatatttcattatgtcatgagataaaatcaagaaaattattaacttgttgcttattaaacacacatttctttacaagtaatgatgggcttttactgactgcatttatgtttgaaatgaaattaacttcaaactagaactttcaagtagagttgagataaaacattatgctttcccaattgtcactttggatttgcaaagttactatttttctgccatccaaaaatataagatttattagaccacaagtcatagagtgactgagatttggaaggattgaataaataaatgagtgagtacatgggtggacaaaaaaatgctaaataagtgattagaatagtttaggatataaatagaagatttcgggagatgtgaaattcatggaaatcattctgaaattgtatctgaatagccagcctatcaaatatgtaatcttccatttcagtaatatttgctagttttacctaaaaccttataatgtcaaaaaaaaaaaaagaaggggcatttaaaatacgtgtagtatactacttaataagcaattaaaccaaagcagagtcgggtaacttatcttctgcaaatcagcacaaaatcctgctaaaagtgaaacatgctttagccagtcacattacgtggaaaacaaccataataaatagatattgatattgtacacattatgaatgatcattagtgttaatagactttgtttatatgtctgtgtatgtgcaaatgcaaaaggaaaatttaaaatctgacttccttaaaatttagtttcacatatttctgcctaataaaagcaaggagaatatattgtctagtaaaaagactatccactctctttggagcttttccaaataaatatcctccaccaaatttttcatatctgtagtcactgagggcatcatttttaatattatcaagtgtccaacattccttccacttgcaataaccatttccttttattttcaaaaccagatgcttttgaaaatgaatggggataactagtgagtaagactctgtttaccttactatttaaggaagcttattttggcatttcagattttaaattcaaatataatatgttataatgatctctgtaattattatgcaatattttaagttgcattttttggaaaagcatatagaaaatttaatattcttcatcaacaatatggtacaatatgtcataaaggagagcttttatagaaatattaaattcaccttaagctttgtatggaaaatctatacaaatttaatttcagttaatactcaggaaaataaaaaatcatgaattttcaaaatttatcacatttgtgaattagattctataaatctcttgcctttgggaacatgagttgaacatgactgagactgggatgaatttctcttcttattcttctaaatataatattgtttgatttattaaacacagtctaatttgttttacttaaattccattatctcagattataaaaagtagaggtgtcaaaaatgcagcacaaaaataataaaaatgacctagtttttaggtgactatggacagaaaaataaaaaatttgaagaacactttgcccagttaagatgacaagtgagaaaatattatctgtttcctgagtttcacttcgagactttaggttgtagagtaattgcagctcaagtataaatgcagcaagaatgggtcagtcagtactggtagaaaaataattatccttgtactaataaaataagttcccaatgtgaaggagtgagcagatatacctatacaactcttatgtcatgtatttgatcatttgatcacctcattcatcttaatcctgttttattgttgcagaaattacatatgcagagtgtggatcactataatattatttgatctgtataacattgaagttgacaattatacaacccaacatctcaataaatttgtttcagattaatcaaagtatacttgtactaaaactggatgtaaaaatagcttttccattaaatttatatctacattgtaagaaaagaacagttaatctccttactattgaattcaaaatgaataaaatataacattctaaagtaaatgtcattttgaaatctacagctggaatcttggcattcaaacactatagcatactgtggcacctgtactttagtattccataataaatgtaagctttaattataaaatgccctcgccacaggttgctaatttctctattgtttacataatatctaaattagtctgcataggaaaacttttcactttttatgattttttgtttatatgcttcccataatcaccagtggataaagcattctatgtgacacaggaaagaacatcatttaataaagttgtaagccatgttaaacatctgcatgagaatagtttcatcctctgcataactcctggttaataataaaatttacataactcaacagagacagagttacactacctttacctcaggttttactcagtgatggcagaatacatctgatgtttggataaattattattgatgctttcattaatgctctcaatctttaaaatttctatgtagttttatacaggttagcacctttaaacattacaagaatgcttcatttcacacacacaacaaatatattatcttctgttaagatactattatcacactaaaattttctgtcataaaaatgaaaaatatatcagtaaatgcaatttccagagatgaccaaactaacgttttcctttcaagcacgtggtacaagtgtacatcctgtgtcacctatgtcaggggttcccaacaaccaggccacagactggtgcttgtctgtggcctcttaggaaccgggctgcacagcaggaggtgagcagcaggcaaaagagctaagcctcatttgtatttacagccgctcctcatggtttgcattaccacctgagctccgcctcctgtcagatcagtggcgggattagattttcataggattgcaaaccctattgtgaactgcacatgtgaggaatctaggttgcatgttccttatgaaaatctaatgcttaataatctgtcactgtctcccatcactgccaggtgggactatctagttgcaggaaaccaagctcagggctcccactgattcctcattatggtgagttgtgtagttattttattatatattacaatgtagtaatagtagaaataaagtgcacaataactgtaatgcgctttaatcatccccagaccatccccatgcccactccccaccctgaccatggaaaaattgtcttccacgaaactggtccctggtgccaaagaagttaaggaccactgacctatgttacaataagtttctgcaaagaatgtgattgataaaataagcaaagtcaaatattgtgttgaacttatttttataaagaccttttgctatgaaaagttgccaagatttggaaactagctagaaagacataattaatattttaaatttgcaattatgaaaagtctctccagagtaatgcaaacaatgtcaactgtccacacaataatggaacccaagattacattagtaattatatttgtatgtttattatcagaataagtgaactgataagctactctaattaaagtatgattctaagagaatttttttttctaagcacacttttgttcacttagaatggatacaaactacaagtcattttgattctttgcatttccaaataccactggcacctctgatccagccacagtgaccccactcaggtatgcatgctgaactttggacccttcggtcccccaaaaagcattttttcactctctgtttacattccttgctaatttgatttcaaggatctcattaatttaaacttttcagagttcccatcatttggtagttacccaattctgcttactggatggtgtattgcagggaataataggacttaaggctgtggcaattcaatatacacaactcgtgctacgttattttcattttgtgtgctatcctggtggccactttatattgtcactgttgttttaaggtagattgagtgaccagatcttcagttttacccaggacagttctgctttacttctatgtttctgtcatcatgtcctagaagcatttgtcccagattttctgttttacaaaatgactattattaagtcattaaaataagccagagtgaatttttcaaacatttactttgtacttgtagcttcttccatggagtgtgagaaacagtctgtcagacaaatgagcaataaatagacttctcttaagatatagttaaatctgaaagaggacaagggataacccaaaggcactgtatgataaaatagttaaactaagaaactcattaaatgatgtaaatacttatgaagaatattcttctggtgctatatttaatgttaaaatcttctctaaaaaagattttattaatgttcatatatattatttgtcttttgttagaaatacctatttccagtataaaatgtagaatttaatttttgatccaccaatggagtaagacccactttgcaagtattaatgctatcataataaaatgttcatcaaatgaatgaagagagactaaagaggttaggtatatatgacctgtaccatgcttcatgttcttatcagataatgcaccctaaatatgctacccttcttcagtagagtaagaacaaccaatccaggctgggaagagtaataaaaaatatgtttaacaaattgaaaaagagatttgggctttgagaaaaatatcaaattccccaggactaaatatatgttttccataaatattatatacatatatttgccctgattctgaaatttttgcttttccccctctatttttctttttttctgaaagttttattgttctaatatttatattcttatttttcttattatttacctttcacatttggatctacagtctgttttaagctgatatttgtgaaaggtgtaaagcaggtgccaaattttatatcacaaaattggtgttagatagatggacagataaatggagatatcaagctgaccttgcagaatttactgaaaagtttccctgatgttcagctctgccaccttctggtgaaggggttctctaaatttgtgtaatcttatctctgattctctagttggctctaccagctattcattgctccagggcaaatattattgtctgaactactgtagttttgtcctaggcgtttgctcgttattagtgcaactactgtaggtattcttcttcaataaaattgccttgcggaagttgcagtgttcagagaccacgccattgcactccaacctgggcgacagagtgagacttcctctcaaaaaaacaaaaacaaaacaaaagaaacaaacaaacaaaaaatgcctggaccatacttggtccttgtttttccatacaaattttacttattttttaattgtctttccaagttaaccatttatacagtccactaggattttgattgagctagcttttaagctgtgtatttttttatttttaagtagtcatctaattcctaaatccagtattttcatctatttacttatatcattaatttatctttagttgttttgcagaggttacagtttttgtttagatattcctgaatattttatttcttttcatatatattatatatttaactaaaataggtttcatgaatatatatatgccagagtatatacatatatatattcatatattaaaaaatgcacttttatataacatttgtgtccctgttgacttgctaaatttatgaatttaatgtttttctgtaactatatgcatattttgagtttctagcagaaaatattattaactttaattatttagttttatttattcttttccaatatttatttatctacctgtctataaatgcgttataactgcatggtattgcctcattgcattgtctaggaagttcagtacaatgccgaaaaaaataatagtgacagaaaaacatttttttctttttattattgcagaggaaaagttttaactcttcacaattaaatataattactgtcaaggcttaaaagcattcattatcagattcagaaagtttccttttattcttaatttttaaaaagtttttattgcaaatgtaagttgatttttagatgtactttgttttttttatttttctcctttatataaaaaaattgaaatatattttccatggaaatacaattttaaaagtttcaagaggttacagatatggcctgtgtaaacaatggtccttatgtagaatagtagccataatattttagaacacaacagcaattcatagtgatgagtgggttgtttttaggaaatgggatgaccggggatgggagccgcatttctcataaacctcttcggagtgattctgacagtaaacaataatcaggacatgaacggaagtaattacataagcctagaaatcctccagtacttgaaaagagcattgtggtggtattcactatgactcaaacatgacacagttctgatattacagacaaatgctgaaatacttacatatgttcttataaaaaattatgtaggaattaaacattcgttgtctaaaccaacaagtgttagttaacctatatttaactaggaaaggggcactataagacaattgatcatttccactgaaagacactttattggtttcatagtaatattttcaattttatgtggacgataaaactaattcctaactacaggtgaatgtacaaattgatttgcttacaaataacaagtctttataaaaatataaatatttacaattgtgttaaatatttttgtattgctgtctgcttttatatttaattattattgtgatctctttatgttacttgactatttcttgaggatttctgccgaatacaagttactcattaggaaaacatacaggcttaattctctttaaaaacatagaaacaatccaagaggatttaaaattgcttaaactgtgttttataaatcatggtgtcaataataactgaaagagggaaaagaaagtagaaaacaactaaataaaataaacaaagataattagggtcctgtaaaaatcgagcattgctaagattcatctaaattttacagccaacatttccaaggcatgaataaaaattaagagaaaaactacaagcactaaatatttggaaatactgctgcatatttttgccctcttaaatatatatattatatatatatatatatgagatatagatatatgattagatacagatacatgtctgtcgcccaggctggagtgcaatggcgctatgtctgaacactgcaacctctgcaaggcaattttattgaagaaaaatacctacaggagttgcactaataaggagcaaacgcctaggacaaaactacagtagttcagacaagaatatttgccctggagcaatgaatagctagtggagccaactagagaatcagagataagattatacaaatatagggaaccccttcatgagaaggtggcagagctgaacatcagggaaccttttcagtaaatgtaaaacacacatttactgaaaatatatgtgtgtatatatacatgtatatatacacatatgtaaatacaccatacttagatctacctgtatacatatatgcctatatatacacataaacatcttctcacacacaaaaaatgtaaggagtgaatcacttaatactcattgatagtccttaccaaaaagtaagcatttctaaaacattgttgaattacaccaattctatagccttggttcttttaaaatgccacaagtgtcataagaaagaataacaaatatttccccagaaattaaaatccccatcaaattcatgtgtgagtggtattctgaatatttataatatcacagattttttccactaaaatttctaagaatttgaccttttagattttctacacactcagggaaattattttgtgtaatctattaacagaatacattagattctccacttagtagacaacaggagaaaaacactgaagaagtaacttttggttacaagtaaatgaagcatcagtaaaaaatgttcacctgctctggcatgtcactacctctttgctttctatgggtgtgatcaagaggagacctgagagaacaggtgtacagtaggttactgagcaggcacaataatccaggtgtgtgtaaggagtacacactggtatcagatacaaagggaaatcaagagaaatgagagttgtttccatgtctttgctattgtgaataagtctgcagtgaacatgggaatgcagatatctttactagtggtgtatttcattttctttaaataaatacccagtagtgggattgctgggtcatatagtagttttatagttaatttctttaggaacctccatattgttttccataatggctacatgaatctacattcccacctacagtgcacgtgttcccttttctctatactctcaccaacacttgccttctcttgtctttttaataatagacatcctaacaagtgtgaagtgatatttcatagtagtttttatttgcattttcatgatgattagtgatgttgagaacccattcatataaccattggccatttatttgtgtgtgtcttcgttggagaaatatctattcaggttctttgccaattatttaatctgattatttggctttttgctattgagttgtatgagttctcttaaataaatcccttatcagatagaggaataaagaaagaaactgtgtcatatatttacagtggaatattattaagtctcatcaaagaagaaaatcttaccatttgccacaacatggatgagcctgggggacattatgctaagtgaaataagccagacacagaataaaaatattgcatgatcttatttatatgtggaatctaaaaaaagttcaatatagaaagatagagaataaaataatgtgtcggggatatgaggagggaggaaatggaggtatgtaagtcaaagaatacaaagtatcagataagtaagataaacaaatctagagatctaatgtacaacatgaggactatagttaataatattgtattatatttgagatttgtgatgagtgagtagattttacttgctctttccatgcacacacaaaaatgggtaactttgtgagatgatagatataatttgctttactatagtaatcatgttactatctatatgcataacatgttgcataccttaaatatatataataaaatttattttatagaaaaagcatgctaaaaaaactggactggaaaaaagaacctaactgtatgacatatttctatcatcaaagtgtgaggtcaccttttgtgagtcattgcattttctggacttcttggttctcatttgtatagtactagcttaggggctctaaagactgatattactaaaatttatttcagtcaactctgaaaatggtatgattttgatgattgtatctgaagccaaagataggaaatataattctagaaaccagggatgggaaccccttatggaaagaaatgatagagaattataatgaggaaatgtgggataagtaagtggatcggtgcatagaaggatagttaaaggaacaagtcttgcgcaatatggatcaatgaaagtgatggtccctgttaactattttgttggaaaaactttcacaaattactaaataaattcactttaaaacatctgaaactagtaagtgtctacacattgagtggttattcaataagttttggaaaagagaggcaaaaagttttcctgattcattttgaatcaggtaaaagtattacccataaaattatgtgaataagaagaaattctacttcaatagaatatgctgtatgatattaaaacaaatgttaaatagcattataaaaatattaagacaaaagagcaaagaatatgtactatttagggccacagcaaaagtttcatgttagtgaagtatagaatggattcctattagagtgtatcagtttataaaattgggctacgatgagaaaattcatgatgctagttgtaaacaaaaccacagaagctatttgattttgtgtcattcgtgttgctattcttattgacacagtaaacagtgtttcaacaaatacatatttcaaataagatccataacattcaattccatgtttacagaaagatactttgaaaactcaatatttttgaataaatattttaaaaatctgagcactaattttaaatgtatacataattattccatatgattttatttcttgttactgaattttaatgagaatgcttatgttatcaatatctgcaagattttactttgctttttaaaaaattcatcaaaggaagtaggtatattagagaagagaattaaaggagctgaataattatgcccatccttatcctcaactggatactctttcaagctcaattcaataatctttgtaaatatttatcaaccttctccactttgtttaaggtacaggctacactataatttttggtgaaaagcatttccaagttccttttaatttctccactaataatacaccttggaaaagtttatgatttataaattatacattacaatgaattgtttaatagctacatcttattaggccatcaatctacatgtttaaaattccatattgcatacaggaattaggaatattttgtattaaaagttatattcttttgcctgaaaaaaataaaaaacaacaaaaaaatacattacttttacaattaagaacaaggaggtgaattgagctttcattttgtaacaacatcttgcttggtaaagaaagaccgcttcacagaactgaattcatcctgaataaaaccacaatcttaatttcctgtattatgttctctttaggaacattagttatccaggtgacagcaagtgatgctgacgatccctcaagtggtaataatgctcgtctcctctacagcttacttcaaggccagccatatttttctgttgaaccaacaacaggtatttgtgaatgaaacaagcaaagtttaacatgattctaaagaaggcaattgtcagcaaaaattatctgcttagaaacatgttttacagtagtcctgatatgtcaataagcaaaaagattgcaattcctaagcatttaattacttttagtcttttagctgatacttctaggagactggatttttcatgtccatagcacaaattacttatgtatgtggtttaaatcatatgtaaagattcttttaaatgaattagaaaaagagaccagcaacccaatttaaaaatatagggaaaaaacatttataagcaattgacaaagaacaatatacagaaagccagtaagcatattaaaaatgctcagcctcattagtcatcagggaatacaaactaaaaccacaatgaaatacagctgcataaccctgcagaatgactgagattaagtctgagtataaggctaagcgtacacattgatatgagacattcacctaaaaataattctgtattttacagatttctgatttacatgaatacaatatttgattctttttgtaatattgctctaccaatctgcattaatcaattgaatataaaataagtagaacacagttttctcttttctttaaacaatcatatgaccctaattcattaaacaaaaattaatttttgtgttttaaacaaagattaggcccatgtaattttttttcctttagaagattatagtctccactgaaaaaatatatatatataactaatcacccaagaacgtgagaagtgccaaagaagtaaaattctatggtttttaatacaaggaaaatactatttccagcttatatcaaaacccttaaagaattaaagtattgtgttggatctttaaacatttcttatttattcattcagcaaatattgaatgtctcagcctttttcaattagggtttcttgagagagtcagattctaaaaaatattatttgagtacctatgttcttaattctctcaggaatgtacatggcctttattttttcaaatgtatggaagaaaaattattttattatatgcaatgaatgcctcaaaacattagactttaattccctcacacattcaggtctagaaaggctgaatatgtaccaaatgttatacaacttgctagatttataaaggtacaaattgcaaaatttaaaacaatacataatagtaacaaaaacaagatataataatggactcttctttcttggaacttacagatagatattaaacatgaatagtaatacacacatacattccactgtaggtacttatgaagtaaaaccaaaaagtttcagtgggagaaaacaagtcaggttgactttatgttgtgtggtcaaggcagaatacacggaaatcagaaagtttagctgagtctgtagacaaggaagggagagtggaagatgatttcagggcatgggaaaaattagggaaattcctgaggtgggaaagagttgaaactcttagaataactgaacaccagtgtggagaaatgcagaagagagaagaaagggaggtgtctagagtacaaacccatgctgggtcataccaggccttcgtgaccatgttttctttccacccccagcccctaccctgcacactgactttttaactatactgagcaggttagctaaactattacttgcattgctggagaagcgttggtatggacaacgacaaacatggattaaattactgaaagcataagttctgaagtgcataagatccagaaatacatatcctttattcagtcaaaaggctgagaggaaaagttgaaagcaaagtaggcacagttaatggggaacaaagactcctaggtccctctcccctgagtcacatacagggagacgctagcagcacttgtgcaacatattgaatgctttccattggattcaaataattgattacatgtgtgaaacactttagtccgcaactaaaatcccctcatgttatggtctaatttatcttttaaaagttcatataacaattctttaaaaaattatattatattaaatttagtccaataaatcaaaaatactaccatttcaacaaataatacaaaactatggagatagttcacattttttgttctcagtctttgaaatcaggtgtgcattttatactcatatgtcatttttttcacaagtttattgtattctttaatttacttttattttaggttcagggcgtaaatgtgcaagtttattacatgggtaaattctgtgatgctgaggtttggggtactaatgatcccgtcacacacaggtagtgagcatgctacccaatcagaagtttttcaactatctcccccactccctccttcccctctctagtagtcctgagtgtctattgtttccatctttatgttcattaatatcacaatttttaatgaatattttgcccttgatatatttgggtattgggtattatttattttttgtgactgtttatgtgttccccaaatctttagaaatgttgagtcctctcttatgaacctgtcttaagattttcttaggttcttttcagtgatagttaataaatgtatattaaataattttatagaatttaagcatttattgcaatatttatcattaattatcttgagtttgaatatattatatatgtgtatacacacacacataaaataactgggtcaacaaccaggtcttcttcagatctcataattctaagtagacttcaaaataataagggcatgacatttatttcataaatttggtattataatttacaaatctatcaataatatactaacttcagagtttcggggacaaagttaactgtagcaagccgatattatgttagaagagatagcagaaaataggttaaagtaaaaacaagacattcttttttttctacctgtggattatcttaacatagtattttattaagggcctaccagtgttcctaatattgtgatgatcactctagactctaggcagtgttgatgtttaatttattttttattatttttctctagtgaagtctctgtcacattgcagtggttcaacatatagcaaaataatgtatactgcaatggttaagaaattaactagaactttgtcatgattaataatgaaataattggaattttattatatttttaaaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtaagtaaaaaggattctacatcttcattacattataaatatgagtgtgttaaatataagtagattatatagttttcattctaaaagcactacattaacactaaaattatataaaataaatttgtcaattgttctggtatgattattttaattcatgttaaatgttaaatacaaatgaaagaataatgtgttagtttctattcttgctgtaataaattgccactaacttcatggcttaaaacaaatgtattatgggtctcattgggttatgatcaaaggattcagggaggcatttcttgctgtaggatcctagttcatttaagggttagcagaattcagtttacatgtatatagagttaaggtctctgttttattgatggctgtaagctgggagacatccttaattcctgaaggcctctttatggctcttgatttagcccacacatcccagaagcagcaaggagtgtcacatacttcacacactgacaaccctctaacccacacatttgcctcttccacttttaagcactcatgtaattagaccgaacccagttggataaagcaggataatgttcccatctcaaggtcagctaattagcaacctgaattccatctgcaaacttaattctcttttgccactttcggtgacatatttatgcgttcaggggaatttggacacagatatctttgtggggtccttcttctgcaaaccatagataatcatttaaaaatgactttttgtatttctttttactttataagccagaataggccacacctgctctaataatttaagcaattactgcaagctaaacataaacacatggtatgcttcgtaaaattttcttatgcaattattggaggaatttcttttctaggaaatttatttttcaggttatactgttttagctacaggaatacatttataagcacttccagaaagcataagtaattatcatgctaggaagaaaatttaattagcatggaacaaagaaaagagccaataaaaatatataccatagcatgatttcttagttattgattgtttatagacagaaacaaaactatcttttgattacttttttttcctcatccttttctgttccttgccccattcctcaaagtcaagtgaaatcatgtcatttttaatggcccaagtgaaatgctactttcactgacttccttccagtagttgagtccatgaataagcacaggaagttggcatcatacaaatttgcttttaaaccctgaattttccattcattagttgtacagacttgagaatatctgttaatgtgtgtgcgcacacacaaatgcccacacctaaatgatacagacaactactcagtgtagccaacatatgcaaggttatcagatcttttgatttttcaataaatatcacaaatctcattttttaatttctgctctatctcacaattttaaattttgtcatattaaaaaattaccactgttatatgggttgagaaaacagttcctctgtggatggactataggcaaaggggtcagagtctgcaccttcgtctctctctgtgtagtgtcacatatgatgtatatgatacatatgttgtcttctgtccacaacattaatatggcctctgaaggcaagaggagaacaccaagttaaatatgaaatacccagaactttataaaataattggcatataatatgtgggaaatagtgtctggatttattaaataaatttggtctaaatttatgcagatgattattaaatagcaagtagaagactctggaagacaggaaaattcccaaggaacttgctgcgataaaatatcctgaagcttctactacctttctcagtttccctctgatttttcctgactttaatattaaaatattttgaataaattagaatatttaaaatatcttttaaaattatctttattactcaagtctgaatatgagatgatggtattcctcttaatactttcactcatatacgagtgtgggtgaatctgattctggcctccttactcttgtccacatggttttcccttgtgggaatcccattaccctcctctcaatgtaaatactcaatacctataccctctgttgtgggcaacacttcctaccctcccaattaaaggcatctctcaaacatccctctcccttgtgtgaacagcgtcctctgctggttcatatctatcacatcgaaacatgtttattattgttttttctcacatcctaaaacaagacaaaacaaaaacactttcttgccttcacttccatacttagctaaagatgctttgtattcttcctttctctttagagaagatttatttaaaatattgttcatacttattgtttccaattaacgacctcaaaatctcagaacttactccgtttgagttacatccacactacttgaccaaactgatctgatcatttctatcaataacctaaatggaatgcagtgtcaattctcagttctgataacacttgatttcttggaagaattttatgtaattgatcaacttctccttgaaaaccttaatgctccattctcattagctttttcttctgtcttactagtctctgttttttccttccttgccttttcttcttctttgtatactttaaacttcggaacatttgtgagtcaggcctttgatctcgtctttcttcccttttatactcattcctttatgatcttatccagacacgtggctttacataccacctctgggctgagaacctcatattaaatatacatctccagactgaacttctcccttgagcttcgcaaaagtaaatctgtctactcatcaacttcatatattatatatttttttaaaaaaaatatatatatataaaggggttcagaggagggggcagctggaatcaggagctcagttaagtgtatattaggttttaaatgtgcattgtatatattatatatgtgtattacatataaatgcatattatatataatatataatattttatataatatataacaaatatataatatatttatatataatatacattcaatatatatcatatataatatatataatacacatatatagtatataatgcacatatattacatatataatacacatatatattacacatttaaaacctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaacctaacacacacttaactgaactcctgattccagctgcccctcctctgaacctctttttccaacagattttcccatctcatgtacccacacatccaggtttcatgttcttcaagccaaaaccttgcttattcgatataaacaccactgtttgaagaattagaagaattagtgatcccactcagattatggtagccatacccaggtcaaccataatttttcccccagcctgaattgatagcctccacaattctgatagctcctggctttcaatattcttggagcaaatgcacatacacaaaacacacacatatacatacgcacacacacatacacacacacgcataccctcttccttccttgcataaagatttgaagctactttttctacttttctttttctcagagttaaaatttaattccctgcagatgctgttgtctctgccttagaaaatatccgaaatatgaacacttctcaccaactccatccctagcactttggcacatggcaccatcttatttcgtctctattagtgcaataggctctcatctagtctctttgcttacaccattgttctcctttagtttattttcaacacagctttataatcttgttaaaatgcacgtctgatcatatcacttgaaggtcttcccatctccctcacagacgtcaaaatccttaggtttagtatcacctaaatagtcctaatggtctgaagtaatctgccattgtccagtcctgtctcattacctcttgaaatcttagtgtttctatctgcctgtttgcttactaagaaaccaacaccaggcaattatcctctcttttcccagaacactccaggctcgctggcttttcctcttcttgaaattatatttccccagatactcattttctttcttcaattcttatccaaaagtcacatctacagtgaatactttacaccttatctttaattttaagccattccaccagaatactaccttcttatataccagtatcttatttactgtctgttttatcatcaagaatatgagctgatggtggcagcttttatgtatattgtcacctgttctatctccagcctctaggacaggaccttgtaaaaattatgttcaataaaataatttttgaaagtatggaaaattatgtagacaaaatattgactgaagaaaatatttcagttctttttcattttgaagaccaatagtttaatatcaactcaataacatttaagtcttaaacatctgctttcacgttcatggcaatgtaattgttttctacagattaatgtcagtgatttttaatcttccaataacataaacaattcttttaatttttctataatgtaaaaagcactactatatagtcagtcttcaacttctgctctaaaaatgtagtaaaatattagctcttaaaaattaacacttattccacttaaaaagtaaggtctcaaatgcaatctttgaagtgactgcctcctccatgcttctaaaggaactaggaatccctttaaagaagaattttattatatgtgcttctttttagaattctaaggagttccattctttaaaatattgcatgtttgctgatgccgcttgacatgagtaatgtcatatattaacatggatgaaaatgcaattgcaaataataatttaaaaatagtatagttctatatcagttttacacaagttactcctgaaaaataaaaaaaaaaagtgcccagcaatttgtagttatatttatgtattttaaatacatctgcaattatttcttaggaccaaatcaattaggtcatctttgactacaaaatgttttttatattacattcacttaccaactcctttcgatctatatttccttgcatttccaggatggctgatgtaatgcaggctcagaccctcaaaatcaaactatcgttcttggaactctactatttgcatgcagactctcccacctttattccacatgtatatttattcagtaacttcaggtatcaggaatgttagagtaaaattgaaagttatttctgtcaaatttaatttagtatggttgaaggttacaataaaaaataaaacatgaatattgaggagacatgcatgtaaatagagataatattggtgatagactttcctaagatatatttgagagatgatgatagatgctcaaataggagattagaaaatatttatatttcaaaaagaaagggaaagagactatatatgggggcagagagaggaaggaaggaaagaaggaaggaaggaaggaaagaaagaaaggaaaaagagaaagaaaaaagagaacaaataaagaaagattaagaacaagtaactgggaaaggtagatacgggattccctacagatcaaaaataaagaatgctacaattgcgacccggcacggtggctcacatctgaaatcccagcactttgggaggccgaggcaggtggatcatgaggtcaggagatcgagaccatcctagctaaaacggtgaaaccctatctctactaaaaatacaaaaaattagccgggcgtggtggtgggcgcttgtagacccagctactcagtaggctgaggcaggagaatggcatgaacccaggaggcagagattgcagtgaaccgagatcacaccactgcactccagcctgggcgacagaatgagactccgtctcgaaaaaacaaacaaacaaacaaacaaaaaactataattgcaagttgtctatattaagtatttatccaaaatacctccaattttgtttttaaaggtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaaggtagacatgttaaaattatttgccttgcagaatagcgcaaaattaaaacataacatattttgtgtagctggttagtttttaactcattaaataattgaaatgagaaccagtaatttatgttttatggagacaaggattttagagatgagagagttattacagagtgttttgaattatatgcagaacatttttttaattctaataataaaactttttggaaaatatcttaaatactaggaaattaattctcagtttcattagatgtttatgctttcaaaagtataactttatctccaaattaaaataggtaagtgacaatacacccagatttgttatgcctgattaacaattatatcagagagatccatgtacataaaaagaaaaatctaactgaaaggccactgagacttaatttaacaggtaaaaccttttttctaaatagtatcttgggttactaaagccatttcttttgtgtatactgtgtttctttgcagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtatgtctgtaaggtcagttttgcattaataaataagtaaatataaaatagattaaaaataaaattgcatgcaatcttttttttaattgagagggagtctcactctgtcttctaggctcgagtacagtggcgcaatctcagctcattgccacctctgcttcccaggttcaagcgagtcttctgcctcagcctccctagtagctgggactataggcatgcgccaccacgcccagctaatttttgtatttttagtagagacggggtttcatcacattgtccaggctggtctcgaactcctgacctcgtgatccaccggcctcggcctcccaaaatgctggcattacaggcttgagccaccgcccctagcctgcgtgcaaatttaaacaaggttatatctgtatctatatttctgtatgtcttaattaatttgtaacaatttaagcaaaatagggaacctcaatgtcggttaagatgcagtaaaattggtgatttcaaacacgtgcaagaaggaggcaattaccaattaaaattcagtgcattatattccctcttaattggggaaaggagataagaggaaaacaatcgttttttaaaaagccccaattagagctgaaacaaagctgatcaaaatgtggcttatttaaggcagcgcgcggtggctcacgcctgtaatcccagcactttgggaggccgaggcgggcggatcacgaggtcaggagatcgagaccatcctggctaacatgtgaaaccccgtctctactaaaaatacaaaacaaaattagccaggcgtggcggcgggcacctgtagtcccagctactcaggaggctgaggcaggagaatggcgtgaacccaggaggcagagcttgcagtgagccaagattgcaccactgcactccggcctgggtgacaaagcgagactccgtctcaacgacaacaaaaaagtggcttatttaaatactatttacttgaaatgatattcaaaaattgagaaagcttttatagcagtggtcctcaacctttctgccaccaggaaccagttcggtggaagacaatttttccaaggtcgggggggtgaaggggaatggtttcagaataaaactgttctgcctcagtttatctggcattggattctcataaggaggtctcaacctagatacttcacatgcacagttcacaacaggattcatgctcctatgacaatctaatgctgccgtggatatgagaagaggcggagctcagacagtaaggctggctcgcctgccctcacctacaggccatggacaggttcatggcctgctgttcatggccttgggggttgggaacctgtgttttacaggataccacttaaaggagttcaaagggttagaaatctattcttgtattacaattaaacagatatttgccatctattaaaatagtctgttattttcagttactatgttataatttattttgcttttgttttatattttgtttatttgtttgtttcagtagttgaggtatagtctggttgggcataaaaaaccaaagcttgttacgtaatgatttctccaacacctttccttactcacctattttccagaaaccttcatatattaattaaaatgctagctgctccttggctctgtgaaggtcttgcagtagctcaatgaaaaagctcaatttaatttttgataccaagaaatgttcccacttttccattatagttccagttcataaaatgttgccttctgatacgcatatgtagttcttaattagtcatagacattttagtgattgtataagtgcatatcaattttttactttaaaaaatgtatctgtatacctattcattgttcttcagggaacactaaataatatggaatgttaaaaaatgctttgatgattaagatattcatatgttatcatttatagtaataaagtattgaaaactgttaattttaggagtacaagtgagtaaattataattcatgatgcttgtgatgcataggtaataccactgcatacattttaaagcacaataatacacaatgaagaattgcatgcttactacatgtgaaaatgctacatatatatgaagaaaaacctaaggtgcaaccaaatattaagaggttttgtattttatagtatcaccattggtgtctacttacttcaatctgaaaatattttagctaatgacttccacctttatactggcaattattactttttaaaataacttgtatccatcaaaaaacacgttttaatgatttgacagatgttctttcatttaaaagtgtcttttaaataatattgcttttcatacatatgttaggatcactgaggatacagcagtttttgttgttgatattgttgatttttttcatatgatatagcttgatttaacaaacattcaaaatacatcataaaaacaaaatcagttgcttatgaaaatacccacttcagcacatttcaggaggcttctttttggttttctttatttatctcttttttctttgtaagcaaaagatccccaaaatatttgaacataaaatgcaaaatgatttcaatttgagttttaatttgataatatctcttctttaatactcactgcatggtaagagctatgaaaaccagaaaaaatattaggatattgtattttagccttagggatgtctcattgttgtgggagaaacactaacacatattaaacatagtaaattagccccaattcattcaactcatattagtttttcctactaagtaagaatcacctgctgtttctgtaaagcatggaaattcccaaactcagtttcatcacgtcttgggtggggtaaataaactggtgtaacgaaatactcttgctttagttgaggtcataaaagcttgaggagcaagatctacctttatatgaattataataacaaactacatgtcaatttttaaaaaatggggcacagaaataatggaaaaatttaatatttagacttgaaagtgagatgatagaattgttttaaggagccttgtatggtaaaaattagaggagcccaaacaatctgtaataaaattactaccataaaattattaagaacttcataagaaattattcttaaaatttttattttatcactaagactatgtattatttcagaagtctaaatgtttacgtccctcaaaattcatatttgaaatctgaaatgccagtgaaatggtattacaaggtgggtcccattttgaaatcctaaatctcaatgaaatggtattaggtgggtacgagaaggtgggtcttataaggcatcaagtgacacaggtggagccctaatgaatgggattagtgcccttaaagtggaacccagatagctctctcaagcctctctctggctgtaaggacacagaagtcaacagtctgcaactgaaagagtgctcttgtcagaagccaatcatgctggcatcataatctcatacttccagcctctagaaatgtgacaaataaatatcagttgtttataagctgcccagtctatggtaatttttaatagctctctgtgatgactaagacaattgccttattcttttggacttcagatatagggattactcttttggtatcaatgggtatgatttactttttggacgttattgaagtttcctttcaaattaagtctaaagtcaaactttgaaatattttgtaagtatgagaaagatggtgtattatttcctgttagaaaaaaaagagcaaataaaaagcaaagcaagcaggacaaaaaggaaataaaaagattagatcacaagcagtgaaactgaaagcaacggagtaatataatgaagccagtagcagattctttcaaaatattgctaaagtttattaatctctatcgagaaaggccaaggggcaaacagagagagagagagagagaagacaaaaattattattaccaaagtgaaaaagggagcacacatattgatcccacagacattaaaaagattatagggactactttgaacaatgctatgcctatacatttagaggaagttcttgagagaatccaaagatattaaaagataaataaccttagcatacacacacacacacgtatacatttacaaacaaccatatatgtacaacctcataaatatgtatacatacacatgcatacacacaagcatatatataccaccaaaaagtcagttaaatagcttcataaaaaaagagcagttccagtaaaaattgatgccactgatatatcctaccatacgtaacaagcaaagaaaactacagatcaatatccctcataaacaaatatgaaaattctttacaataatagtaatttgagctatttgtgaaaaggaaagtatatccttatcaactggagtgcacccaggaatgcaaggatgtgtctatatattaaaatagtttcatataaaccaccatattgagagattaaaaaagaaaagccatataacatctcaatagacaaagaaaaaacatttgacaatattcaaaattaacttattataaaaactatcagcacaatcagcacaatatgaatagaagattcttaaacagatacagagtatctacaaaagaatgcagctaatattatacttaattatggaatattatgtgcttttttcctaagattggaaacaaggtaggaatgtactctttcactagtccaaatctataatattggaagtcctggccatgcagtaagtgagaaaaagaaataaaaacatacaagctggagagaaataatatagttttctttatttgcagatgacttgattattgcctagataattccaggaaattcacaaaaatgcccagtaatatgtgagtttatcaaggcagaaagatacaagattattataaattaaacttatattgaccgcaacacccagcaatccctcttccaagcatttacccaggaataaaggaaactttgtgttttgggttgagttgtgtcctaaagagacatgttgagtcctaacatccagtacacccgaatgtggccttgttaagaaatagagtaattgtggaggtaactagttaagataaggtcatacctgagcaggtatgtttttaatccaaaatggctggtgtccttataagaagacagacactgggagaggactgccatgtgacaaccgaagcagagatcagagcgatgcgtctacaagtggaagactagcaaggactgccggaaatcactggaagctagaaacaggaaggaaggattcacccctacaggcttcaaaggaagcatgaccctgttgatactttgattttaataaatctaatagagttaatttatcgttttcagccacccagtttgtggtgttttgttgcagcaggcctagaaagtgtatttattttgacatgaaaacctgtatgcaagcatttatggcagctttatacatgatctccaataactggaattgactcaaatatccttcaataggtgagtggattaaaaaaaatgaacaaacaaaaataaaccctgtggtacctaaactaaaaagatatgacaaaggaaaggagggtgataaaattgttctgtgtcattatgtgaaggcggacacatgactattcttttgtccaagttcagagaattctccaagatatagatgaaaatactaattagtgtaaactctggaaaaaaatcaaataggactttggagatatccccaaaattgaaggcaaactattgcaaatgtactttattatattatagacaaataacataatcaaaaggagaggaattaggaaaatacaacctaagtaattttggaagagagtatttcaattctaaatctagagaaaaaaatagctgttcagaagaaatgtactctacatagtgaatatattttttacatggatactatttagggattgcagtgttactctacatgtatattgggattgaacacataagtaaatatgctgtagatagtaagactaagatgcattattgtcaaaagaaatgattacaaataaaaaatgagaaaagttacatgaaggtgtcacactggattgaaatctgaggtatgatgcacgaatgccttcttaatatatatacagacagaaggaattacatggaaataaatatagatgtgtttgtacgcatgggtatacatacatatatttcctgctgatgtctgctcaaaggacctaaaaacaatgaaactcaagaagcaatgggaactcttaatacctagatcttgctttctaatactactctccaatcaaagatgctgcaactcatctgataactggaatccagagctgttgtaaggaaacgacaagatcatcctggagcatcttgtggttccagaaagaaagtattaaaaaatgttaacattattcctctatggatactgaaaattagtggataaatgtttgagaaaccagaacattttaaaatagtttcctgagatccttatgaattacagaagaaaaaaatagcaattttaccccagagaaatggggtcgtcatcacctattcgagttctcaatgttaatatcaccattcatgagatatgatgaacatcatgttcccctgatatgatagcctaagaaagtatatcatgtctgtgttattcctgccaaaaatatgtaaccttagtctaatcatgagaaagcatcagacaaacccaaattgagagacgctctttaaaataattgaccaatactcttcaatagcatcaaggtcttgagagacaagaacattgaggaatcgtggaggagactaaggacgcaggaaaatgaaaggccgtattggattctacattggattgtaaaagaagaatatgagtggaaaaaaaacagtgaaatccaactatagtttgtagtttgattaattaaattatagcggttaatttattaaacagattaaagtttatataagattttaacattagaaaaagctgagtgaagagcatgtagaaatgctgtgtgctgtttttgcaacatttctgtaagtccaaaattattgtaaaatgtttttaattggattagtgggaaaattccaaattttaaattttgctgaggtcatgatggtacatatctaaataagtcagctgtttacatatttatgaattttctgatgtttgtctccctagtttaaaaatgggaaaaatatatatatgtattttacatatatgtaaaatttaactaaaacttacctcaaagccaaacaaattttgtccagtgaaggtggagtgggggaaaagaaaacttacataacgagaatttgtggttctaaaaggggttaagaaaaatgatacatattacacatcactgcttatatcacatcctagaggggctacatatatttttacttctgttttaattaattaatgggaactgaaccaatttattgtttatgtggctcttcttcctaaattctaacagatgtgaattaaactactaaagactataacatcctgtcaaactttaaatgggctttatgtgcaatgacattttacagaaataggattagatgtttaattcaaaataacaactgttaaaacactgtataatttttccaacaattctattaggtgtgaaaggcaaccacttggggatatttagggaaaatacttataaatattttaaatggagtacagttaaaactgaactcccctaaagcttaattcctcgtgatttctattgagtccttatctgaatacctagctacaaagtagcataatgtttttggaaatacttgaactcaaaattaaaatattctcatctttgccatataattatggtaaacttccttgatatctcatcaaagtcttcaggaatatacatgcaatgagaagccattattgaaccctagttattattgctctttaatttttattattaattgtttccacatagatgagacatgctgagtatttcgaagtcttctttcattgtggaggtggagatcatttttcagtttttttttttccttgggagaaatttgtaacttggctttcttccatgcacaatctaaaagcacattagaactactgtattttacttttgttttatatgtgtgtatatatataaaacatatatattatatgtaaaaatatataatataaaataaatacatgtgatgtaatatatcacatacatatatacatacatatattgtatgtaatatataataaaacatatgtatcatatattacatatatatgcataaaacatatatgtattatgtattacatattttctatatgtaatatagaataaagcatatatgtattaaatattacaaatatgttatatatgtaataaaatatgtcatgtgttataaaatgtaaaatatatatcatatataatgtattatatatatgtttatatatatatatatataaatattttggattcctgattccagattccagatttcagaagtctttcaggtttcccaaaagaattaaaattctatctactatatagactttactttttatcaaatttactttttaaacaaacaaaaacatttgttaaatatcaagccaagtagttgtagtaaaatgaacagattcgcaagcaacacctgtgacataggaaagagatcaatactcgtctaggctgaagatatattttaatttatttgataggaaaaaaagattcacaatcattaattttagatttagcatccatcaatttaaatctaaagtcatgttacgtctttttttctatctccactgagttgaatcttaaatacaggaatatactgttttaaaagttgttcggtattatatattggctatgtagagcatgcattgaataagatgtcttattgcttaaagagtattatctaacactgttatgcagatagaataaaaatattaaggtatactttccttttggttcaggtattctattactaggagcaaagtgttcaatatcaatgataatggtacaatcactacaagtaactcactggatcgtgaaatcagtgcttggtacaacctaagtattacagccacagaaaaatgtaagtactcatttgaaatccaatacagttgtttgccatattttgtaaataattacaaatttctatacatggggacaaggctactttaaaatgttgttggaattatttaaatgacattcaatgtaaatgtgtgtacttgcgtattttattagtttttatttatatgcttaccactaaataccttctaaactattttctaattataacagtaaataattttccatacaagaataaattgaggaaacaacaaaatacaaatgaaattcacctgaaattctgcttgtttatttaggtggatgatttcgttttcgggttgtaaatttttctgatttaccacttggatattgtccttaaaatcatgaatccattattcatacaattatatttattaaagcttaaagaaataaatataacacaatataaaatatcgaagtcatttccattacttagtcaatagatttagaattgtaaagtattaaaattacaaatataaaatattctcagatgcatcttttcttatagctgattttacatagaattttaataatcctgtttcctttcttcactctttgttgaggcagggagcagatatctctcttttccttactttatcaggcagatggcaggtgatatggtggagtggaaggcatctccgcatattatttgcgatacaatgaacagttctatggaaacactgtaggagagcttgaatctgggttttcaaggttccatttaactaaaccataaaaggaggcaaatgttacaatggaataaatgcccgctgtaacagaggaaatgtcaaggcttctcgtgtcagaaaatgcaaagatgtttattttaaatgcagcttttattcattgtgtatttctgagaacaatttttttttttcattttaaggaaaaacttgttggaacaagcttttataacactggataacaaattttcattttttttctttctctaacattttaaaaaattctacatcattaagcccattttagatctatttggggaaaatatgtgtaactgccatttttttactactgtgaaatcaatattgaaccaaaaataattaggcttgaccatttaagcttcaatagcaatataaacaaaccacctactggtggaaaacagggcattacataaaactgttttaaaaatcatctagctgcatttgctaactaccttgaaaagctttcaccatagcaattatactgattataggaaagagatgttccatttaaaaattttttttttccagcaaatgaagttcgttgtgcttagtctcttttctggaaagcttcccaaattaagcacaatgctatttatcagtatgctagctaagtgaataaaactactaactattttaaggtgaagctgtgaagttttatatacattttgtgcagtaataccaaaggtttaatttaacttaatttcaagcaaagtttaggaacacaaagataaaaacattatgaatttcttattaattttctgtcagtttattcacaactgaattacattatacaatttaattatttaagcaaaaagatattctgtgatgatgtatgcgctgaaaccataacaaatacgaacctaaattttctggttaatttcttcttgaaatctttagaaataccttttcatttttaaatgttccattaatttattttcatcctaaatgtcacacaatggagaaaagtctcaaaatgataaatactaatagttgctgtatttcttaaaggccatggatgtgtgtgtgtgtgtgtgtgtgtgtgtaataaatcctagaaattttaatttttagttaattgaaaattacaatttctatcttaattgtaactgttattgttgggaaaattcaattttaagcaaaatctcatcccagcccagaaaacctcccctcaaaggtagaacagagagaaaaattttattactggaaagcattaaaacacaatgtgatctgcatcataggaaatctaagagattgccaaaatggaaagaaatctcacctttttatgtggtcaagcaggtgcaatccaatatatacatgttctcaagttaaatattatctagatattcaagtatgaggacttagcactatttgtcacatagaattcattctatattcactgggtagttggagtgaccgcctgtatttgctaagtggttttatccaaaggacaacttaacttttcatgtctttatgacaagaggtagttctacaacttagaacaagatcgttgctaaaatgagtctcctatccttccccacatctaggatatagggatgctgtattccttgaagattacatttcaaagagatggtcaccattacttgataaatacaatcctggatcctaaagcttccaagaaacttgttgaacttttgaaagatttccatacgcttcaaagggacaaagaaaaaacttacatacaaagctttttttttccctctctctctctctttctctgtgtgtgtgtgtgtgtgtgtgtgtgtgtgtatgaatgctctgagaaaaggaaggaaagaaaaaatattttcccttgctttcaacaagtacaaggcctctaatttttaatttgttttgttctttcaaattatcattgcaaatagtacatatattttaaataaaaacactaaaacaaactaaagaatcccactcctataccctttaattgtatgcacctttcctatagctttcttttttttttatgaaaaagagaggccctgtatgatgacttaagcctgtaattccagcactttaggaggccaaggtgggtggataacctggggtcaggagtttgtgatcaccgttgccaacatggcaaaagcctgtctctactaaaaatacgaaaattagccagtcctggtggcatgtgcctgtagtttcagctactagggaggctgaggcaggagaatcgcttgagcctaggaggtggaggttgcagtgagctgggatcctgccactgcactacagcctgagagagagaaagattaaaaacaataaacctacacaatataatagctgcaacttacttttttcagttcacaaaatacatgtctggttagtagatgcaacaaaacaataatatttaacattcattgttcagttatgtactaagtactcttaattgccttatgtatattaaccaatttgtgtaattgcttcatgtaatttatgcaattgctttatgtatatgtttaatcttaacaacaaccctataaggcaggtactactatcacacccatttttcagaatgccaactgaggcattctggttaagtatttttctcaaattgagaaacaagattcaaactcaagtcatccagttttagagctcacaataaaaatgtgttacattgactcttttatctgagtcagggtttcactctgtagcccaggctggagtgcagtagcccgatcacagctcactgctgccacaacctcctgctcaagcgattctcccacctcagcctcccaagtagctgagactacaatgtacactactacactcagctaatttttttggatttttagtagagatgaggtctcactatattgctcaggctgctctcaaactcctgagttcaagttatcctcctgccttggccttccaaagcgctgggatttagaggtgtgagttaccatgcttggccagactcacaaatttttaataaatccacataatatcatagttcagttgtaatttattctccccaattcttttttgttgtacatttgagtcgtttatataatttggatgtaatgcaaataactctggaatgtatttaatcggatcatttactcaaatactgataccttagactgtagcttaagtttaacagattgggtcacagatatgtgtagtttaaatttcattatccattgctagagtcggtttacattgttatttttcagcactcagctatcactgggtgctgttctatcgcatatgacaaaaatggcatgggctaaaccatcattcttcttacctgtggtgagaggctgtgtgaacattatgataacgcggcgtgtctccactacaggccatttggctccacacttctgcccccaatttcaaccagggcacattgacaatgtctgaatacagtttggattgacacactgggatgggagggatgctgcagacattcggggaatagaagtcagggatgccactaagcatcctacaatgcacaggagaatctcccaaaactaagaattatccagtataaaatattaatagtgacagcagtgagaaagtctgctataagataaatcgaattttctctcctgtgaattcctacttcatacttttttctgaaatgtctttttttatatcaatttgaaagatttaaatgttttaaccacaattttctctcattatgttttttggatttcttggctcacttagaaaatcttctcaattcaatgtttatataaaaactttatttagattttattataactattttactttaaaatatatttagattctaattatttgtttttaaaagctacgccctaaatttcagtggttcacagaattttttttgttatagcactgcagctataaccttacacaagtaatttaactgtaatttttgaaactaaatggtttatcaattttttatccgtaaaattggggggataataatccatatattgatcaaaattaaatgagttaatacaaaactttaaatggttcctggactcttgcaagctctccgtatacccttattttactttatctttttactgctttttctcatcacttattacagcccatggcaaatacaatgcactcaataaatattgcttggtttgaatatattgagcatggaatttttttctaggatctattgttgataagtaggtgaatcatatagatatcctgtcctcagattgcttttttcaagtaaaataaaaatacaccacgtagcctctaatgtaattttaatgatgtctcttctaaagacatattaaaatatgttagatttttattatatatattcaaattgcagacaatatagaacagatctcttcgatcccactgtatgtgcaagttcttaacatcaatgatcatgctcctgagttctctcaatactatgagacttatgtttgtgaaaatgcaggctctggtcaggtaaggactcattataaattacaaagtctaaacaatatatcattgtttcataatatgaaatttcttcatatattatacaatattgttatataatagatatcaacatctttaatattcatatattataatttatataattattgtaattctatattatattatattcaatatatatacaaattatatatataaaataagctttataatatgtaataatttttgttatgcattcatcttattttaaaacatcaaaaaatttattctatttatattaattacatgcttttatgttgtgagctttgtataataatattttattttaatttttaaaagcatgcaaatttcaagttttctactttcaaattcctaaaatgtttttaaaaatttgctaacgatagtgattcagtagtttacttttatagtatatttattattcagtagttcatttatactttgccaatacaattaaaaaaattaattctataggttagtcacatttaagtttttttttttttattcatcatgcaggtaaaggtaaaatgagacataaacataaacatatggagggaaaatacaccagaatgttttttcgtagcgtttaattgctataccaggtatagcaacacaaataaaactgagttttgtacaaattattagatatgtaaacacttatgagaacatactcattttgaaatacattatcattacttcacaatttatttcacacactttcttatctgctgctcacttttttatttgtaaaatgtgaaacttaagttagaatgttatttgtgtacttctaagctctggtacataataaactaatataattatcaggtttcttagagcacacagaagactattaaataccataagctgtttttctttaaaaaatgtccactaatgttcaaaaattttacagtctagagttcatgatactaaacagttatacagatactatcaactcaattattctaagtagctttgaatttatcaacaaagctagtcagggaccatttggattttacaaaagcagaaattatatttctctttcaataaatgttagtaaccaaagttatatttgatcaattagctactatgctgaggaatactcatatcttaagaaataggtacatcttaactgttactgattattaaactgcaacatagtgaaaattgtcaatatttcttgaaatgactgaatttcattaaggtatgtgtatttttgaatgtgatttcactggaaataatgatcaaatcttgcctataaatattttccaaaatgtttttgaaaacagtaatagaattgttataaatatacaaatgactttaaaaatttaaagcactcatttctaatgggttagaacccaaggatttgggaaagtaaaaggtggatataaaaatttcagaggctctctattgtgttgcactttccctagaaccaaaattgaactattttagaaatgtatgggcgtacagtatagggtagaagagatcacaaaaacagaatgaacgtgaacttggacccatggctcctgcagaaattcagcttagacatttttcttcaaacgtggtactataagtagattatatatttagaaattggacatagctaatgttctcaagaatttcaaacacatctgattacttagacacattgacaaatataacaagcaacttttaaataataacatgtaaatctaataaatgatactttaaatgtggcacaccagttttcttaaaatacaaataatttttgaaatgatgaattttataattttctaataaatatatatcaaatttacatattagatgtaacatatttctagaattattataaataaaattatggtttatatttattataattatatttcatatttctagtaccagtatagtaaattatttcattcatttcatgtacatatgaagtgtacatatgaatgtatttagattatccatttattagcctgttttaagcctaaaaaaaataggtttaatttactgcatcttctatacacctatttctgtaaatgtcccatgtggtaagtatgttaattggacaaagttctgttttttatatatatatatagatggagctttgctctcgttgcccaggctggagtgaagtggcgtgatcttggctcactgcaacctccctgtctcgggttcaagcgattgattctcctgtcttagcctcccgagtagtggagatgacaggcgcacgccaccacacccggctaaatttttttgtatttttagtagagatgggtttttgccatgttgggcaggctgctctcaaactcctgacctcgtgatctgcctgcctcggactctcaaagtgctaagattgcaggcgtaagcgaccacacttggccgtttctgtttaatattttcgtattttcctcaatatattactagatttatgacagcagagattcttgattttattccatagttatatatgtatgcacatatagtgattataatatgaaaagtattcaattcatatgctttcagaaaaatatatttcacatgcaacctggaaaaacaattttgtatgttttgtaaatatgaaaaaataagcaaaaatgacaatactaaccacatggatatagttcaaaatagaattactaagtagtatttgttagttatactaaaaaacttaatatatatgtatacctgagtgcaccaatatataatagatatttaaaaaaatttatttgtaattcattcaatatttaagcttgccatacacatatatatacatacatacacacacacacacacacacacatatatatatatacatatttatatattcagtaataaaactaattcttggaaactatccctgattttgaaattatctttataacacttattcaaatattactggacatgtatagtcaatgaaaatagaaatgaaactaaaagatggtgtgccagtcctcttttatatatttttcaaagttgatgtaatactttgagcaacacaattttaaaaaaaaagaatgatgaaatagtgaagatttatttcattattgtcattcttcacacaaactttcaatacacaatctttcaaattacatgtcttttaaatatatatgtgaaaaaaacttatgcacaatgatgaaataattctttggatgatgatgtatcatgaaaatgtccaagacaagtatcttgataatattcaaggcatttaaaaccaccatgttactaagttccataatgtatcctagatttataaaagtgtctacatacccacatagtcattgaagatataatttttaaatttgaaataagttaatatttgtttattctttgaagtacctctataacaaccacaaaaatgaaataccattatctacaaacaggtagaactgatccaaaggaaactcaaatgctaatgtttattgcaatgtactgtaaaagtattctcagtcttaaactctactgaggagagaaatatctattgggtgcaatggcatagagttttcttgtgccctgcttaaagtataaatgtaaagctttatggaaaaagctatgaaataaaatactttttataaatgtacatatatgtatactatgcttaaaaagtttagttaacttagggaactttctcaacatcatataatgtagcaataggtaagccagaattaaaatttatgtctgtctccaagaatgatagtgatttttaccccatattccatgctaatcataaagactagctctctttagattatgcacacaactaaaaatatgaaaaacaagtttttctgtttctctattcagaaagaatgctatttatgattttaagggcaaaaataaaaggaaggtcaatttgactgattccaaactccttcctgggatatgcactcttcaaactcaaaataagggacattggtcagccctattttacaatttcccttaaggagagtgtcacacatcatgaaataattattttgggacgtgcagatgtcgctgtcaaattctggaagtctgtctcagtcctataagcatctgaaagaatgatatatggctacctatcatgttcctccatttaaatccaaggagaagccaacaatttcctcccaccctgctgtatacatgatagtttacaaattgaaatcagtggacacatggtttgagggctgtcaatgtatataacattatagtagatactttctcatatattaagatgccttgttttaataatccaggaattatggctatcacaagcacaagactgttgtgtttcctccagtgttgatcatagagtcagactgacttgggttgagatttctgatttgaaattcactgggtaggtttttgttaatacaattaaaaccaaacacctaacattaatatatgcctcccaaagtgccactaaaaactttttaaagtgctgttaatctcttcctccttcctagaagtgaaatattaatgtatgaacactaaaaccaatgaagcaatctctaaaaaaaaatgctttcaaaggtaataaggcatagctcatgtaactgaaatggtgtgcatatgaaccgtaattattttaatgcaatatctctgtataagtagtttttaaaaattattacaaagggtagtaaaagttatttgattaggttcaccataatcttaacaataatattaagtggtgctgataaggaaactctgaagagcattctatttagaagtaaacagagaaaatgtttaaacataaggaacagttaatcaccaaaataaggaaatgtctacaccattaggacacaaattgttaaatatgcgtgtcagataaattaaataatgtaaattctggattaagccaagagaaaatccagaaccagtatatactttcttaggtttcaagcagggaacttggtggcacaaacgaaatggaaaaacactttgacagctctccaccttagaatgagaaaatgatagtaaagagaaaggtggcaccttctttgatataatctcagcctgagatccctgaaagggaattgctaaaaataaaattggggcagaataaaacatgaaggacacacaatttagagactgttggtaagaaataaaaagcttcattataccagaaactaaaagaagagtatgtgcatagggtgatagactcagcatggatttgtttctattaagaaacccaaaacaaagttcactgtttccacttccctagagtactctttatttttatttttaaaaatatttttaattaacaaatacagatagtacatatttatggtgcatgatgatatttatatatatatatatatatatatatatacacacgaacatacacgcatatattgtgaaatggctaaatcaagttaattaacatatgcattacctacatacttgttttttgtggagagaacacttaaaatctactctcagaaattttgaagtatacaatatgttgttattaaccatagtcaattgttattaactatgtacaatcgaactcttaaacttatttttcttgtctaactgaaactttgtgttctttgtccacactactctttaaaaaggaccaggcttcttcaaagttccaaagcagcagcgcaataattgttttaaaaaatatttacaggtgtccatgcatgtgtgcacacacacacgcacaagttaggaaaaaaataaaaataaagaaaaaaataagctatctacatcacaaaaggaattataaaaaggacaaagaatgtttagaaaaatagatcctcacacattcatgtcagtttctgtgtactttagacaacatgttagtctttgattgcttacatggtttctggtacagcaatatgttctgggctctgccactgatcaatttaatgcttcgtggcgcacattcatgcctcaatacctgcttaacaaggtcctgcgctgtgcacaggaattacgccccccaaccccccccgcccccacccccggagagcttttctcctttacggtgagtgcaaggttgagccttgtcagtagagggctgtggatgaacattgcaggagaagacttctcttcctagatccagtacgtggcatgtttgcttttccctttgtcatactgcatggtcagctctctggacgtgtggggatttgtgtggtgcttttccccagacgcacatacagaccctaatgtaccaaatgtacaggcacttggcaaccagcaactgccgcctgggctcatgacaaccgccttgagacccactccccccccacccccaccgagtgtaaacactgtgctccagacctggcaacgcagtgaggtgagcgccaagtcctgcatatttatcctccagcccactggtaccctggagggttgtttcttctttcctgaagaatgtgggttagaatgtgaacccaggcaacctgtgaacatcttccatagggtatgctgcagctgcacctcctccaaggagggctgaagctggtcccagggagaaggctttccgcccacgcttggctgtcctctgatattttctcagagcgtcaggataccctttagagttctccttacatctttatgattgctctgatattatagcttagaattctattagaattcctcgtttcaaatgatcatgtggttttgtccctctgttggaaccaggctgataccgagccaggcctttcacatttcctgtcctagatatggaatcagtcatttcccaagattctgtgatctgttagtgaggaattgcagaaaatacagatggaattgtcagtaaataaaattggaaaacctgtccaattaattcctacgctttctctttcatttttgataatgataaaggcagtattaaaacttcatctcatttttttgtgatttttatttttttcaactatttttaattagtataaatatttataaattaatgttttaggaaaaggtatcaatttttcagagggttttttaaattgtaactattaaaaataatttataggtaaacattatttctatcaaattgctacagacaatcttacatatagttcaacattagtttccagatatccctatagaaagttgttaaataatttttttaaggccaaaatattttaaatgtctaataaatacataaatcctaggaatagcacagaactctttaagcttaaatgtgttcgaattaatatgaaacatattaaaaagtaactataccaaaaagaagaaaaaatatatataataaaacatattatatttaaaagaaaaaggataaaaagtcaaattgtataaaaaatgtttgaaagctgtgtaaaacattaataatcgtttctattacaaataactggccaggcacagtggctcacacctgttatcccaacactttgggaggccaaggcaggtggatcacctgaggtcaggggttcgaaaccagcctggccaacatggcgcacccccgtctctactaaaaatacgaaattagccgggcgtagtggcgaatgggcgaatgcttgtaaacccagcagcttgggaggctgaggcaggagaatcacttgaacttgggaggtggaggttgcagtgagccaacatcacgccattgcactccagcctgggtaacaagagtgaaactctgtctcaaaacaaaactacgccgggctgggtggctcacacctgtaaacccagcactttgggaggctgaggcgggcggatcaggaggtcaggagattgagaccattctggctaacacggtgaaccccagtctctactaaaaatacaaaaaaaaattgccgggcatggtggcgggcgcctgtagtaccagctattcaggaggctgaggcaggagaatggcgtgaacccgggaggcggagcttgcagtgagccgagatcgcgccactgcactccagcctgggcgacagagagaaactccgtctcgaaacaacaacaacaacaacaacaacaacaacaacaacaacaacaacagaacaagtaactacataaaccctgtaactttttggcagactaatacattttaattaaaaataaaggcaggcagggggtgatggctgacacctgttatcccagcactttgggaggccgaagtaagagcagcactcaagtccaggagttcaagaccagcctttctggactggactttcacactgtgaaattccgtctctacattttttttttttaattagctgggcatggtgattaatgcctgtagaaccagctaccaaggatgctgaggagggaggattacttgagcccaggagttcaaagctgcaatgatctatgattgcatcattgcagtctagcctggacagagtgaggacatgtctcaaaaacaaataaacaaacaaacaaacaaaataaataaataaataaataaaggccagagataagtgagaagataattatttgcaaaatcctgaagaagtcattctgtcctcaatatgcaagaatatttgctggttgataagaaatgttctttataaaagttagtacctcgtgttgatgtagtaaatgacttaatgtaaataccgtgggtgactttgccaatgaagaaatttccaagcactctgtatccattacaggtgacatatttatcattctgaatgttttaaccaggtaagagtactgttgaagctttcccaaattattttccacaatatgcattcatagaaattaacatttaaaaaatttatcagatccagaaaccacattctatttattactaatattaataggaagtgaacatttttagtaaattgattcatagattggtttgatgaattacttgtgtgtatagaaatttcagcaagtatgtaaaaatgtatataaaatgaaattataaagaaaattttatttaagaataataaccaaagtaaagggtgttttgggacaccatttatctaataaagcaccttaaaactaataaaaagaaaagtgatctttcaaagtacctcctagattaataaaacaaccagattaatatcttgaagtaacacaatttaaggcaataagattacataacaatcaataaatcatcctacaggagcaacgttttcttgtattacctttattttaacatcaaggttatcagactatcagacttgaagacttgtattgaaaaataattaaaggaaaattctttgaattgtaaaacttgttttttaaagtttgtgatgtgattataaggttgtccatgaaatttgctggttcactttttttataatgcaaatctattaataggtagaatgggtaaaatatagaattttaaaacaatataaaattctccaaatgtgtttcagtgaagatatacagatcttaaaattatgctttacaatattttctttgttcttttcagttatacaataactcaaattaactcaaaaaaagaaaaaattatacaatattttctttactcttttgaaaaaaattccttatctccaaaaataattggtaactttttcatgatggatttatttgtatattttagagattgcttagatgtgctacagcatcagaaaactgaaaaaaaaaaaaaaaaaacagctattttcttccagctagttatcattcttggccccaggatggccagagtttaaaaaagataggcgtttaataactgaggctgctctatttctctttcgattggaactgtctatcacgtttctcacttttttgtttgtttgtttgttttttgtttgagacagagtctggctgtgtcacccaggctggagtgcagtagtgcaatctcggctcactgcaacctctgcctcccgagttcaagcgattctcctgcctcagcctcccgagtagctgggactacaggtgcatgccaccacacccggctaattttttatagttttagcagagatggggtttcaccatgttagccaggatggtctccatctcctgacctcgtgatccgcctgcctcggcctcccaaagtgctgggattacaggtgtgagccatcacacctggccctcatttactcttaagcaatacatagcacacagctttccaatgatagctgagtgcatctttttgaatttgatggatttgcctcttttaccctttgagaaaaatgagcaggatagcaaaataagtgttgttctttttatgtattatttaaatgtcttttgttttttgtttctttgttaggttttgttttgtcccatgtttttgaaaggcaaagtggttctttagagaggattgcaataaacatttgttttctagtgttaagttcctggaatttctgattggtattcttgattattgtctaaaaatcacatgtataggaaaccatgagatgtaattcaaatatgtttccccttatgtgagaatgaaacatcaaaaacaacaagctacaataacaaaaagattacacagtgcaatagctgaagatctctatcactcatccacactaccccaattagatgataatatcctaaccatgctgaatactaatctcctcatttcaaaaataataatacagcttctcctctacaatctctatcttctaaggattttgtaaagataaaaaacaaataagaaagaaggtaaaagaggactgtggtaaaagtagttttgttaatattaacagtgacaattaagggtcatgtcatacattataagttcttaacatggagttcattgtcttctaaagagatttgaattagctacacggtgtctatgtacacttgacattgcacacaaacaacattgtcaatgtctgttggagatgagagtggagcaggttaataatgtcgttcatcagatgtttaggggagtcgaattaacaaagtaaaaaacaaaagttaagaactccactataaatgtgttatagaggttgatttttttgttttgtcatcatacgtgtgtgatattaataatgtactacaggtacataagatgtaaccattggtttagctgaatgaagtgtctgagagactgcatgcacagggtttacattttcttgtgaatctataatcatttcaaaatgcaggtttttaaaaaaagtcattagactggaatgaaataaaatgaaataatgtaagaaaaatagaaaagaggattaaaacaattatgcttaataatactgagactatgtcacagagaagtttctaaggaatattttcggtcaagagatttgtatcgttgagtttcaaagttacagttaattttcatgttatttaaactttcctaaaaataataaaaagttaacaatatacaatactttgaaatctgtaaatattttacatatcaagtcaaaggaactaaataatacacataaaaattatatacacgaacttttcatttgatgctaagaaaccctcagataaaagtaaacctaggtgggacacagtggctcacgtgtgtaatcccagcactttgggaggcctaggcgagaggatcacctgaggtcagaagttcgagaccagcctggccaacatggtgaaacaccatctctactgaaactacaaaaattagctgggcacggtggtgggcacctgtaatcccagctactcaggaggctgaggcaggagaatcgcttgaacctgggaggaagaggttgtagtgagccgagatcgcaccgttgcactcaagcctgagtgacaagagtgaaactccatctcaaaaataaataaataaataagtaatgaataagaataataaacctaaatcctaggtaataaatataagacttcaaaaggcacacataatacgtataataatgataaaatattatagtcctcaatcgataatcaaaactttatgtaatattgaaactgatagggtaatataatttaaaacagtaataagaaaacaatgccttctcttacactattatttgttggagttctaaagccaaatttcatacaatatataaagtacatataaaataaagtcactgaaaaaaagaaaaattatttgaaaatatgagtatgtaatgcagtgcttccaaataaatgatagaattgtaaattttcctgtagccacgtttaaaaatataaaaaacacccagataatgttaattttagtaatgtttatttgatataatatatccaaaatatcatcttcacatacttttaattaaaatcattaacagaatattaaatattttatacatatttttaatttatgaagatgattcttttctcatttcccacatgctcaaacagccagagaaaatggcaggtaaaaggatgtcttatatctatctactttggatggataataaattgatcatagaaaataaaaatgccagagtagtcacactctactctggaggaatccaaacatttactcaaatacctatgtgggtaaacaaaatttttggttttgttcttaatgtgtaagtggccagggtggggaagagtaggagagaattttcagcaatttgcaaatattaatataataaatgagctgacatcagggtaatttgcctttgccatgtggtgcaaatagttatcatttttcaaatcactgagtgccattattttgactgatattaaatgtctttttttttggaggtaaagtataatatcgataattttcagattcactcataccaatattttgtctaaagacatttaccttgtctccatgtaaaaattttctttttcctaaatttcagtggttgcattttgtgatctatgattctcttcctttcacttttgtgtccaaaagtttcctgaactcattatttcttcttttatccacttcttcctctcgactacagttcatatccaaataactgtatctctgcctgatttttctgttttaagctatgtgtctgactaacctgagaaaacaactcagatgtcccatggttacaccaaatttgctcctaagccttccctttcttcagtatccctaggaaaattattatgatatcaagttttgcaagaaaaaaagacatatggacatcatttttaattaattctagtctttattctccatatccaatcaataatttggttctgttgatcccatctcctacatatgtctttaatgtatcaatttctctctatcatcattctttctaccctaataggaacctatattctcttctagagtgaacctaacctaagggacctatcttctcttctagagtgaacctgacctaagcaggtctgcagagggatgttcctgtaaaatcaaactttccttcatccaatctcacagcacatatgcagcaatgtatcagttttataaatcaattatatttattaggtaagactgcagtcatgcagtttcaggagaatcagattttactggatggagagtagcgaggagaatatatagccctcttgaaaatggtgaaaaaacattactttggtgacatcttctggagctcagcatacccttaggcaaattttgggactcaggaattatatctctatttgaagcatactgtaccattctcaatttatgaacactgctcagtaatttctgtattgtttctcatttaaaataacacattccataattgtgattgttagtgggtttttttgtatatcacataaagtgattttgattaccaagcagttgttcaataggatcatgacaatagcttgcggactagattctctatttccagacttacactaaggatgtcctcagaaggagcattctaaaatgcagtcctttgcctggaaccatgtgatcccaaataaaagtaatgatcatgtcattcccaacttagagcctgggagtgtccctcagtataaagtcaaaactctttaatatgtccacgatgtatcccctgctcacttctgctgtatgatcttctaatttcagcacagatacaaggttctctgaccccccaatatttaagtattaagtactttaggtgtttataacttttaaaatgtaatttgggtattctgtacttcctcaatactttttaagtttgcaattctgcttgatcttcttcaccactagaatgtgaacagtggtgacagagactaactttatccatgattgtaccaccagggcataggattgcttggagtgctgtaagtactaatgaaatacattttaaatggatacatttaagatactaatgagatattttatagtttaatatttttccatatacatgctgattttatgtgaattttaaaagtatatttggaatattaactttaaaaggaaaattagaaaatacgtattgagataaaaatctaggaatgtgtatttttcaactgaatatcaatttctacaagttaatggcaaaaacaattataatatctatgacatttaaataaatataatgaaactttgtgaaaaatccttttagaaaacttagagtatcctcagttctatccaggtctaaaatattatgctataatgaccttttgaacatttttcttctaatattttgctaaacaaagaaagacaacaagcatactacaacctagactttcttgttggttctacttctattagtgtattattttgtactctgcctgtttgaacagatgttcaacaccttttttgagttttatagatttattttgtcaaaacaggtgtaatttaaaatcatttactcattagagtaatataaaaagtgatggtctcatacatatgtttgtataataatttcttggcaatgggagacaatctgcatctttagcctaatacaaggtatacctacctagaataactaaataagcaactcagataagatttttaagaaaatctttccagatattcatttattacaactccaactttttgtttaacatttttctattgagaagcatttttttattgtttattaagtgcacttcaaggaattgatgagttatataaattaatactcagtatttgtatcttgatttagagttcatgattcaatctatagtttataatcctattcaacaatttattcattgactaatcctggaagtaggtttcattgtgacttgccatgaaggtaaggaaacagacacaaatgtattgcttgctccaaatatttgtgtacaagagttgcatcttaaattagctgtccatcaattgcatgtttaataagaaccatctctttggtttgaagaatgtgagtattgggcttatttttggctcaggataattaatctggaatgatatcttagtaaactggcccatgtgtgactttttcttaaaaaaagacatagtgcataatgattaatagcaggcaaatgattatctttattctcctgattatctttaaagtcaaatagtgattatagtttcataaaataactaaattggaacttatgaaacttccattagtaggtcatctttaatctacaaaatattaatttcatacatttatacctaatgtatgatatctttgccttcattaattttcttgatattctttgcttaggatcacacttttttcctcaattcatatttttatttgagtattagctcattggctgtactcttaccctagaaaatcttccctttctcccatatcaaaacacattattttcttctatttttaaccattatttttggtccttattctacaaaattatattacttatttctctgtcactaacttttatgagacatatttttacttgcttttggaatttcatgtcttttacggtatcattttgtatgtaaatctggtaggacaagaacaagtctaggatatgaacaatatgtcctagagggctacacttactactcatatttcacattgcctatgacatcagcttacattctaattctggcccagccaatttacttacctaagacacttagcttatatgaagcttaatataaacatttataacatgggaacaataataggatttattccagagaccattgtgaagattatctaagataatgtatagaacagatcctggcccataggtaagttcttattaaattgtagttacttttcaattcttggggcttacacaatgtatttccattgtagctttcaatgcactgtatatagatgattgaatgtactgcatcagaaataaattggccaacattctacgtagagagcaaaaagaatactaaaaatctgagctttcagaattggtcataatttggagttattttcattttctcttttcccaatctctcaagccatggctgttcttggtatatacttttaccttttaatttatctttactcctttcataaatgtataaggtcaacgatagttcccagataaagagatataagtaaatagcaaccaatacaacatatagaagtttttcttataattttattttaaaatgaaaatgaaaacctttccattggtatatttaaaggaaaaataaatatcctccatcaaaacttattagcatattaatgtggtccctttattagtggtatgtgtttaagtgtacctgttcaaggtaacttcaataaaattcataatacttgatatatgactcattttatgtctgtgtcttcctatttttataaagtaattatgaaagccagtaaaacatatcttattggaagcccaacttacaaagcaaatataagtggagacatgatcatttaaaaggaggcagactgttgaaatcttgctcattcagtttcctgtacatatgcataaggtattttgatttattaaaaatcttttgacatacatacagcatatctccagtcttcttaagtcttcattcccaaagggagacatttgcaacatttactcagatgctcatgtttaatacagaacatcaggtagtaaaataaaatattccttatctgaacactgtagccacatatgccagcaagataaacatgaattctatactttgttatcaatcttatttcagcaaatgtgcatataaagatatccatatgcctatgactaacaatattcaggacaccatgatatgcaaaaactcaacaagagaatattttcatgaggaacacataatagacataggaacacataatagtttgtcgtgtgacaaaccctctgacaagccaagacctataatcctgaaaatgaaccctgaaggttaagtattagtatttttatttttcaaggttaaaaacttctaaatggcaaagccaggattcagaatattgggtttccaagcccctgccctctacccagcctatacaaaatcctgtaatattctaaaatgaaggctttaccttaacataaatcaatatccacatgtataattataagcatggattgaataaaatgtgttttgttaaattacttaattaacactaaatgaatattatttattagtaatgtgtaatgagttaaaaataaatcaatgtggagaagtaatatacagatcgtattggtttcctaatgttctttatgcctgtgaagatgtatctatttttttgaagtataatataaatctgggcttgtcatcttgcatctgaggctatttttgtttgacatattgttaaaggcactttaattgtagaaaattcaaaacaataacttctataatcaatttactttaatttccacaattaatcacaatctcactatgtgatcttgacagcatatctttttcgacaataatgaactacttgactgacagattcatgtcttgaaagaagaaaattaattgagaatggatttgttcatgtctgcagtacttcattgttttatgatctgagatatagagatgaacttatttgatgtaaaacactttcctataatcattatgggtcaaaggaaatcatgtacattgcccctacattttaaatgcattatttcctcaatcaattgcaaatctcattacttcagcaaatagtttagtaagccagtaactctaccacagttttgctctcagtaaaaacaggaaatagacaactttagcaaatcataatgtctgacattcagataaagaaaaagttaagaaggaagaaagagtgaaatgtaggcagggaggatgtgagtaatacaaaagcaatgctttggagactttcaacaaacagcttttggaatccacctgatccatcaacaagagtttgtttattatgtaatattacaacactctttgaaaaaaggaagtgaacatatttttaacctgagaaaaaacattttaatattctccactgatttgacagttattttctgcaatgtccctattgattgtaataaagcaatgtgaataaaagctaataataatagcagcagtgatcttcttcctgaatccaaacaacaacaaaaatctatccccctttttttttaggtaattcagactatcagtgcagtggatagagatgaatccatagaagagcaccatttttactttaatctatctgtagaagacactaacaattcaagttttacaatcatagataatcaaggtaatgtcattcactcataatgagttttgatacatttttgtgactcatgttagactttaatggaatttatggcatggatttttatactgttcttgcaacataataatgtttggaaatcaagcaaaagagtaacaattaaaatggaaaacaaaactcaatgttaagttctaaaaatattgactccatttctcaccgcatttcttcaaagtagaaacactttttaaagttatcaatggctgtaagctcttgtaaagtctgaatgaccctgcgaatataattgcagttctgacaccacagctcctttcatgttctcatctaactcagacttcaatctatgactgaggaagaaaatgatatttattttagttacagtcatgttagcttgattgattcaaaaatatttagggtcatcaattaggagcttagaatatgtgaaattgggttaatatagttcttattccttcaaaactaaataatttgtatcaatctaaggattaagtgttccaaagaactttttgtaggggcagaatttatttttcctttctgtagaggtggattaactttatacaaagccacgctgcttctttttcatgagcttcagtaagagatactttttgtcataataagaacttctgttttaattttttcatacctcaaagttatgaaacacagttgatttattactcaagtatctgtaaccaaatacttgcagttctccttacagctgaggttaagctttgttcagaagaggcctttcatacgagagtaaatgcaacacctttctgtctgttttgccctcgtcaaattcccccggggaggaaactcaaatatgtttcagacaaaaaccacaaatatctctttcaagctctttgacaaatctccagactcctttccacaaaatttagccatgtaacaaactcttagattcagggggtacatgtattattattattattattattattattattattattattatttgttgcagacttcaacgttattttatttatttattttttattattatactctaagttaaaaattatattttaaaatacatatattaatataaatgaatctaagctggagtttttaaatgtatatatttaaatacattgatatttgtatatatagattaatttatattaatataaaataaattactgaggtgaaataaatacattgaagcatacaaaattgatttggtttaatgcttgtggtcacaagtaatttaataaaacacatatttaaaaagtgtcaactgtctctcaactcttagatctgcctagcgaataaaatcacatgggctttatagaccttaagggtttcatagtgaattgtctttaaaaaggtgatttgggaaatgtcctacttaagcatgcatttcaaaaggcttttattttccttttactgctattgtcttctaaaatttggtgactatagaaaatattttgagggatggtaaaaaagaagtaaagggaaaatacagttctgaggtacaagaaattacaatgacaaaagttattcataatattttgggattcacagaagagtcattgcatatttgttgaagtgcttattgtttgttttcatgaatttttttgaatggactctctaggtaaatgaatcagtctaagtgtaatgattttcagaattttaaatacaaaatagattaataacagcaatgtgatatgaaatatactaataggatcttgtctaccaagtgaaattattttgtctaattagaaaatatagtatttgagatcatgtgctttgatatatatctttgaaagtcttgtatattccctggatttgtacaaataatgggtcacaagtattagaaaatagaccgtgtcatatgtaattaacacaaataaagccagctctatcagcttatatttcatattggtagtccctataaattattgatatctgattaaaaagccattttctgtgttacacgtatgttttatatatgtgtcaaagacattttggaaccaatttaattaattcaataataatataaatactttaactaaataagtagtatcaactcaatatttaataatattaaatagtaattttactacataatttaaataattcatctgattacataattagggtttaggtaatgtcaaaacactaataatttagtgtggatgttttagttgtcttctcgtcagaaatttcgtcttccttttatttgaacttacttgatcatatctctatactattgtccctagcacatgtgactattacatacaaatttctcttacgtagttgaaaaaattatgcacatggatttttgttttagataacacagctgtcattttgactaatagaactggttttaaccttcaagaagaacctgtcttctacatctccatcttaattgccgacaatggaatcccgtcacttacaagtacaaacacacttaccatccatgtctgtgactgtggtgacagtgggagcacacagacctgccagtaccaggagcttgtgctttccatgggattcaagacagaagtcatcattgctattctcatttgcattatgatcatatttggtaggtagaagtcatcattgctattctcatttgcattatgatcatatttggtaggtggtgctgaactgaacatatactcatttatttaaaataacatgataaatacatagttaattctattatagcattataatgtgggtctgtgtgtacgtttattgctcctctgaatgtagtataattcttaaatcaagtggagtaaataagtggataaaaacatgatctttgaattgtatgagtatgtgagtgtgtatgtacacatctgtttatgcatgttcttgacacatatacaatgtaacagtataaaacatgtaaaaattagtgataataatggcgagcttctctcgagtgcttattatactccaggagacaatcttcagtgttttatatgcactatgcaatccaaacctcacaataaccttattaagtagtaactaatatcacctacattttccagatgaaggaatagaaactcaaaaagctttgtgctttatgaagggtcacacagctagaaaatgatgtgctaagattccatgaccacaacacattgttatacaacactgtactgcaactgactagagcccaaggtgcatttaaaaaaaaaaacagcgcagtaaaatctactctcttagcaattttcgagtataaaataccttattattaactatagttaccatgtggtaaaatagatctcttgaatttattcctaatgtctaactgaaactttgtgtcttttgaccaatgtctcttcattctctcacctgctatcctgctactaccattctactctctacttatgtgagttacttatttacttgttttagatttgtcaaagtgagatcatgcagtgtttgtctttctgtggctggcttctttcatttagtataatgttatctagttttatctatgttgtggcaagtgacagaacttctttcttatttaaagctaaatagcattcgttctgtctgtataccacattttccttatccattaattcactgatggaaacttagcttccatcaattccatatcttggctatcatgaataatgctgtaatgaacatggaagtgtggctatctcttcaacataccacttttatttataagtatttaaggtgatgaatatattaattaaattgatttaatcattccacaatgtatacatatatcagacatcacattgcataccataaatgtatatgtttttgtcaattaaaactaaaaataatccaaaagtcttttgtgaataaaaaggacagtaaatgttagaaatgaggaatgtataagagaacgtcttttttaaatccaagtacagaagagaaagaaatcccagtaaaagagcgctattagtttttgtttgcttgtttttttctattgctatcactgtttttataagcagataatttatattcatttcacaaatgaggcagctgaacaccaaaaggtcttaatcaggctttcaggactataaaatattcatctagcataaccttttcctttttttaatgccaaaatatatagtctaaactctgctcttgcctccctcaaaacttcaaaccaaaagccaatgaaactacattgaagagtgagagcaaatgtattagtttctgaaatgtcaaactgaccactcaaactggcatgagatatgtttcaggacctgccttgtcttcacttaacttatctttctcaaggtttcaaaaccaatccattcctcatttacacctaccattacaattgtttaggacctagcttcagtttttaaaattatttttaatgatctttgattatgaagctgaattcatagctacatagctagatccagaagcaaagataaatagtaaaagcataattttgggggactaaaatactgagctacctatagatacagacttaaaccaagccctgaaaatctacaaacaaacaaggggcagctttgtaattacaaatgtgagtaaaatttagcaggtgggagttacgggtcaactattacaatagtgatttcctttgaatgttttataaatgtttatctccaattcagatcagaaaagtatttattagactcctttctatttcaaccatatatatcatatgagttctaaagtgcaatacatgaatgcaaatatggtgaccttatttaatttagatattttaaatgcaagttttatataaatactatataaccaacatatttctctttgtgatactattcataacattacttcatgtgtgtttcaaatcctacatgtgaaattctgaacagctacataagatcctaggttggctcttggttatccttgatacccacacgcaaagacacacacacacacagacacacacacacatttttatttaaaattaaagcaaaagtgttctgaattttttctgtttctacatgatgttaaaattatcttatgtaataaataataattctagacaaatgtgttatgattcaaatgcatgatagtttgaaatttctgaaatttatgtggtgtcacagaaaacaggctctgaaccaactttctacttttgtctttttttattttattgtatttataattgatacaaattggacatatttatggggtacagtgtgttgtttcaatacctgtatatagtgtataatgctcaagtcagcataattagcatatttgtgactgaaaacatgtagcctttctttgtggtgataacattccaatttatctcttctacctattttgaaataaattattagctacaatcaccctacggtataatagaacaccagaacttattcctcctgtcccactgtaactttgcaccaattgaataacctctcttcagccccactcccctgactactctccaaatcttggtacctatcattgtattctctacttctatgaaatcaacttttttagattccatgtataagtgagatcatgcagtgcttttctttctgtgcctagcttattttacttaacatgatgtccagcaggttcatctatgttgctgtaaatgacttcactgttggtgactgaacagtattccattgtatctctcaactagctgtgtctttctagcaatgtcatttaacatctgtgtgcttcagttttctcatctataataggatataataatataatgactttcacaagaataaaatcaatcaataaatataaagcttttagaagaatgcctgatgtatgcttcatagtcaatacatattaatttagaaaataattatgccacagaattttgcttcaatagggaacatcaaactgttctgttgttctgaactactattaatatgaagcattggctactaaagttgacaaacgcattcaggttgcaaagttttattctactttattctattttaatatttgagaagaaacagattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccagaaaaatcgtgatacattcttttgtaattttgcaagtccctttggcaaattttcaataacaaatgtatctttttgttttataatcataaagtttaagcactcatcttgagcttgaaatgagagcaaagactgtaatgtttataatactctttattgtttattgatattctgatgtgctttcttcatcagggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaagaatgctaggtaatcttagtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactgaattaagatatcttagtgttattttatttactcaattttcatctttcacactgtaagaataaaatgtttttgtggttaagttcctgatactatatagagataaactttaaaactttaacacctaggataatgtgggtgattacataaatgtttaaaaacatttaccttatatggaaagcagatttctgactaagatgccatgattcattctagtttgatattttaaaactttgccaagagcactctttaaaactgatttcaaatttgaacagatacttggtgtatacaaattaatcagagttatatagtataaatttgtattatttttgatattacaactttgtattaaaaaggaaaatatatttaggtgtttgtcatagattttttttcatatgcaactcaaaacacattcttatgtcaaaatacaatagcaaaatacaagtcaatatttactcataattaaatgcaaactttatgaaactggtggaaagtgtggaaaaatttaagtaaatttttacctctactaaaaattatttagacaacttaaaggaatactggattcaaacttcagttactattcactgtaaatattatgatcaactgaactgacttaccattcatgggataaaacatgatacaattctcagtatttgcttttctgttaagagcttggaatatgactgatgcttcagtgtcatttttttattattgaatataaaattaggtgcaatagatacatttattgtagccttaagaaggaaatcaatgctaagctgttgggcataaaactttacagtaacattagataacaagataataaaacactttaattttaatcgaccttttaagaatgatctttattattctatccaaatcaaggtagacttcaaaatttatggtttgaacaggaagaaagtagtgaatacaaaattcttaaaattggttcatatgatcatttttttattaatagcatgtgagactaagctgaaccaaactggccatatatgttaaatcaaataatttgagtaattttgaaatattgatgaagtagttaaatggttataatatattttattggtactttgaaatttaaacatctatatcacataataaagaaagtttttcatcaatctgaaacaggcaccattaaattggtgacacaaatattatcatttcacaaaagcttgagaaaaccagatttgaagtgaaataatttaggaagatattaaaagtggatgagaggacataagatgtagtcaatccttaacgcaatgataccattattaggaaagaggaaaaataccaaacaagagaaaatttaaaggagcaaaaatttgcaagtcaaatagaaatgcacaaatcgagagaacatttacatttctatcacattgacatgaaaattgaaaatgtatagtcagagaaattttcatgaattattccatgaagtgttgtttcctttatttaaaaagaatgctaggtaatcttagtagaaaactaaaaagtatgataaacaacagatggaagaattcatggaaaatagacgagaaaaagtaaataaggctttctggagatgacggaaattttgtatgaataaaagccttataaacaatgaatacatttggataaacaactcattaaaatgcacattaatggaatacctgtacaaatagttttaatacttgtgtccagtggcactaaagagatatattaaaatagattctggttgagttgattataaga

SEQ ID NO: 13059 - DNA, 43086 bp, Human
ctttaggcatttcttctagtgcattcaaaattatccaatttacaagtaattcattttaagttaacttctagcatataaaatggttgtgttgaaacactgtcttcagaattttatttttaaaagatactattttagtataaattcacatttatagttgaatgcttttgtgaaagatattagtctttaaaatattttacaggctggccttgttggctcatgcctgtaatcccagcactttgggaggccaaggcaggtggatcacttgagcccaggagttcaagaccagcttgagcaacatagtgaaacctcatttctacaaaaaatacaaaaattaccaggtgtggtggcacacagctgtagtccctactcagaaggctgaggtgggagggtagattgagcccaggagatagaggctgcagtgagccatgattgcaccactgcactccagcccaagtgccagagtgagaccctgtttcaaaaaaaaaaaaaagttcgacagttccaaaacacattaatgttaattagagtctgctaagttgctataaatacaacaaaaaattcaatggcacaaacaaaatatcagttgcctctcatgaaaaagtccaagattagcaggtgcagattggaagagcaaaattgactcagggagtggtagaaggagagcaaggatccaaggcatgagccacaatccatgcctcttacaacccctcacatctgtcaaatagaacccttgtctggatgggcccttgttctaacccagtgcctgaaatcttgtatctgttatattggtggttctacatgactttatatttgaaaagttacattttagaagtggatattttgtatttttggttactaatataactgtgtgaaagcactattaaaaatacttttatttcgttaaaattacctgtttatgttttggtctcctccactaatctgtaagcccctctgagtaggaaacaatacattcctcactatactccagcactcagctcagtgcatggggatttaaaagtaaatttcttccagaagtgtagattcttagatccagattgtgaggaggggaggagagaggtataggtgagccgggggcggaagtgggggcaggatcatcttaaggaaggagaccactgctactactgctgccctcctcccaccaccttgcctcgttcacaagacaggaggagagaaaaagcaaaaagttggaaaaaaaaaaaaaagtaagataaattgccagacaaccttggcaccaccacccggccctaggagttaaaaaaagtaataataataacatcaacccctgacctaaactacttgtgttatctgtgaattcctgacactgtatgaaaaaagcattgtagcccccagtcacgtttcccactcttgtttgatgtatcacgaccctttcacgtggaccccttaaagttgtaagcctttaaaaaggccaaaaatttctttttcggggagctcggctcttaagacgcgagtctgccgacgctcccggccgaataaaaacctcttccttctttaattcggtgtctgaggagttttgtctgtggctcatcctgctacaatctgtttgaacagatcacctgaaaggtaggtgttcatttaagcatttggagtagaactggctttggggttgttgacagttttcccttcactaggaagtgtttgtcactttaaggcaaaaaccaggaagttaaaagtggatgcagaagcgagcacagacggggctaggggtttcagagaaagtaattgagagtgctggcaacagcagctgaaatatagagaagttgtaggattaactttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatagtaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggtacatacatctcctagtcccttaatacttgaaaccctccctgcaactaggtgcatacgacagtttatcttaacagtgtcaggtggccgggcgcggttggcacacgcctgtaatcctagcactttgggaggccgaggcgggcggatcacgaggtcaggcgatcgagaccatcctggctaacacggtgaaacctcgtctctactaaaaatgcaaaaaaattagccgggcgtggtggcgggtgcatgtagtcccagctactcgggaggctaaggcaggaggatggggtgaacttgggaggcagagcttgcagtgagccgagatcgccccactgcactccagcctgggtgacagagcaagactccgtctcaaggaaaaaaattaaaaaaagatagttaaacttattatattccaaagaataccagccacctttattgatctccaaactgacatgcattggatttgctgggtttgcttttatttttacattttttgaaggagaatttttattctttttatttacagaaaattcagcagtgtacatttaacccagtttagtggcaacttctttcacctttcccttttccactttggtgattcaaacccacagatttaggacccaggacattgcctccccattggcagcgaatctcatcatatctgtccatgtaattggttctgaaaactgccaccaacttagccacacctcctttgtcttcctagtgaacctgtgtgaaggcaacgtcgtgcaggtcttcctgtggactagacatcccaatcttacctcacccttgataatgcagtaagggacccccattttgggacacagggcaggcaggaagacaaccagctcgatgggatccgcatcgtgtgcaatcaccaccagctgagtcttcttgttctccaccaaggtggtgattgtgttaacccctgctggaaagacgggtggtgtctcgatgggggtatcccctttgctagcagctttcttctcagtccaggacaacagtctctgcttcttctcttgttttgtctctggtctgtgcttgtgggcccgcgtaagcagtcagtagctgtttggcagtgcgaagcctgggtgaactggttaatggcaggaagtgctttcagcagcttataaaaggatagctctttgctgctgcaacctgatataggggggccatctgacaaagagggtgaggtctctttggggctgtatgtcctgtccaatgccaaaattcttaggctttttctcaaacagaggattcacaacttttttgtcttcctgcttcttcactgatagcaggggcgggggccgccttctttcccttagccttctttcctattggcatcttgggtggctagaggagaacgggtttgcttttaagctagttttctgaacatttaatagtattgaggtgccctagataagttttacgtttcatatttcataaaaactaacacattgttggccagctacataaaagtggctttatagcatttcttagttgaaccgaaatacaatccttttgcaccctgactctgttttggggactaattttatgtgacaatcatccttattcagatctggagtggatccccttagctgacctgcatacgtgtatcatcatcagtcttggacatgggctaaaagcctgttgtttttagtaaacagcagaaaattctgctcttaaaatccagccacaatatggtatggaggttaagaatgcagtcttaggctcaaaccttatttctgtcacctactagcagtgtgactttgggcacatcattaagcttctctgtacctgtgtttcttcatctttaagaagtggataataatagtatccactttatagagttattgtcaggagtaagtgaatggataattatgccaatcacttacaacagtgccaggaacatagtgttacatgttggttattattcagtaggcctaggatgggactcacacatgtggtgtctttactaagcatcttagccagttttggcagttactgaaaaggcatgaaatcaattgaggatgggaggaggttgggagggcatccatcatcttgtctgattatcaagtttctggtttttatctccaatgtggtttaaacttattctctgctaaagacttaacgtggaggtttttcttctgattatccacttggcaaaattttaacactttgtaaactgcttccttgaaaataaataagctgtgtttcatcataacgctctgacttctgttccaacagaccacacctgtgtggttcaccgttatatttctagagccaagcatgtattctactatctccattttttaaagctccccagatgattccaatgtgcagacaacagttcaaagagagtttctattccatgggattttgaaaatctgacaggaacagaagccccaaactgtcctcattcctcccatttaaatttttctcctttcttctgtccttattacttcttccaatcccatcagttccaatttccccaacttccatcccctgctctctctctcttttctttttaggcagagtctcactctgttacccaggctggagtatagtggcgtgatctcagctcactgcaacctctgcctcctgggttcaagtgattctcatgccttagcctctcaagtagctgaaattatacacgcactactacgccttgctaattcttgtatttttagtaaagatggggtttcaccatgttggccaggctattctcgaactcctcacctcaagtgatctgctcacctcggcctcccaaggtgtggggattacaggcatgagccaccgtgcctagcctctcttttcttacacagacttcctgctcaaatgtgtgagccttgtgcctaggtaggaaatataatcagtgtatagagtttgtagagagaagatttattcatcaatggtagaaaattgtaaaatgcaggagcagaagcttctttttcttctactcactaacccaatactgctctgtgctcactcttttggaaagcagtggattggcacagtggtaaaccttacctaagttccaatcaggtgtttcgaaggacttgaaggatgttgttgacacaggataacacttgttgtggttagtgatttgaaaaagagttgaaatataggagtacctcaaagaggtgagatctgtcattcatttcactcagtgatcccaacagacctgctgtggataggatggctctactctttgtaaacgttgaacttttggaatacacatacagacttgcatttatcggtacctcataaagtattttattacagagggactttctaaatatctcttgaatgaataaatgaaatgaaattcagaagttaggaacatgcctcacctgctctccatacagcaaacatcttaattccaaaatgaccttgccattcattaatttaccttaattaaaaaatatatacacttatgtacaaacatgtttaaataagcttttaattttagaacagttttagacttacaaaatttattaggaagataatacagagaattacagtacacctcatgtccagttaccccattttacattagtatgatacgtttttaaataatgaatgaaccaatattgatacattattattaactgaagtccatactttattcagatttactcagtttttcctaatggccttttgctgttccaggatcccatccaggatactgcattacatttaatagtcatatctccttaggctctttttggctatgaaatttcttagactttccttgtttttgatgcccttgatagttttggggccaggtatgctgtagaatatccctcagttgggatttatcttatttttttctcatggttaaattggggttatgacttttggggaggaatattataaggtgccattctcctcacctcccatcaagggtacatactatccacattatacccactgttttttttttttttttggaaacttaaaactcattttatgttattataagtaagaaattagcattcaatatatgccacaatatatctttgttgaagtgtaagtttgttccacttttctatttttcattttccaacttttattttaggttcgggggtacatatgaaagtttgttacaaggataaattgtatggggctggtataactgctagccatatgcagaagattgacactggatcccttccttttgccatatatgaaaatcaactcaacatgcgttaaaaagttaaatgtaaaatctaaaactataaaaaccctagataatatcactattgatgttaaccttgatgtcctggcttgaaatagcatttgtcagtttttgccacactgtaaagttgctccttttttctccattgccatactatactctttggaacaaagtcactatgcacagcccactattaaggacaaagtcttctattctaggccttctgtctttccatatgaactttagaatccatgtgttagcttggattctaaaatagcttgctgggatgttgattgagattgcattgtatctataggtcaagttggaaagaactgacatcttaacaatatttaatcttctagtctatgaatcagaatatctctccatttatttaaatcttagactttcttcatctgtgttttctaattcatgcttataaatcctatacatattttgttatgtttatacctacgtatgtaatttcaggggtattactatagatggagtttttaaaatttcaaattccagttgttcattctagtatataaaaaagcaaatgactgggtgcgatggctcatgcctgtaatcccagcactttgggaggccgaggtgggtggatcacgaggtcaggagatcgagaccagcctggccaacatagtgaaaccccatctctactaaaaatacaaaaaattagctgggcatggtggcatgcgcctgtagtcccagttactccggaggctgaggcaggagaattgcttgcacccgggaggcaggggttgtggtgagccgagattgtgccactgcactctagcctgggcaatagagcgagactctgtctcaaaaaaaaaaaaaaaagcaattaacatttgtatgttaaccatgtatcctgcaaccctgctgtactcacttgttgactctaggagtttttttctttttttcttactttttttttttaatcctttgggattttctacatagacggtcaggtcatctgcaaataaaaagttatctttattccttcccaatccgaatatcctttacttttctttcttctattattgtactagctaagacttctagtgcaatgttccataggagtggtgagagaggacatccttaccttgttcccagtcttaggggaaaagtgtctaatttctcactgttaagtatgatgttggttataggtattttgtagatgttctttatcaaattgaggaagtttctctccattcctagtttgctgagagttttcatcatgaatgggtgttgtacaaacaacattttaacaaaaataaaagaaaaagaaagcaatcctactgccttaataagtcgactggttttctgtattttcacatttttttctatttcaaataaatgaagtatactcaaaagagacatgtctaacagggagcgattatacaagtataattatatacccatagatagacataatattacatatttggtgattagaatgtaaatttaattttacagttccctttgtacttcattatatcatacgccatttttaatgttcctgcacagacttcaaaatcatagtttttggtgtctccaaattcaatttccataattcattaactaattcatttcaaagcatttattgcacatccaatacacaccaggtcctgataatagagatttaaagaaggatatggctactctcgggtttctcacagtcatggaatcaaatgcctgataatatagtgtgtttaagttatctttatagaaatatgaacagagagttttgggagcttggaggatgaataggggaatctaattctatggagaaattagaaaagtcttgttgaaggaagtgacatttgatgtaactcttgaaggacaggaaattttccagatgaagaaatagtaatatttacgaaggtttaaagttgtgcaagagcctagagtgtttcaggaacaatttaataacttagaaatttgagattaaataaggacaacactggatgaagattaaaagataaaccgggctagattgtgaaatgtgctaaatttcaaaataaggaattttgttttccatatggaatcaagagaaactattaagcagtggagtggcaggatctactttgtatttatcaggatacccatggagtggtgtggaaggtaaattctgcatgttgaggctgggcgcggtggctcacgcctgtaatcccagcactttgggaggctgaggcgggcggatcacgaggtcaggagatcgagtccagcctggctaacatggtgaaaccccgtctctactaaaagcacaaaaaaaattagccaggcatagtggcgcgtgcctgtaggcccagctacttgggaggctgaggcaggaaaattgcttgaacccaggaggcagaggttgcagggagctgagatcgtgctactgcactccagcctggcgacagagtgagactccatctcaaaaaaaaaaaattctgcatgttgagatactataatttactaaaccattcatctattttgggaacatttaacattgttactaattaattgctatttaagttatacaaaaatatatctatgcatttgactttatattattttgaaatttttcttgggacaaaattttgggagatacatatatcttattgaagtctttttgagataaatgttgatgtattttattagttttcttatgcattttgtgaaacttacatcttattctgtatatccctttctcaatacaatttgatatgcatccattaaacatttattgagtgctatttatcattgtggatgctgtggggaaaaccatgagtacaattcaaggggcttacaatctagttggagagataaggaatacactacaaaacattatggaggtctttgaatcctaagctgagaaataggaactttattctgcaggaaatgggaaaacatctaaaattttaattagggcagagatttagtccagccacaccttagagagaacactttggttgaaacaggtaggctagattagaagaagagacttcaaaggagtcttatgaaaatgttattagcagttaaagaaatgagatgttggattataggtcagagaaatgggaatgatcaatttaggattcctagattgaataattaagcaataaaaatgggagaaaaacaatcctaaaggtggacaaagccaacaaacaacaaacactctcctttgtggctatttaatgtttcataatactcaatatctcaatatctgttcatttctagaataaaaagggaggaggagatccaaattgattaaggtgattttccatagtcaaaacaatttttgaaaatctaaaaatttgaaaactcctcatttgtgaaatctcggtgacaggctgggtagattgcatcattgcattactttatgtgatcaccacaacaatgctataagatagttaataggaagtttttttttctttttctttttcttttttttgagacggagttttgctcttgttgcccaggctggagtgcaatggcgctatctctgtcaccgcaacctccgcctcccgggttcaagcgattctcctgcctcagccccccgactagctgggattacaggcatgcgccaccacgcccggctaattttgtatttttagtagagacagggtttctccatgttggtcaggctggtcttgaactcccgacctcagatgatctacccacctcagcctcccaaagtgctgggattacaggcatgagccaccacgcccggcctcaataggaagtttttgaggatgcaaagaagtttgttgtaggggaaagaacactgaattgaggattaatgtcatttaatgcagtgcatctcagtttgcatgagcatctgaattctgaatcacatgaagattttgctaagatgcaggttctgattcagtaggtctgaggtggggcctgagagtctgcatttctaacacaatctctcaagggaagccccagctgctagtctacagaccatactttggtagtaaggatctagagcagtggttctcaaatttcagttgtttttttgggcatttagcttgtctcatttttgtattatgaataatgctggtattaacatcctttaacataaatcttcctaagcgatgctgaatatttttttaaaaggctaggtaaattgcaaggagtttcatatacattttaacactgctctccagaaaacgctggagatgttatactctttccagtatatggaaactgttacactctttcctgtgtatcttcccattttgcctcattgttactcatttaaaagactattactcagtgttagtaactttctgttcacatgtttagaacttcagctgggatagaatagaataggtagaatttttggggactggccatatattttctgtcccagacattctcttcatgtggtgaggctggacttcctcaagctatggtggtctcatggtagttggatttctcatatggctgctagcttctaccagagcgagctttctgagacccaggcagaatccgcaaggctacttatgacttggtcttggaagccattcagtgtcatttcaactgtatgctgttggtcaaaagcaagtcataaagataactgagattcaaggggaagggactacataagggcacaaatactggaaggtgtgtgtgtgatttaattgacacttctttcagaaaactttttcagatgtctattggctattataaaacatgaagatgatcctcaagttgctatgaatactttctatttattgcaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaaggtagaaaattgtgtgggtatctttgtgtttgaagttgtttgccaagtaaatgaataacgtggtttcagttaccaatgtttacttctaaagattggcttgatttgcacatgtatttatcctacccaggcaaaaactccattctttgtcctcctttgctcctcaaaaatattcaagggacagtctctctttcatatattttggctgcagatacaggaagccagctggcagagtgttttcattaccttcatttcacattatttgattgcaataaacagatgaagggaaatgttttccccattacagaagggaactgataggtatgggaactttaaaactctctggttccacaacttgtccattactgcttagcccttttgtactttctgaagtactttccaatatatttgtttacatgaacatcataaaaacccagtaaagtatagctcttgggtagttaactctggtgtagaggggagaacatggaattgcagaataaaaacctgaattctggtgcttgccctaccactaactaacttagatgttagacaagcaatttcctcaatttcaatttttaaaaattttcttgtttgtaaaacaagatgattgtaccagatcacttctgtggttccttcctgctctaaagtattctaggacttttctataatttctgatcacgaccataaaagaattttatggtcagatatttctgacagctggcaaaaagcccaaaccttctgccttctgatcatcctgctaagtcatgcctttttctgcttaatgacaataagaaaatgaaaacatctagtgaacttctaaagtaagtcatttacattccagtggtgcttctcttcatttatttaaacaatacttattgaacaagtttgctaccatactaagcattgaatatgcaaagacaaaaaagaaaaatcagtaactttatagtctagttaaggggataaaaatgaagaaaaattttattataaatataattaataaaaatagagagttacatggggacaaatgctagagatctatacgttgcagctcggaggaaagatgttgaacccatcaggacatgaaatatcaggttccagggaagttttcttaaagaagataaagttttcttaaagctgagtcttgaaggatgagtaggagtctaccaaataaggaataaaagggtgatctcggcagaggcaccagcctgtgtaaaagaacatgatagaggaactataaatagtgctggattgctagtgcatgcaggggtggtttgtctctcttttttttttttgtttttttgttttttttcagacagagtcttgctctgttgcccaggctggagtacagtgacacgatctcggctcactgcaacctccacctcccaagttcaagcaattctcccgcctcagcctcccgagtagctgggattacaagcatgtgccaccacacccactaatttttgtatttgtagtagagacggggtttcgccatgttggccaggtgagttttgaactcctgacctcgggtgattcacctggctcagcctcccaaagtgctgggattacatgcgtgagccaccgcacccggccgggatggtgtctctattagtccatgaagacattatggtcatgggcccgtagaagcacatagtgtttccttaacctaagtagggtaacccatatttattattttttataaagctaaaaatcataacactatcctgtttcacagcctctttctttatagttctttgtaaaatgggtatttatgggagccaaagggagattcatttatataaaatgagagccactgaggtgtttttctaccctaccaggaaaaggagccctatagctcagtcacttatttaaaggtagccaggagaagagaacctagggtaagaagacatcagaaggtctcaggacatataggggtcaggagaagaataggcatttagtgcatggagtgtcataaaagcacaggagaagcccaggctttactcaggtgttacagtgccttaggacctggaccaagagacctggtgacttgcacttttctagaagaggagggtacattagcctgccaacactatgttatttttttctgtcttgtggaaattttctcattctgactacagccccaaacagttcttatttgtggagtatgaaaatcaaatatccctgcatgggtcctattatgtgatagtgtctgtgatatcagccctttgtgtaacactatgcaaggagagtcatgtcagggatgtcccctgtggttatcacttttcttttcagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggtgagcagcttaccaggaaggaagacccttgacccatgcctgtgacctgacccctgaggaatgggaggattgtggtctgagtaattcctactttggaatgaagtaagacttatcctaattattcttgttccccagaaggatgttggggtaacttgtattactgccatttttgtaattttggagattagagcaaaatttgcagtctatttagttttacaatgactttagtcattgtatcaaatgactggagtatcaaagggaagaatgtggagttcttgaggagcattaggtagaataaggaatttttcagcagtaaacacaaatattgagtttctaaggaaggaatgaaagcttgaagaatttcagtctttggcctggattttcattttaaaaaaaaaagcactctatactctaaagtatataagaatatatgtgctgtaagtgaaatgcgagtaggtatttaaggggatgaaaagataaaagagaatggaggttttctgaggcagtttatatttatatctctaaatccaaaatacaaacacatcctgagttaagcaaagtacatatgacaaggaaatcacaaggtactactctgaggctatgggaaaagaaaataggcaaaaatactgagaaaggcaagaaagtagctgagtaaagagaacacttggagaatatatgcttaaacttaagtctgcaaaaaaaacaaatgacttgacaaatgatatctatcatgtaaaccattacccaataattattttcccttctcttgcaggaattgagaagttcaaagggcagtacttccacagtcgagactataagaacccagagggattcactggaaagagagtcattataattggcattgggaattctggaggggatctggctgtagagattagccaaacagccaagcaggtttgaatcactcaattattatttacgttgcttaactctagcttcagtttctccaaggaagctgcaggtggacccaacagagaatagggatacctgcacatagcccttcagtgccagtggcaaatatagggcttcgtttcattacctcagttggcaacatggtgattggtgctaatagaggagttaaggctaccagttagagttccattgtgcaactagcctcacaccaaggaactggatcagctaaagtctgggctcattatcctaatcaggcatcttctcagagtgtgcctctggctttgataaagacaaagtaattgctgggagaggttgttagaaagcagtattgagagcgaggatcttcaattggccagcagaagtgctatgttcttacataaaggaaagcacgcgtgatcattggaaacttttcactcataggatggtgcttgaattttcctttacactccccaaatggaaaaaagtatcaattttatcttcccaaagacaatgtgggtatccgtatagcgtccaaactgtagcacatgcaagcagcttgccctggcctttgcatacagttaggtaactcagataacattcattctaaagcaattatatctccttggctttttgttttgtttgttttggtttttgtatagcagactttgaactgagaagcaagtgtcttcactataaattcctggaaaaagacatgccaatattgtattttgttattaatgtctgtgttgaatcaaactctattggcaataggtaaatgtcttggttgttctttagtaactttaattaagccatgcttctctataaagatgttttaaattgttttattttaattagaagcttagtgctacaattctgttaaatgactcttactcagcaactttgtttgaaaaacacttcttctcattgctatcctcatctataaccacaaaaattatttcatatgatacttcataaattaattcaacagacatttatcaggaaataatcatataaacaaggattaaaaataattaaaataattatataaacaagggttaaaacgtatgtgggtgttatggtagaggaatgtgcaaaatgtggagtggggacccatggcgagagccatctttaatatcattggcttgtcaaatgggcagttctaagggagcttggccttacctgctctggggaattgcaggttgccacataacaaagcatttctgtgtgggtacagataaggtggctgtgtctgtgagaaagcctgggaaaatgcaaaggaaaactatgtctgcatagcagaggcaatactgtcacaccactaatccaagctgaagaaactcaattgctgagttctaactttttactttacttgtaaattgtattcatgatgatttgtttataaatcaaaaactttaaatggacctatatatttcagtatatcatggaagtttttcgtataattcttgtagatgcttttgtaaagagaaaacattcctttttttcaatattaatttcatataagattacactgattaaacaattttccttataaatctgatttgtaaatgttatttgcttaaaacaaggtatagatggaaaactgaaataagaaatatgacagccattaagcacttatcaagtgtttactatataccacaccttttacaaaaacactgcttaattatcacaacagccttgtgatatatgtattattattattactatttcataaataggaaatcttttcattagggctctgagcgttttcattactcagcagaagttatatagccagcacacaaaattgttcagtttctaagaccatatatgctctttcaactgtgactgtggaagtacataattatcagagtgcttacagtcactttaggcgagataagatttgtgaagtaaacaattatccctctgtagacaggtcattttagacaaaaagactatgaagcaatgtgcgtatataacttaaaatctggaagccatctccagagagtttcatagtgtaggaaaagtgattcttttgccaggtaactgcatatcaaatctttatcagttctgaacatgaactttagccagaggaggacacagaaagactgactagcttcctgttgttccactagcaatcttatttttctccattaaataatcaatcaaacatttcttaagcacaggctttggagttagtcagacctgggttggaaattcacctctgccacttactagctctgtgatctcaggcaagttattcatcctttccatgcccctcatctataacatgggtgtaataatactttcctcaagaggttgttgtaatatagatgaaggacctagcacaatgacttaaaggtcacaaatcccaataaatggaagtgatgataatctgctgtggatgtgtaggctttatctcctatccttgagaaaacacatttgaagagacagaaattaggagtgtagaaagtttaatatcaataaaaatgataaatagcaggggtttttgtaataatgccaacaatgtcaatggcaaaagaatgagggttttagattaaatggtctccagctgctttcaactttaccagtacatgatttttaatgagttctacaggtgataagtgctagagaaattcagaggatggagagaaaattgtcagcctgaatagtcagcggtttcttcatggaggaggcagtcttgatctgggtcttaaaaatgaacaggcttcgcagagttaagaggaaagaaggcatttcaggcaggcataatagcactaaacagaaatacaacggtgtattagagcaaaacatattcttggacagtagatacaccaatttaattctaagtttagtgtttgggaaggaaaatggcaggaaacaaacataaaaacccacaaagattgtgcaggggctaaaaagccagactaatgagtttgaactctttttttttttttttttttttttgagacggagtctcactctgttgcccaggctggagtgcagtggtgcgatcttggctcactgcaagctccgcctcccaggttgacgccattctcctgcctcagcctcccgagtagctgggactacaggcacctgcaaccacgcctggctaattttttgtatttttagtagagacggggtttttcagtagagacggggtttcactgtgttagccaggatggtctcgatctcctgacctcgtgatccgcccgccttggcctcccaaagtgctgggattacaggcgtgagccaccgcgccgggcctgaaatgattcttgaagaaaatgggggtgcttttgaaggtttacgaatctgagtgacaaaagcaaacaatttcttccatgccccaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggtatgttcccaggatgggagtgcagggatagtggccaaagcacaagaataaggactcttcacactggctaatagtaaagccacctctacccatacattaagaaaacccacagtggctgggcatggtggctcacgcctgtaatcccagcactctgggaggcggaggcgggtggatcacctgagctcaggagtttgagaccatcctggccaacacggtgaaaccccatctctactaaaaacacaaaattagccaggtgtggtggcacctgtctgtagtcccagctattcaggaggctgaggcaggagaatcacctgagccctggaggcagaggttgcagtgagctgagattgcaccactgcactccagcctgggcaacagactctgtctcaaaaagaaaaaaaaaaaaaaagaaaagaaaaagaaaagaaagcctatagactcatagaatctgaaatcagatttctaacttgtacccacagatgtccaagatctattggtctgtgggtttttaatctagaattctctttggcagtaacccttttctcattcccccaggtatcagttctttttgcatgatacccaacaacaaaatgatagctgaggacagtgcgtcatttactcattgagtacctgttatgagccaggcatcatacatgggcatgaaatacagagagaagacataatagtaatagtaatagaaataacactcacctttctgaggactttctataagataagcacagtgctaaatgagttacatgcagtatctcacttaatcctgacaatagccctataagttggtactatttttgtttcacagtgaggaggtctatgcaaacctaccccaaaggctgaggaagctgagaggctgaagaaagaagctgacagattcagtttcttagaaacatttcatagggacttatgaacagaagccatgtctgtctcaggcagtggtgagacaagatggtagatccccataccattacctcctgacccagggatgatataccacaggggaggggcacacatacttcagagcgaatgggtaggagtttgccctaagggtgggatttacagtaagtacatactattaaacaacagattaactggaaatctcagaggtattcccggaaccagggttgatcagaagtcaatatggtagattaacttctaagatggagttgctttggcctccacaatttttgatctacattttacaaatataaaaactgagatgtagagaaactaagtaattttcccgagggcaacagaaataataaatggcagactcaaaaaatagatcttaccttaaatactctaatgagaagaaagaggacagattataatgaagaaatacatacagtgttatgaaagtacaaaggatggggtcctcagagaaccagggagggaaaacatttctagaggctgattttaaatttattttccctccaactttttatttttgaaaatgttcagatctacagaaaagttgcaaaataataagtacaatgagcacccatatatccttcacctggattcacctgttaagtttgctatatttgcttcctttccccatctctgtagataggtccatacatatagagcatacatacacaagtacatttttttctgaaaccatttgagtacgttgcagtcattaagacactttaaatacttcagtgtatattgtataagaaaaagggcattctcctacataaccatcatataattatcacacgtgggaaatttaacattgataaaatacattaatacattggcaatatccccagttgccccaatagtattttttatagctttaaaaaaatctttttaaatctagtatcctgtcaggtaatcaatcacaccattacatttagttgtcatgtctctttaatctctctttttatatatatatatttttattatactttaagttctagggtacatgtgcacaacgtgcaggtttgttatatatgtatatatgtgccatgttggtgtgctgcacccattaacttgtcatttacatccattaacttgtcatttacatcagatatatctcctaatgctatgcttccccactcttcccaccccacaacaggccctggtgtgtgatgttccccttcctgtgtccaagtgttctcattgttcagttcccacctatgagtgagaacatgcagtgtttggttttttgtccttgcgatagtttgctgagaatgatggtttctagcttcatccatgtctctacaaaggacatgaactcatcattttttatggctgcatagtattccatggtgtatatgtgccacattttcttaatccagtctatcattgttggacatttgggttggttccaagtccttgctattgtgaatagtgccgcaataaacatacgtgtgcatgtgtctttatagcatcatgatttataatcctttgggtatatacccagtaatgggatggttgggtcaaatggtatttctagttctttttgaggaatcgccacactgtcttccacaatggttgaactagtttacagtcccaccaacagtgtaaaagtgttcctatttctccacatcctctccagcacctgttgtttcctgactttttaatgatccccattctaactggtgtgagatggtatctcattgtggttttgatttgtatttctctggtggccagtgatgatgagcattttttcatgtgtttttggctgcataaacatcttcttttgagaagtgtctgttcatttccttcacccactttttgatggggttgtttgtttttttcttgtaaatttgtttgagttcattgtagattctggatattagccctttgtcagatgagcaggttgcaaaaattttctcccattttataggttgcctgttcactttgatggtagtttcttttgctgtgcagaagctctttagtttaattagatcccatttgtcaattttggcttttgttgccatggcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatcaagtttcagctttgtacatacggctagccagttttcccagcaccatttgttaaatagggaatcctttccccatttcttgtttttgtcaggtttgtcaaagatcaaatagttgtagatatgtggtattatttctgagggctctgttctgttccattggtctatataagaaataattctctctttgacatgggctttctttttaagaacccaaggcattgttttgtagagagtctctaaatttagacttgcataatttttttcctttattatattcaggttaaatgtttttgacacatatactacataggacatgttgatcttagtgggtcacatcaagaaccacattatgtcagtttatctcacagtaataatgctaaatttgaccacttagataaggtggtatagataccatcaagtttctccactataaagatattttttcccgttgaagttaatcagtggggtgacatttggagactgtgtttcctaaaaacctttcacctaattattttagcatgcatgtttttggtggttgcaaaataaattgaggctttgttgaataataggagatagccaaacaaatagagcaagggtatagcattctaattataaagacaaagtcttggaacagcaaaaaatacattatgctccaggacttgcatgtagtctggtatggctggactatatagcaaagatggaagagtgactgaatgtatctccaggttcatcaggcatgaaaacctttggttcctccgcggtcttctgagcggtcacgtgaacggcttcctgcaggctggccatggcgcttcaagttcccaaggctccgggcttcgcccagatgctcaaggagggagcgaaacacttttcagaattagaagaggctgtgtatagaaacatacaagcttgcaaggagcttgcccaaaccactcgtacagcatatggacgaaatggaatgaaaaaaatggttatcaactacttggagaagttgtttgtgacaaatgatgcagcgactattttaagagaactagaagtacagcatcctgctgcaaaaatgactgtaatggcttctcatatgcaagagcaagaagttggagatggcacaaacattgttctggtatttgctggagctctcctggaattagctgaagaacttctgaggattggcctgtcagtttcagaggtcatagaaggttatgaaatagcttgcagaaaagctcatgagattcttcctaatttggtacgttgttctgcaaaaaaccttcgagatgttgatgaagtctcatctctacttcgtacctctgtaatgtgtaaacaatatggtaatgaagtatttctggccaagcttattgttcaggcatgcgtatctatttttcctgattctggccatttcaaagttgataacatcagagtttgtaaaattctgggctgtggtatcacttcctcttcagtattgcatggcatggtttttaagaaggaaacagaaggtgatgtacatctgtcaaagatgcaaaaatagcagtgtactcttgtccttttgatggcatgataacagaaactaagggaacagtgttgataaagactgatgaagaattgatgaatttaagtaagggagaagaaaatctcatggatgcataagtcaaagctattgctgatactggtgcaaatgttgtagtaacaggtggcaaagtggcagacatggctcttcattatgcaaacaaatataatatgatgttagtgaagctaaactcaaaatgggatgtccgaagactctgtaaaacagttggtgctacagctcttcctagattgacacctcctgtccttgaagaaatgggacactgagacagtgtttacctctcagaagttggagatactcaggtggtggtttttaagcatgaaaaggaagatggcatcatttctaccatagtacttcggggctctacagacaatctgatggatgacatagaaagggcagtagatgatggtgttaatactttcaaagttcttacaagggataaacgtcttgtacccagaggtggagcaacagaaattgaattagccaaacagatcacatcatatggagagacatgtcctggacttgaacagtacgctattaagaagtttgctgaggcgtttgaagctattccccgtgcactggcagaaatactctggagaaaactctggagttaaggccaatgaagtaatctctaaactttatgcagtacctcaagaaggaaataaaaatgttggattagatactgaggctgtagtccctgctgtaacggacatgttggaagctggtgttctagatacttacctgggaaaacactggtctatcaaactcgctgctaatgctgcagtcactgtacttagagtgggtcaggtaatcatggcaaaaccagatggtgggcccaagcctccaagtgggaagaaagactgggatgatgaccaaaatgattgaaattggcttaatttttactgtaggtgaaggctgtatttgtagtagtattctaagaatcgcgtgatgttttcttattctccttacattaagaggtattttgtgtttgtattcttggctggatgttataataaacatattgttactgtcaaaaaaaaaaaaaaaggaaacctttggtctactaaataaaaagtatggaatgaagacagtccaaagccattcaaagatttaggcaagtgagtaacataatcatacctacattttagaaagaccattttgaaaatggtgtgggagtgggatgagacaggaggtcctaaagacaattgtatcatctggttgagataacaaggagtagataaaactatcttggggatgttaagaggagaaagggaaaaggcttggtgaccagatatataactcatggttttgtgggttgggcaactatatggatggatggtggtactgctggtgaaaaggagtaggtttggagaaaaagatgaaatcatgaggttggaatgcagaacacaatcgacctagtgtcaaagcataactaaatgcaacaaaccagtagtggtaatttaaacatataaaattcctgaggccaggacagctctgtctgaagatgagttaatatagtattcaggcattaagactactttttaggccaggtgctgtggctcacgcctgtaatcccagcactttgggaggctgaagtgggaggatcacgaggtcaggagttcgagaccagcttggccaacatggtgaaaccctgtctctactaaaaatacaaaaattagccaggcatggtggcaggtgcctgtagtccaagctactcgggaggctgagacagcagaatcacttgaacctgggaggtggaggttgcagtgagccaagatcatgccactgcactccagcttcggcaaaagagtgagactctgtctcaaaaaaaaaaaaaaaaaaaaaaagactgctttttagaaagctccacgatactagaaaccagccttattattattaaaagtaatggcaaaaaaataagcaattacttttgcaccaacccaatgtttccagtatccgtatcctacgctgtccctaggaaacaataacaagcccgaagtataccaagataattcactgaaaacaactttgagataaattctaaaatcctaggctgtgtatcattggacaagtcacataacttttctaggcctcaattccctcatttataaaacctggataatgacacctattctgcttccttcatagagttttgtgagagtcaagttaatgcatgtaaaagcaacttataaactgtaaattgctacatacatgtaatttatcatacagtttggaaaacagtggcctaaacttagctcttgagcctttgaaactggaaatgagactgaacagaatgttgacagcttagttctgtcagacttcttggtatgagaatacaaactattgacctgtggccttatcatatcacacacagaatattattgttacttgagaaatcatatatgcactcctcaaacaacactcttccttcactcctccaacactctccctttcagtgcatccagggtccaacttcagatctgatcttgatctgtgccaacctagtataaattagaccttttccaaacttcatgcatagaccaaggggaagattattggcatcctgtttacctccaccaaagcaaaattttacttatgtggtactgatttctctttctctcatttctccacttgatctttgtcacgactcacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtaagtgaccatgcaaatagactacttaattacttggtgatatgtttacctctgtttaggtacttgtttttaaatagctagagatagcatgtatgattacaacagtgcctagcacaaagttagtacagaaaaatatatttttgagtgaatctaaagtagcaatttataaccatggacatacatcatacctgggaaatttttccaagctatgcatgctttgacaccatccttgctgatgcttatttagttagtctggggtggggcagtcataacatctttgagaaaaatattccccagtaattccaatgtgtactccaaattagaatttactcatctagattttaggcaactggcatatgtttctgaagtaaaatagttttatcttctttcattatagataaaaataaaatatagaaatagtatgactttatttcggccgaaaattaagacctggttgcagactagtcaatattgtaggatattcaatcccccaaattctcacttttctccttttatgtcccctctttcagttttggctaggaatatatgaaaaaaaaaaggggaataggtttcatatgagtcagtagaatgatatagcttccaaagaaataattaaatctagcatcattaaaaaactataatgttctagaacattacaactgttgttctctaaactggccagaccacacctaatgatacattttaaaagtgaagctggagtgcgtttaataaggagagagagaaaaattttttaagggatttgaaaacatgccatctgaagtacaactgaaaaagccggagagagatttagcctggagaagataaacttcaggagagatatgagaatttccttcaaatatctgaagggaaggcacatggaagaaggattagatttactcagtatagcttcaaagggtcaaaccagaatcaaggagtgaaatcttgagggttacacatcagcttaccattaagaaaaaaatccaaaacctttttcctatcagccaatgccatttcatgatggaaccagctgcctctgaaattctaagcagaaaaggaaaaggatgccaaatgactgaatgctcactgggccggggcaggagagggggaaggtatggagtagattcaagcctcaggatagagagaaacaagatgatgtttaagggtccttctaaagaagaaattcactgattctatggttgttataacaaaatttgctattgttactagcatttaattaaaactactcagagttcctgttggaattacaccttttttgttttcactagtgaaaatcttcacagttgcagagaaaaaaagaaccaatggtattacagttgatagttcaacaacctttctaaatttccccaaatttctattacttccagtcctatccagcagattatgtactacctgagagaactatacaagtagtcaaacgcaaatagcccattaagttggcctaattctagtcatattaaagtgatcttttaattgggtcaattacataagcggagaacagttcattaaaacaggccacagcatcttagtatactttaagcaactgggactcttttccaagaccaagtgaattcttgagaggaaatagagaaaatgagtatttgcaagagtctgcattatggttatgagattatgggatcttagggaaaatgtacaaaaagcccagcttcctatgctagcagaagcctagtgctaattcctccagcttttttctaacacctggaaggaagaaatcttcagaattctctaactttaccagacttccaacaggaactctgggttttttattctgtccatggccaatctgtctgcctcccacattcttgcctttctcttccctgaattatcccttcactatgccaattttaaaccctttggattagcttgtttttcccatttttttcatgtctgcccaacaaagcctgcctccttccttgtctgttccctaccaagccccattttccttcttcttctgttctctggaattattgttctcttgtcaagaaaatattctactcttttctagaacactgaatttacttccttgccttgactgaaatgaaacatagtttctgttttgattgcgtcttttgcagcccttgcaagtgttttattttcactcagcaactttctttccttcaaaactatatcaagttacaccaaatctctggatcacaagaagtcattatgtcataggctggcattaaagttcctccacaaattggatacaacctccaatttcaggcccatctttctttcttttttttttttttttttttttttgagatgcagtctcgctctgtcgcccaggctggagtgcagtggcgctatctcggcccactgcaagttccaccttctgggttcaggccattctactgcctcagcctccccagtagctgggactacaggcgcccgccaccatgcccggctagtttttttgtgtttttaatacagacggggtttcaccatgttagccaggatggtctccatctcttgacctcgtgatccgcctgcctcagcctcccaaagtgctgggattacaggcatgagtcactgtacccggcctcaggcccatctttcactagtctttaccatacttcctacaatactctagatgcactggatgacgtacccactaagcagcaaacacagcaggtacccttgtaccctgtgcttttgcttccactgtgctttcttcttgatatgccctccttttactttttatttctataggaaaagtctatgcatatttcttccctccctttgtaatatagtgatagctccttaagtaaaggactcatgtttatttgcctttgtattgcaagcctagaccactgcctagcacataagaggtatctaataaacatctattctaagaaatgtcagtttagccttgaggtaaattaaattctaaattctgatgtagaaacttcttatttgaggatctcagcttatgggctaccttagccaatttccagttatgttaaaagcctgaactggactgaaattgcagaatgggagccagatctcttttctctcataacattagctatacactgaaatatgcaggagcaagtcaggattacacagatacaacctgctttaggctgacagcagactgaaggcctaccaccacagaactctaattcagactgtcttccttcccaccttgtcttggaacccttggaagatctctgaacttcagttcctcactgttcttcaacattcttcagataacatatactgaccttttagtatgtaccaggccttctgctaggggctggagaagcaaatatgaccatacagaaaatccctatctttctggaatgcagagccaagcaaggaagactgtgttagcccattctcatgctgctataaagaactgcctgaggctgagtagtttctaaaggaaagaggtttaattcactcacagttctgcatggctggggaggcctcaggaaacttacaatcatggcagaaggaacttcttcacagggtggcaggagagagaatgagtgctgagtgaaagggaaagccccgtataaaaccatcagatctcgtgagaactcactcagtatcatgagaacagcatgagcagtatgagagtaaccaccccatgattaaatcacctcccaccaggcccctcccatgacacatggggattgtgggacccaaaattcaagataagatttgggtggggacacagccaaaccatatcaaagacagacaagtaaacagacgcttaatgatttgttcattcagcagatatttaactatatcctaaacaagtgctccagtagcaatgcagaagagctgccatgagagcagtgggcaataagtacccaattctccctacaactacataggaatttactaaaaggacaaggaaatattgaccatagaggggaaataatcactactgtttatgcaaagttagatgaaagtgacagaacaaatagagttctgggaactgcaagtagttcagaatgctggtaaagtgttataggaatgaaggaaaatgaaactagaaatattcacaggcaatatcaagagtttgcatttaaggtacaagttggagaaccactgaaggattttaactggaagaggagtcaaatcagatctccagtttagaagatatgttagagaggagtgaaatgggaaataggtcagtacgagcctgtggtaaaagtctcagtaagacagcatgagagctttaaaccaaggtaatgacactctaaaggaattggaggagccagacttaaatgaaatttcacaggcaaatctgaagaatttggtgacagaaagcatgttggagaagagagacagaaaagaatctgttcaggtgttgaggccattcattggaattgggaaactaagacagggagcaaagacatggagggagataagaaatatggtaaagctaatgtgtctaaataaggaaacactgcaaaaacaaaatttatgaattaagacataactgtaccacagagtatacacgtaaaaagatgtatacatctttttaaaattttttaatttttttaaattttttcaccccatgagctctagactaagatgtatatacctctttatctatctatatatagacagatagggtaatagatagggttttttgttgtttttttctttcttttatgaattgggtgtctcccacaatcaagaaatatacctcctccttcatgtttctagctaatagaagtaaaacttgtggttgtgtagaagtaatttggaaattgactctcaaaacgcttattttgagtatccgaagagacctatgattaagcttaaatgaagcatttcagtgtttcctaattgatttatgacgataaataataattcccatggctaaaatgtaaaaacacatggaaaacaacagaaggctatttgagagtgatgaacttctgagttccatattttaagagggatacaccaggatagttattagagtatgcttagtgaagggcaaccaagatggcagagaatgtgaaaaccattatatgggaaacatgtactgtttagcctgataatgagaagacttaaaggagttatgacaatcatttccaaatgtttcaagagctgtcatgtattaacattaaactctgtggctccagaaagcagagcttggtccagtggtgcaaatgcaaagagtcagatcttggggtcaataaaaacaataatgttccagcagccagagcagtcaaataattatataatcacctcagatataattattatagatacccatcaccagtgatgtttaaagaggaatgagataaccactaggttagagtacttgtagaaagaatgcttgtatcaggtaaaatatattgccattctgaaattccatattccacaattttatggagtgacaccttaggactggatgtggccaaaatcttctacatggcatagtccctagttataggggcatacaactaattgtttaagcttagcattgttcatactggcttaaatactattaagccttagtctagccctgtccttggtgtataattcctacaactggaactgtttgtgcatcttacttaaatttatcagttaatattaggtattatgagttccccttggccttaacccctactcttatcaaagaaacatgtttagaaaatgaagcttatcttccacaggactttaggcataaaatgtgattaagatttattttggctgggcgtggtggctcatgcctgtaatcccagcaccttgggatgcagagacgggtggatcatctgaggtcaggagttcgagaccagcctgaccaatatggtgaaacctcgtctctactaaaactacaaaaaaaaattatttgggtttggtaggatatcagtgatggaagatgaaaggaatgaaatgaagtgagaagggaagtttagagaaaaaagaataaaaagaaacgaacaaagcatccaaggaatatgggactatgtgaaaagaccaaatctacgtcggattggtgaacctgaaagtgacggggagaatggaaccaagttggaaaacactctgcaggatattatccaggagaacttccccaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcagatctctcggcagtaactctacaagccaggagagagtgggggccaatattcaacattcttaaagaaaagaattttcaacccagaatttcatatccagccaaactaagcttcataagtgaaggagaaataaaatactttacagacaagcaaatgctgagagattttgtgaccaccaggcctgctctaaaagagctcctgaaggaagcactaaacatggaaaggaacaaccggtaccagccactgcaaaaacatgccaaaatgtaaagactgtcaaggctaggaagaaactgcatcaactaacaagcaaaataaccagctaacatcataatcacagaaccaaattcacacataacaatattaactttaaatgtaaatgggctaaatgctccaattaaaatacacagactggcaaattggataaagagtcaagacccaacagtgtgctgtattcaggaaacccatctcatgtgcagagacacacataggctcaaaataaagggatggaggaagatctaccaagcaaatcgaaaacaaaaaaaggcaggggttgcaatcctagtctctgataaaacagactttaaaccagcaaagatctaaagagacaaagaaggccattaaataatggtaaagggatcaattcaacaagaagacctaactatcctaaatatatatgcacccaatgcaggagcacccagattcataaagcaagtccttagtgacctacaaagagacttagactcccacgcaataataatgggagactttaacaccccactgtcaacattagacagatcaacgagacagaaggttaacaaggatacccaggaattgaactcagctctgcaccaagcagacctaatagacatctacagaactctccaccccaaatcaacggaatatacatttttttcagcaccacaccacacctattgcaaaattgatcacatagttggaagtaaagcactcctcagcaaatgtaaaagaacagaaattataacaaactgtctctcagaccacagtgcaatgaaactagaactcaggactaaaaaactcactcaaaaccactcaactacatggaaactgaacaacctgctcctgaatgactactgggtacataacgaaacgaaagcagaaataaagatgttctttgaaaccaatgggaacaaagacacaacataccagaatctctggaacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagaagaaggcaagaaataactaaaatcagagcagaactgaaggaaattaagtcacaaaaaacccttcaaaaaattaatgaatccaggagctggttttttgaaaggatcaacaaaattgataaactgctagcaagactaataaagaagaaaagagaagaatcaaatagatgcagtaaaaatgataaaggggatatcaccaccgatcccacagaaatacaaactaccatcagagaatactataaacacctctacacaaataaactagaaaatctagaagaaacggataaattcctcaacacatacaccctcccaagactaaaccaggaagaagctgaatctctgaatagaccaataacaggctctgaaattgtggcaataatcaatagcttaccaaccaaaaagagtccaggaccagatggattcacagccgaattctaccagaggtacaaagaggagctggtaccattccttctgaaactattccaatcaatagaaaaagaaggaatcttccctaactcattttatgaggccagcatcatcctgataccaaagcctggcagagacacaacaaaaaagaattttagaccaatatccttgatgaacattgatgcaaaaatcctcaataaaatactggcaaactgaatccagcagctcatcaaaaagcttatctgccatgatcaagtgggcttcatccctgggatgcaaggctggttcaacatacacaaatcaataaatgtaatccagcatataaacagaaccaatgacaaaaaccacatgattatctcaatagatgcagaaaaggcctttgacagaattcaacaacacttcatgctaaaaactctcaataaattaggtatcgatgggatgtatctgaaaataataagagctacctatgacaaacccacagccaatatcatactgaatgggcaaaaactggaagcattccctttgaaaactggcacaagatagggatgccctctctcaccactcctattcaacagagtgttggatattctggccagggcaattaggcaggagaaggaaataaagggtattcgattaggaaaagaggaagtcaaattgtccctgtttgcagacaacatgattgtatatctagaaaaccccattgtctcagcccaaaatctccttaagctgatgagcaacttcagcaaagtctcaggatacaaaatcaatgtacaaaaatcacaagcagtcttatacaccaacaacagacaaacagagagccaaatcatgagtgaactcccattcacaattgcttcaaagagaataaaatacctaggaatccaacttacaagggatgtgaaggacctcttcaaggagaaatacaaaccactgctcaatgaaataaaagaggatacaaagaaatggaagaacattccatgctcatgggtaggaagaatcaatatcgtgaaaatggccatactgcccaaggtaatttacagattaaatgccatccgcatcaagtgaccaatgactttcttcacagaattggaaaaaactattttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaagggagatatagatcaatggaacaggacagagccctcagaaataatgccgcatgtctacaaccatctgatctttgacaaacctgacaaaaacaagaaatggggaaaggattccctatttaataaatggtgctgggaaaactggctagccatatgtagaaagctgaaactggatcccttccttacaccttatacaaaaatcaattcaagatggactaaagaaactaccatcagagtgaacaggcaaccaagaaaatgggaaaaaattttcacaacctactcatctgacaaagggctaatatccagaatctacaatgaactcaaacaagtttataagaaaaaaacaaacaaccccatcaaaaagtgggcaaaggatatgaacagacacttctcaaaagaagacatttatgcagccaaaaaatacatgaaaaaattctcatcatcgctggccatcagagaaatgcaaatcaaaaccacaatgggataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcaggaatctagaactggaagtaccatttgacccaaccatcccattactgggtatatacccaaaggattataaatcatgctgctataaagacacatgcacacgtatgtttattgcggcactattcacaatagcaaagtcttggaaccaagccaaatgtccaacaacgatagactggattaagaaaatgtggcacatatacaccatggaatattatgcagccataaaaaatgaagagttcatgtcctttgtagggacatggattaaactggaaaccatcattctcagcaaactatcacaaggagaaaaaaccaaacaccgcatgttctcactcataggtgggaattgaacaatcagaacagatggacacaggaaggggaacatcacactccagggactgttgtggggtgggggtagtggggagggatagcattacgagatatacctaatgctaaatgacgagttaatgggtgctgcacaccagcatggcacatgtatacgtatgtaacaaacctgcacattgtgcacatgtaccctaaaacttaaggtataataataaaaacaaaaaatttatttttacttcattctctttctgttgatataaggtccctttgttatcaagaatacaggtgcagctgtgttttcccactcccctgccctttaactttgtaactaattttccatatacctttaagtccattttctcatgtccatatttcatttcccaactgaaagactacattagggaggaggcaggtattggttggaagtcagagtaggggaaatcccttccaaagacaaagaagaataagtagagtaagctgcagatgttaatattatattgtggtggtggtaaggtgatcaagtgaattgtaacctccttgagtacaggaaacttaccctgtatttctttgaattctccatagcatagtaattgtttataggattattgttccttctgaggtaattttacagttaaaatgttaatttttgtttttaggtctaaagacattgccctcacagagtgaaatgatggcagaaatatctaaagctcaagaggaaattgacaaaaggtaagaaactctcccaggaagatatatggttacatttctacttatttcttaataaaagaaatattgtactgtatttaactgcctcatgttagcttaaggatttagattctattatgaagaaaaaaggaaaaataatttgtgacaatagaatggagaaatagcactagtagtctaaatatgggtaagaaaagagagaaaagttttaggtgtctaaaatcatatgtttaatgcctaaaaaaagtcacataggaaaatgcatatggaaataaaatcagaaggcagaaggtatattatttttgtgaggattacttgaagtgctagtagacttgccagaggaaggaagagtgacagtaaatgaatgagaggtagctatgggtgaattacaaatctgtaggtagatttacaagtctgcagtggccgctttgctggcaatgctcatgtgacagcacactcaagtcacagtggctcatggtatgaatagtcactgtgagttgggaacatggtaacagccagctgcttagtgttttgatgaacacaatcatttagcagtctgaatttcagaacttaagctcaatcgctgggtgttttttatttggacaaagtggaaattgatggtaagtctctaaatttctgtggaaaactgagagacacaatcattccaggcctaaagaggtggttatcttcaactgatgatacttgcataactttcctttgtgtgggaggaggagaaagtaagtttttatttaattccgttacaacttccaggtgctctcctattttcctccttcctttcactgccaaacctctgcactaaattttctaaattctcaccttttgctgcctccctaagccttctgcattgttaacttccatccttactccttaaactgcctttttttttttttagacggagtctcactctgtcactcaggctggagtcagtggcacgatcttcgctcactgcaacctctgcctcctgggttcaagcgattctcctgcctcagcctcctgagtagctaggactacaggtgcacaccaccaaacccagctcatttttgtatttttagtagagatgggatttctccatgttggccaggctggtctcaaactcctgaccttgtgatctgcccgcctcagcctcccaaagtgctgggattacaggcatgagccaccgtacctggccggaaactgctctcttaaaggtcacctgtgaccaacttcattttccttcttctcactactgagtttggtgcttttaaacatttcttccttcttgcagtgctttcttttctggctctaaagtatcttattttaactttcctcctctctttcctttgacttatttttgtctaaccacctcctgaacctgagtagtcagtaacccaaggatataatgtaaccttttttttttttaacttctgaaatagtaaatatttatttatttatttattttatatttaagttctagggtacatgtgtacaacgtgcaggttttttacatatgtatacatgtaacctttattaaaggccgactatgtgtatacattgttttatatgagtttatttaatctgcataatcaaggcaggagctagtgaacctcttttgtgaaaccttcatgaatactatagctctttttttttttttttttttttttgatatggggtctcactctgttacccaggctggagtgaagtggtgtgatcttggctcactgcaacctccacttcctggagtcaagcaattctcccgcctcagcctcctgagtagctgggactacaggcatactaacaacgcccagctaatttttgtgttttctgtagagatggggtttcgccatgttgcccaggctgatctcgaactcctgagctcaaagtgatccgcctgcctcggcctcccaaagtgctaggattacaggcatgaaacaccacgcccaacctcatgaatagtatagatcttgacctactattataggataaataaatgcatgtctacaaactcttgagccaacatattgttcataagggaaagctctcaaattctttactgttttacctttttctctcctaaatctagtcccatttcaataaattcctacttgaccctctatcaggtcctctgaaattccatctcaccagttctacctcaaatttattttctatcatttttttcctgtccctgttcttggattcttcaatctcaattggcttgacttggcttttctcttcctctctgtcctacagttctttcttttcattacagaaagtaaaaagtgaaagtcactcattagctcaccaaatcccactccaccacacagatatcactgttaatcaaccacattttcccctttaaaaagcccttttaaatctttaaatctgcacttggtgtaataatttcatttgtctccatttggagggctacttcctcttgtggaataaatcattctccctcatcctttcaggattccaaattaacattggccctgggaagtcctgccctgtggaccctgtcaccactgccctcatcaaataatagaggatgccatacttgagaatttttgtgatgggttttctctttctcataacatcagagtcctttgtatctagatgtgctatacctgcccctcatcttatctgtatctttcacatccttcaagaacctaacgattacagctctcttttaactatcccctctccacatttctatttggcagtctgaaaccactcagaagtctcgcttcatgtttatctgtcttatctccttttgtaagtcctaagatccttaaggacagtgaccaatgttttatctttcttctctatattccacagctcctagtctgatattgagccaatagcaggcactcagaaggcagtaattgattgactgactgattgaattattgacaggccatggtttctgtcttttctactttaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaactttctaggctcacagtcattcagatcatctaccatctgccaatgagatcaacttggttgagaattttgggattttaaattagctgtcctacctttttaaatctcttttaaatccttcccatattaggatccaacaaaactttatcttaggaaatatgataagtagcttccaattgttgtagtgtggtctacaaatgtgatttgattcatcttcccccactctaattttctccccttttctcctcccttacatggagtctaagtaagtatttgaacaagtcatttatgtattaaattagaactgatattaactaaatgtaggaacattctgcttataccagtttttctcatgtcgtaaagtgtagttctgaaaaacagagcaaatgaaatgcaaagcaggtacttgggtttacatcccagtgccactgatgattctgttttctcatctgtggaagtttcactgttcttgtttcatggagaaattaactaagtgtcagctgtcaggcacactgaactcaggtgatgttcattaatagctgttgtacaatatgtttgtatttggattgctgcttattacttaacaacaggataaacctgaacaatggaaaagaccaacattagagagtattatctttccaaatacacacacctgtaagagaactggaaatgtgagaactacaacttcttcttatttaaacatttgaacaattgccggccctttcaccgaatttacctgtggaatgccttttgagagttagagaactgagaactggtattacttttcaggtcttttgctttccctaatccttgtgatactggagatttatcatctattaaaatggacctagtatttttaaatctgcatatcaaaagcaaattgaatgtctcttgcttccttttaatttcttttaacatataaatttctcttttagcatgtaaatttgttgaattaacagccctttgataatataattcctagttatcagcaataagtacaccagtttcttttttaaattaggagtatgtaattctaaattaattgattctctcattgtacatattatatgcaaggttacaaaaaaaaatcaatggttaatgattttttagctcaaccaagctaaaagatgtgaacaagaaattgaactcaaaacaacttaagatacaaagctcttgttactgataatgtctaataatattcatcaatttaccatatcttgttcttatattaaaatgttctatcattttcctaattattttaaagtcgattacaaaaatatatatatattcttgtagtgccagaaaattgaatacattaataaatggggtagaatagatgaatctcccatgaagaagaattccaaataatttatgaactctgccctcaaggatatggagcagaacttcctacttctctagtgtgagctgaatagtgacttccttccaaaaattacatatggaaagggggaaaataactttgtagtggagaaatctgataaacactatctcggctaggttatcaagattaacactaacagtaataagtcacactgatagtatgtacctttgagatgaagtgatgagaaggccactttacctctctgttgtattcctctcaaaaaccataatgcagtctaaccatgagaaaaacatcagacaaacccaagttgaagaatattctacaaatacctgactacctcaaaactgtcaagatcatcaacaaagaaagtctgagaaattgtcccggaataaaggggcctaaggagacataacatctaaatgtaatgtagtatcctggatggactcctgcaacagaaaaagaactttaagtaaaaattaagggaatattaataaagtatgcattttggttaataatgtatcaatattggtttattagttgtgacaaatgtaccagaggaatgtaaaatgtcaacaataaaggaaattggatgtggggtacatgagaatgctgtactatttttgcaacttttcttaaatctaaaact

SEQ ID NO: 13060 - DNA, 16581 bp, Human
ccaaagaatgagtttataagaggcagagcaaagaataggggagtagtgaatttgttgtacttaagtgggatgtcaacttcataatataaaaatgaacgtttcagcaaatagagctgctcactcagaaagggtggcctatgtaacttggggttccccatcattggccgtgtttaagcctaagtggcatatctggttagaaatggattacagtaaacagtattcctgtatccttcattccgcaaatgcaaaagcctactctgtataaggtacatgcagaatatgaaaaggtatcaaatctggatctgctctctgccagctgtcaaagcattgcttctcacacactttaatgtgatcttgttaaaatgcagattcagaaccctggggatggggcctgattctgcatttctaacaggctcccagttgacgccaacactgctggtctgtgtaacacagagtgataaacgtttctagaaggagacatgcaaatacttataatacaaaggtaagtaccttagggattccactaattttcataaaaaacctggatccctcccaaccctagggctgtctttgccctttttatacctttagtgttccttctgatgttttcgttgttgctatcttccttgaattttatttcttctgaggtttctcactgtgtatgctgtttcttagcctaggagagccttttcgttcttctcctaagactaacattttactaatttgtcaaggagctagagctcctaaacacgccatcttgaattcttccctgcgaccccagtcgggctgaaagctccttccttgtcgctccccactgaacagatttttcttggggcggggagagggggacggagtatcgctgagtcgccaggctggagtgcaatggcgcgatctcggctcaccgcaacctccgcctcccgggttcaagcgattcttctgcctcatcctcccaagtagctgggacttccggcgcgcgccaccacgcccagctaatttttgtatttttagtagagccggggtttcaccttgttggccaggatggtcttgatctcctgacttcgtgatctgctcgcctcagcctcccaaagtgctgggaatacaggcgtgagccactgcgcccggtcagaacagttttaacctccagcaatgaccactgcttccttctgcctgcagttggaagtcagtttcagttttcttattccctataaggaacccacctctccggtcgcctaacacacagatgctgcccagaaaacgtgctggcgcacctgaggcggggtagaaagccgtgccgctcctcccggcaccgagcaccggagcccagggaggcggcctccgagtgtcatttggggacgtcccttctgccgggtagtctcagaggccaagcgctcctattatcccgggcgcagtctccccaggcgggacaggccctgcctggcgccccctcctggcgctggaggctgcgtgcgactgcccaccatcgaggcggcggcggcggcggctagagaggccggcgggtcccgggcgccgaggctgcaggccgcagggaacgcgcactgggcggactccgcgccgccggccttgtagccattttaggaggaatcgctggtcgccagcgaggggtgcggcttcaatttcaataactttattggtggcctgatctgcagaacagccatcacatcagtggcccttggaggagggagcgcatcgcccgaggtgactggagtgggggcgcccctggcagtgagcgcggggacgcgggggaggtcccgatagcgggtttcctgagctagggccagtgagggcaccggggtatttgcaggcgttcccgcaggccaggagggagagggctccagggctcggcttccctggggcggggaatcccttgccctgtcccgaggcgcaggggcggggccggggggcgcccctgacgcggcggctgaggtgttcccagcccggtgtcgttccccgcggtaggtggtccccgacgagctgcagccatgggaaacaccaccagcgaccgggtgtccggggagcgccacggcgccaaggctgcacgctccgagggcgcaggcggccatgccccggggaaggagcacaagatcatggtggggagtacggacgaccccagcgtgttcagcctccctgactccaaggtaagcgtcccatgcccgcagttggtgtcagtactgcagcgggttgatttctgggctcctcttccctttcttggttcttttctaccgcgccgaaccgggctatggttttttgaattaaagggatttatcggggacagaggtgttggatgataattcctcttgaagtgccgcctcaaaataggataaagaggcggagttcttgctttcctggtgttctgactaatctgttggccacatttttaggatggggacaatagacatccccccatccccgatcctccgagcacgaatggctctcttccatagcgttgctgaatttgtagtttgtaatccctggtggacaacttcagagggtaggttgcacgagttgctgaccataggtggtagtttctcacctttgccctgaggtggctaaatgaaattctttttctgaaaatttctatgtatcagtatcatttttgctcttctagcagctctacagttgtgatcctcttcccttttggcacggctgtaagcagcaactacttgcttattgaatactttctcctagtcttggggatcaattaaggacatcatttagttgactgcttaatttttgtcccatactttatagttgtggtggctgaggctgtgcctctttcacgccccgctgctgctccgtaggtggaagagccaatgattccacgacttgtttactcctcagtagtacttcaaaatgttgcgtggctaaaaaaacgacaacccacagctgccctgaagaccttgctctcaattccaaggactttcaggaagagaacaacttgttttcactctgtaagaaaggacagatggagctgatagcagcgattaccattctaatgtttctaatggctttcagagctgtcagcatgaaatacaagtaattcctccaggtagactgactggatgagatagaaaaatggagggcttgaggagattcgggtgtgtttgatgtttcctatcatttcatcacttcccagggaactggggctttagagagtgaatagagtattgtttgccatattggtagcacatggaatttggattccatgatttatttctttggatctcaattgataacatcatcacagcctggcgcagaggctcacgcctgtaatcccagcactttgggaggccgaggcggttggatcatttgaggtcaggtgttcgagaccagcctgaccaacatggtgaaaccccgtctctactaaaaatacagaaaaagtagccgggcatgctggtgcatgcctgtagtcccagctactcgggaggctgaggcaggagaatcgcttgaacccgggaggcggtggttgcagtgagtttagatcaaaccactgcactccagcctgggtgacagactctcaaaacaaaaaaacaaaaaaacaaaaaaaccaaccataatcacagagaagtgagagtgattaaaaggagcacttattggggtttattctccaattctccattcttatttgggctatctacaagccatctgaatttacttcttcaaagctttcgaaaggtgatccgcctcattatatttttacccttttcctatgttgatgactcaggatttaaatacagtgtatttgtcgaactgtgactgcagtaattggtgtcctgattaaaagccaggttgctctgtctgaattggggcctattttgtattattcttatctctcacctcagtcttggcatttgtgaattaagaaaattattcatataattttcagattgtctgaaaatcagataattcctaaggtctcatttaagtctaaaattttatagttctcaatgtagcctctttacttctaaactcaacattttacttaaacatcaaactgtagttctgattgtcgttttgcctcttttcctggtagttttgctgagtaacttggagtaaacaatctttctgctagtcagttgcattcattcctactacagaaatgtcatgtcataagtggaagggctttcctccaaagctaggcatattaatagtttgtagctttcaaattctaaactgaaaatcctgtcataaaagtaactgacagaaacagtggcaggggggcctactttgctttgaatgcctgcctttttcagtggactagttcagtggttctcaatcctgtttgcacattagaatcacctcagatttctttaaatagtttttggaaaatttgaaacactttcaaagtagggggaaacagtataatgacatctatatacatgccacccagtttgaacaatgatcatatcttgaatgaacatataacatctataccccagtccactattctcccactagttattttgaagcaaattcccagatattatatcaagtattattttatctgtaacattttaggatgtacctctaaagatgagggttttttctttgttattttaacataatcacggtatatctgggaagctttttttcctttattttaacataatcacagtgttatctagaaagctttttaaaaataggttcccagatcttacatccgaatctgagggttattcttaggcatatgtcaaattcttgtaattctaacgcagccagttagtcaagagtgcattgttctgagaatatgtagttttctcttaagtcaattccttatgtgaaagtcctttcaattctctttctctatttactttggattatcctgctactgatatgctatactgtagttttgaggaatatcaagagaatgtatggagggaagctatgtcaaccattttgaaaagaaagcccaaatgaataagctagtcctttttttaaaaaaaaacccacattattcaatttagtaatatttaggcttaatactatacagtcttatttaccaaagtcacttaaaccagtctaaaataggggtcagcaatctttctgtaaagggccagatagtaaatagtttagactttgtagaccatacagtctctgttatagctacgcaattctgccactgtagcctgtaagcagctatagacaatataggtaagcaaggcaggtatgttggttcacacctctagtctcagcttctctggaagctgaggtgggaagatggcttgagcccaggagttcgaggctgcagtgagctatgattacaccactcactgcattccagcctgggtgacagagcaaggtcctttctcaatcaatcaatcagtaaaataataggtaaacaaatgggcagagctgttttcaaataacacttgataaaagcatctggcttactggctgtctgccaactcttggtccaaaggatagtaatgaaaagaaacaggagttactgtttttacaatcccataaacctcatttgataagagagctacttttgataaaggaaattgtatttttgatctcttgcttcttgaggttctagaatttttattcctactcctgaaataattagtataagcctgggataggggaataagtaagatttcatagccacttctcaagttttaagaaatcagtgatctagtttttgaatttttaatgtttcttctttttacttcttagctgaaatacagtttatgaattacttatgaattttgatatctctgacttccattacaactggtaattgagagctattcatatttgcctataaaaatatatggctgacttaattatcttttacagaaccatactttgttttcatttttttttcctctgaagaaagactcagaagcatatcataattgcctgcctatgagttaaactagtggtagggagttatttttttcttttttttttaagggagagtctaaggctctggaagggtaagtgacacaggtagactcaaaagttaggctatgatttaggcagtgcttgagcataggccatttgaccatttttggtcctagatgagttctttttctataatttgttcaaactctgatttagttgctaattttggggtttatatccttagccaaagcctagcacccttctctatcctagggaggagagtgacctttttagaattcttgggtcacagtttattctagggatgacctactccttcttacagctccctggggacaaagagtttgtatcatggcagcaggatttggaggactccgtaaagcccacacagcaggcccggcccactgttatccgctggtctgaaggaggcaaggaggtcttcatctctgggtccttcaacaattggagcaccaagattccactgattaagaggtgacaagtgtcttggttgaatctaagggtccaggaatagagacctgatttcttttctcagaagagagacccagctggacttttctccacctactaaggactgtctctagaacatgcccttttctgcggccacttagtatatctgtgggatttttttttaacctcatagtgagtcagagatgttttaccctttagaatttcattgcctcagagggattcataatagctttatggctacattctttaggactatgtcatacaagtcctgtctatgcttgtgggaagtcttttgtaactgtctgagtcttgttgctctgacttctgcactaaagcaaaacacattttgaatttttaggtagtcatgttatttgttgcttccaaagcaataatgagtgatttaactggttgtcagaatggccctttgtatggtagttcattctctagaaaaggttcaccaaaacagggaaagagtaccttgaggcacttctgtatcctaaacctacctatcttatttgcactggtgaggaacttgttctactgaagcaaagtaagttatactaaggtgaaccatttgaggggattaatgtttttattattcttttccagatattggttaagaactaacgttgttgggaggagctggtaaatacatgtccaagatgatacagaaaaggagaatgggtttatacgttgttttttacaccaggggatacaatggcttaggaatctgggaaattattcatatgatactatgattgccacttgttttttagattcagtcttctaaaaggaacttggcctgtttgcctttcttttttcttctgtagccataatgactttgttgccatcctggacctccctgagggagagcaccaatacaagttctttgtggatggacagtgggttcatgatccatcagaggtaaggccttgatctccaagggtaaccattgacttagcagtctcattttagctgtcatttctgtcaagactgatgggcagctgctcccctacactggaggatttctctcttgataaaacgtggaggtgctgagaacaatcgtgtaaattttagtaaaagaggaaggttggatggaagagatggatttgaaagagagattcaataattttttctattcactgtttcagcctgtggttaccagtcagcttggcacaattaacaatttgatccatgtcaagaaatctgattttgaggtgttcgatgctttaaagttagattctatggaaagttctgagacatcttgtagaggtaattttgtattatttactctctcttgctgtgtctttcttgtagttccttcctaaaagttgtttatgtgtgtatatacatatagagggagagagagagcagggggttggggggaggagagagagagacagagatttttctcctgtaaacatttaggtctcttatttgcagcaaacacaaacacacacattgtaacacaagtctcatgatacaatgtttaccttattacatgggatacactctattttccatgttatcttttataatcactaatgggctacagcctatagtttgaaaagctgtttctagtaatatttcaagttttccactgacctttgatgatattacccagcagaggcgatacatgtgtgtagtttgtttggtttgccccatcttaatcctgccagtttgagacctcagttagcagtttcatgattttatgaggtccaaaaaatgtggggaaaaaaatggtttaaaaaaccaacagcctgggcaatatggcaagacccatctctacaaaaaatttttaaaaattagccgagcgtaatggcacatgcctgtggtcccaacaatttgggaggctgaggcgtgaggattgcttgagcccaggaggtcgaggctgctgtgaagcatgtttgagcctcctcactccagcctgggcagcagagtgagatactgcctcaaaaacaagacaaccacccccctgccccctgacaattctgttgtaggtaattgaaattttgtaaatttttggttaaaaaaaaaaaagtctatggtagcggaaaatatctttacacttttatttcctctaatattatttgagccaaggccttcatctctgcttacaattgctatagtatcagagaatattttgctaaccacacttgtagttaccattttgttactttacaataagaactatctaaagaattgtgcacagtattcccagtgagcacacttctctcctgtgagttcaaagcctgcctctgctactaactagttttgccatcatgaacaaatctctcaacctttttcgttctgagtttcttcacagtaaaaccagggacttaaactttcagtgattctcagctgaggaggcacaataccttaagtggaacatatttgaatttcaggggagaagggtggctttgctgtttttaaaagaaattattggctgggcacactggctcaggcctgtaatcccagcactttgggagaccgaggcgggtggatgacgaggtcaggagatcaagaccatcctggctaacacggtgaaacctcatctctactaaaaaatacgaaaaattagctgggtgtggtggcaggcgcctgtagtcccagctactcgggaggctgaggcaggagaatgacgtgaacccgggaggcggagcttgcagtgagctgagatctcgccactgcactccagcctgggcgacagagcgagactattattaatagtgtaatcatctgttgaggaaacttttgaaaatgttgttttcatcatataagctcagaaggttaaattgggcattatttttgactggtgggacagtaatttaaaagggttttaaaatgctgaattagattatgaggatacttgtgactaatttttgcattatataattctggcaaagtaaccaataaatagacatgtatcataattatatagagagaagacttgcatacttttgatatttccctttctcctaatttcccaatctattgaggtaacgcttataatccattttttactaggaatctacagataatggattttagtctgcactcatttactgtctatccatgtatgtaactttaggcaaataaccaatttgtatttatttttttctggtgaaaaggcaataaaaactattctgtgcacttcccaagggtattttgtggatcatgtgacgaaataacaaagcataatactttgtaaggtttcaagttccatatgttttaaagatattatttaatatcagagtattacttctgcttttttcttttgccttatatgtattttttatttttaattgacacataacaattgtacatatttatgagatacaatgtgatgtttcaatacattttatatgtgtaatgatcgagtcagggcaattagcatattcatctcaaacatttgtcgtttcttcgtggtgataacattcaaaatcctttcttctagctattttattttgttacattattgttacctatattcactctactgtgcaacggaacactggaacttagttcttacaatgaatttggtggctcacacctgtaatcctagcactttgggaggccgaagtgggaggatcacttgagtccaggagtttgagaccagcctgggcaacatagtgagaccctgtctctacaaaaaaaatcaaaaaattagctgggcatggtagcatgtgcctttagtaccaactactctgaaggctgaggtgggaggatcacttgagcccaggaggtcaaggctgtagtgagccgtgatcaagccactgcactccagactcggtgacacagagcaagaccctctctcaaaaaagaaacaataacatttaaataaaatatattataatatatttctcttcatttttgtatattgtattcttgtctgcatactttttttcatttttttgagatgtaatttatacatcataaaattaactcttaaattgtacaactcagtaatttttagtatattcagagttatgtgattatcacaactatctaattccagagcatttttatcacccgcagaataaaccctgtacccattagcagtcacatcccattccctcctcccctccgtccctggcaaccacaagtcttgctgtcttaaggatttgcctgttctggacatttcatatcagtggaatcctacaatatgtggtcttttgtgactggcgtctttcacttagcataatgttttcagggttcatccatgttctaaccatgtatcagtacttcgctcttttttatggctgaataagagcccattgtgtggacatactgtttgtttatccattcagtagttgatagacatcttgattgtttccactttttggctattataaataatgctattatgaacactggtgtacaagtttttgtgtagacatatgttttcatttcttttgggtatatacccagtgtataatgctgggtcatgtggtaactttatgtttaactatttgaggaactgccaaactgttttccaaagtggctggactactttacattccctctagcagtgggaatagtgtgagcgttccaatttctccattcctttgttgacacttattactgtctgtctgtttgattttagctgtcctagtgagtatgaaatggtagcttattgtggttttgatttgcatttccctaatgacagttacatacattttgtccttattgttgcaatcattgttgtattggtagtcttaggagtttataaccttgttgtttggctggaaaaaagaaaaaatctaatcttttcccattgtttgaaagttacaaggcatctttacatccattatctaatttgatttccttaaaaacatcatgaaatagggcaaagattatttttattttataaagaaactgaccattgtggagggattcttccaaggtcctacagctgatacatgtagtagctcttccctgagcctgggtctttgagtctttatatctttgtctgtctcccaaatcatgttgctatgttgaggagcttcatggtttatgtccaggggactcagatttttcctctggttaccttacagctgtagatcccacaggtcacaagtttgtgatccaggacttctaccatatttaatgttagctgccatgtattgatagctttttccatgcattcttgctaattctccaactctttctcatatttgtataaatatctttcagacctttccagctcacccccagggccttatggtcaagaaatgtatgcgtttcgatctgaggaaagattcaaatccccacccatccttcctcctcatctacttcaagttattcttaacaaagacactaatatttctgtgagtatcctgagtattactggggcatctgggggtgtctaggaccatttggaccaaagttcagtaatcctagaggttaggattactacagaggtgtgttgagattataagtcatacacataccaataacattacagatttcctttttccagtggtgagtcacagctttttcaggtactgatataaaaattcatagttgtctcctcatcctaataaaatcaggatcagagctatggacttcttttgagcacaacataaaggagtagttatcatttgggggtgtacaaaagaactatgaaagcttttttgtatataattcatgtctctattcaatctacttgattcctactatgattgtttttgccttgtaacacaactcttccttgtgtgttgtgggcaagatttttgttttagctctcttaaggaagattagtagatgctgaggcatgagatttctgccctggactgataatttttctaattttctgtaataggattgtattattgatacatactagagtgggtgcattattgaaaagagatagcgcattctagtttaaatttctcaaagagctctgaggaagagtaagctgtttggtttgtctgtgcattaatttcatttagtaatttttttagtaatttttttctctttctcttagtgtgacccagccttactccctgagcccaaccatgttatgctgaaccatctctatgcattgtccattaaggtaagtggtggccctggctcttcacagagctccctggaatgagaggtcaagggtaacatacgttctcagtggttactttctctgctatttcattgaagctgaagctggcagtaatgatcaaattatagaagaactctcttttttttaactactaggttgtttgttttaaaatctcagtctctgtgttctggctggctgaattgccctctgataggacttttttgctgcccagttattttttgggtgactagaatctttacactaactgtttacttaagtttgtgttcatagcataggatttcttctgcagaaaaagcaggtttagcttccagttcaaagaatgcttgaatgtgatattaaggctttcattttttgaaggtggaattgagctactttcaggtgcctcattcatatatactcaggtgcttgcatctctcctatacactagttaaaggagagatgtgaccagatttgccctgtcccgtcaactctagagtcctccttggtttttctgctgctttagagtctgggttggaaatagccattctgttctgtcttgttatgtctttgtggtttggctattggaataaagttatatagctctgcagttatcaaaccaggctgattatcattagagtctcctggagaagattgtaaaaatacagattcagcagctccattcctagagattctgaataagtgcatctaggatgggccctataatttttttaagctgcttttacttggatatatagctggattcgggaaatcactgatatagctaacaaactatgtggtacaatataacacttaaaaatatattattgaatttaatttttataataacgttgtaagtatttttaactcctgttttatagataaagaaactaaggctcagagaaggtcaaattgccagtaagtaccagagacaggactgctgaggtccagtcctcctatgctgacttcatattctttcctatattatcattatgccaggtctttccaagtaggtttttctcaggtattcctcatttccacaaaacctgtggaagtgtaaaagtgaattgtttacctgccttgcttctgtcgtatttaggctttgtgtcagcatgactctggagtgttaacccgagaagcattcatggtggataatacagtacgggggaaggtagaaggatacacttgttcttaatcggatttgcttgggttctttgggatctgatggattttgcctcctgtaactgctccttggatgtcatttaatttgcctaggcttgccatctcctcctgtggtacatctgtagtctacaacacagcctgggaaatggtacctcttgctgtcttcttactggttctgactcaggtgaaggtgtttgattattgtggcttagcttggttctgacccattcctgattctctcatattgtttaggcagtttggaattgatccattggattgggtgtctttctgaagaggattttgacatctactttgttcaaggatagagagggattcctaggttccctctaaatcagagagatcttttggaagtcatccctggttttaaatgaaaattagacctgctttgggacttggaaatagtttttcagaaggattgtttctttttttcctcattgtctttaagactttcttctagaaatggatgccagaatattttgttcttttttgtttttcttgctagttttaggcccaacattagaatttaaagtagggaagggagcaaggtaggagactattatttcttcagcccttttatgtgtcagaaactgtgtcagatattctcatgtaatcatcagagcaaccttaatggtaggtgttatcttttgtaatgatgagataaaaagacttggacacactaagtagattacccaaggccacaagtagaatgatgataggagtcagaattggaactaaaacttatttgacctcctgctcttatatcaaactatctctgttaaaagtgagtgactgtgaaggactgatgactgggaagagctacctactgtctgaagtaatgaattagctgcgtatgtttcttttccttgcaggacagtgtgatggtccttagcgcaacccatcgctacaagaagaagtatgttactactctgctatacaagcccatttgaagggatcccttcttgcctctaaggattcaggagaagcatctcccttgcatttctggactgaaccagtcttacctgagactggaaggctgatttgctttgaggctgatatgtgtgtttcagagcctctgagtaggatgctctgcttttgcatttgattgcagatgagagctttatgagttcacggaatttattttaagaaaaaaaaatatacatatgagaagaaggtaaatggaagcctcctagccccagctagaagtattgtttctgcctgtgggttttcaccaagacctgtttgggggcgctgcaggaataactatataggaagatttttcctaaaatgaaagaacagcaaactcttaggatccttgttgggtggagattctatcactgctaccttggctctccaaggaatgggcttgtgctagaccgctgccctacttaacagctgcctcattgcaagggcagtttttcttgcatgggttctctatattcccagagtatgtggcacaatctgtgttgtttatatgataccagatgccccacaagaacccttattcctctcatttcacattcttcctttaatagcctccttcagatcccatacctgacccctctctaacacaaaacttattgggtaagtgactttgaaaagttttgtggcacctgacccaccccagacactagggctatcagaaggtctcctttttagcccagcacaggcccaggccactttgtcgtgtttgttttaacttctaaagaaaatatgtttcagcattataagaaaggcagaatgcagaacacctacatttttgttttagtttggtgccaaggctcaggctgtattggcaaattcccgaaagttttcccactttgcctggccctgcttctgtcttttctttctcagtaaacagttctgaaggcaggagtggaacccgggagtattttcatgtctttcatccttgaaagatttttatgtgcctgcattttttttttaattaaaaaatgccttttcattggtcttaagagaccgcattggagaatttcaggcttttgataaatgcttcttcaaagagattttcttctctagtctagccttccacattcttagattaatatggccaaccctgtacacatcactacactaaacactgctctagataaactgctcaagttcatttaactcatttgatgcacctaaaggggttcctcattttaaagatttgttaggccaagaagcaagagagtattcctagtattcccaaccatgaaaagtatcattctttgcaccaaatgttaacaaaatcattttgttctcctgcctcttctttttaaaggtgtttgatgattaagtggggtcactgaattccatttgtggactgaaaagtattcaatccacttttggggttcagagataaaacattttttcccaagtagctggggctcttccattttgcagataagtcaaataatcaacactaaaggaggctaaactgttgatgaatgagagactccctgactgctcagatgaccctagccacactgaaagggcacctacaggtcagtttagctacctcctgtctttcccatgcaaagctgataacacagttgtctttggacttgtagacctcttggattccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgt

SEQ ID NO: 13061 - DNA, 19059 bp, Human
aagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatctcctcttcagtgttgttctcttatttgaaaaagtatttagatattctcactaagtgcctaaagctgagcttggtttggggccaattaggggatgagtaaggagaaggtttgagtagggacactgtggtccccctgggatgggacaggctgaccattatatcaggaatagtttgaaccactgggcagggaaagagggagaagtcaaaggcaacaaagttccaaaacagaatccccaatacaaaggatgctttagagagagagagcagagtcaaaattcaagataaactggaacttatcataaaatctggaagcaggctggcacggtggctcatgcccgtaatcccaacactttgggaggctgagacaggtggatcacttgcggccaggagttcgagatcagcctatgcaacatagtgaaacccccatccctattttttttttcttttttgagatggagtctcgctctgtcgcccaggctggagtgcagtggcgcgatctcggctcactgcaagctccgcctcccgggttcacaccattcccctgcctcagcctcccgagtagctgggactacaggcgcccgccaccacgcccggctaatttttttgtgtttttagtagagacggggtttcaccgtgttagccaggatggtctcgatctcctgacctcatgatccacccgcctgggcctcccaagtgctgggattacaggcatgagccaccgtgcccagccccccatccctattttttaatattaaaaaaaaaaaaaatctgaggccaggcacaatggctcacacctgtaatcccagcattttgggaggctgaggagcacagatcgcttgagctcaggagttcgagaccaacctgggcaacatggcgaaaccccatccctaccaaaaatacaaaacagtctggcatggtggtgcatgcctgtggtcccagctacttggtaggctgaggtgggaggatcacttgagcctgggaggcggaggttgcagtgagctgagatggtgccactgcactccagcttgggcgagagagagacagacctcatctcaaaaaaaataaaaaataaaaaataataatccggaagcaggttaggtcagagagaaagttaggatgaagttcccacgtgaggtacttattgaggcactttatctgtggaatgagtcccgggctatgagcaagggtatctggaatcttggcttcggctttatggctaacttgctggttgacctttgccaagtcattcacctgtgagttcagctttcccatttgtaaaatggaataaactgtgtttccctcctcagcccctgatagttatagcagtaagaaaacgaaacgaaaagcagtcaaagcgttttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccggtgagtggggcaggaggaggggcgcgcgggccgggggcggggccgagcggggacatgggagtgacaggggtggggggagaagtaggagggactcccttgggaggggttcgggctctgggtgggggttgggggaggcagtgcgcagaaagagagggggaggcagttacacacctgctcctaggggcattgtttccctggggagtcggtagagaacctgggtgggtgaagtgggtccagggatacctgtatgagggccggagtgcaaaggggcttgagcagctccagtgatcagaggaacacagaacgtgtagctgacaaattgaggtcagcttctaaagagatagtagctagcagagtaaatgtggaactggcgatgtccgatgtgtcccatccaaaatagactgagaatttgagtataatctggctctcgcttagcttttggactctgtttttctatggagtcactactggagcaaagggttctcctctcattgtcctccattccatccctaaaccttacttcattcaaagatctcaggcgttccctgcttttctttcttgatggggtttagcaggtgaaaccatgacatctctgggtcctctcccctctgtagagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaagtaagatgatcctggggcagagggagggagggagggagcctgggaggacacaggtggtgggagtacctgaaccaagaagtggtggtgctgtgtcagcagatggtgctacagaactcatccttgagaatgcgtggtggtggtggtggtggtggtggtggtagttctttgagagaagctttgcagtcccttcacattactataaatggacgtgctgacagcttattttcacgttctgactagttctgtcccaacctgataatagtatttattcccaacagtgcaaagaaaaagaagatggctgacaaaattctacctcaaagggtgagtccaggctatatgtcttctggaaagtgtggtgagtttgagtatagagatgatcatcctagatttcaattaatttttctgttcctaagattcgtgaactggtaccagaatcccaggcctatatggatctcttggcttttgaaaggaaactggaccagactatcatgaggaaacggctagatatccaagaggccttgaaacgtcccatcaaggtaacacaggaaagtactaggcagagagccaaaggagaggacccaggaaccttcagcagaattaggatgagaaatcaaaggcacagcacaactctccttggcatttaaattgcatctctcccttccgcctacaaactgagaattacattaggaggataagaacagaatggcaaagggggaggggctcttgatgtctcttgcactacaaatatacccttgtccatgttttcgctgtaactgctctgctaccttgggaacctggcaccttgcatgactttgtccacctggcatcccactatatgcacttgtacttaggctgatggccagtactcctcttctaaatggaatcttcatccacccacccaagggactgggtagacagtaagccagtctgttaggagtaattttggggtttggggagaccgttgtcttcaacatcagaccactgaagccccacgatcaatcctgtttctgccttcctcagcaaaaacggaagctgcgaattttcatttctaacactttcaatccggctaagtcagatgccgaggatggggaagggacggtggcttcctgggagcttcgggtagaaggacggctcctggaggatgtgagttcaaggtccacaatggttggcatctagggtgggagctgctgggaatgaacagtgttgtctggtcagcaggaagcctaactggtgctcacagctccttttgggagcagtaaggagagggacactgttccctgcactgaaagacagtggtcctttgtgtttgcccccacacctttggccctcactggtatcatatggagaaccttattgtcctgggatctgatttgtggtttaccttcctcttggtgctgctggccattggatttagccatatctgtagattatttagttttttttttttaatcgagtttgcacttaatttgaggctgtgtttcctctctgagtccttgtggtatctccatcttctcaactttcactggaggcaccccacagtttaagtaggatagatttctcttgacaggctctttgttgcttcctggggagcatcagctgacaggtgatagtccccaaacttcccaccccagaagctcctcggggaagctcacctttctctcattcccttacattctctggctcttatttttagctgctcgcaggcaagctagttggaatgcacttttgcaggagaaccagggctcagtgtcagagcctccttctctatataggtccggtccatctgctggtggtgtcattctgtccaaataaagctgtttttgttctggctgcttattgcctgtgattcatttcccctctagagtcagacttttctctgttcaaactcgcttagttatgtgcaatggtttgcttaacttgcctcatttcccttgggcaaatgagatgggtaaaacagtgaccctctatgtgttctaggctgcttcttcagggttctgttgctactatgattggtttaatacctgcagatgcctactttgcctatctctcttaagagatattcagaagatattttttgagttttttcccattgttgttggggttcctttttcataggattttgtcttgggaagtttcttctggcctttcctaatgtgatttttattttctctcctctagtcagccttgtccaaatatgatgccactaaacaaaagaggaagttctcttccttttttaagtccttggtgattgaactggacaaagacctgtatgggccagacaaccatctggtagaagtgagtagctctgccttctaggctttgactctgattggaggatgatggacttgggagccgtattttaatgtctaaggagatggggaggtataaagtagtcactctaggtgtacacagtaccgctccaggtgtacagtttgcacattgacctctaggtggcactagcatgtttagttaggaccaagggctcttgtaacctaacttgtcccatctttttaatgttactatcctggtcactgccacctctttcaagggaaagtctactggtggcctcttgtatgtgccaggccatctctgtatcttgcttgttaataatggtgagatgtagttatccatttttcctggcagcagttgctgtaattagagtgattgactgatagggtactagtacttgccaaggttaccattatagatctgggacttcctcttggtctctgctctgtttacatttacattccaattcaccaaaaatcctttattatgatgcctgattgcacaacgttttgaagcccatgttagcaacagtattctttgggaaacaggcaaaaccagaatgacagtccagccagcactccaagtgaacctaacctgctcctttctttgccagtgtagctgcagccccttaacctcaaccactaagagacatggggaggtctttaccatctaataagggaagtaagtcatagaatcaatagaaacttgtaaatatatttaattttatagcagtagagtatagtggctaagaatgtggactgtagaatcagacacatcagagctcaaatggtggctccgccacttactggctgtttgacctaggcaagttactttattatgctgagcattagttttctcatctgtaaaataagtataattgtgcctatcttgtatagatgttcgggaagtgagataatccaggtaaatgtcttagaatactgtcacacatagtaagtactcagtaaatgatagctatgttactgttcacatgtgtattatccattttgtggataaaattatcactggacattgaggcttatttaaatcaaccacaaacaattaaaaggttaatctacttatacacagacagtaatcccaaagccatatgcagttttttaaaatgcctcatgctattactcttctccagtagcctcagtaatcaaagttgaatattcagtcattacagaagctcttccctcccaccccagctcttcctctgggagagcaccccctgacatcttcctctctgtagtggcacaggaccgccactacccaggagaccgatggctttcaggtgaagcggccgggagacgtgaatgtacggtgtactgtcctactgatgctggattaccaggtattctgtggtggtgtgagggggtccagctttcacagccacataccgtcagcagtctcactttaaagagtttatgtctagttgtgaataatttgccactttggcacagagatagagtcttagtcatctctgagttcttcctagaatttttctgtcccagaaaaagcactacattatttgttgaatagcttgaatgtattgctgcatatagacgcagctaactagcttcatcccctatactttggttccctgcagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcaggtaagtaatggacccattcttttgctagaatccattagaacactagttatgctcaaactgctaacctcgtgcttctcccctttgctacagatctttgagtctcaacgtatgaagttttcagagatccctcagcggctccatgccttgcttatgccaccagaacctatcatcattaatcatgtcatcaggtaggcctgtgtgtgggaggcagtgctgtgccggagctgccttgtgccgatttgcacaagccagttgtcaaattttcaggaattttgcaaacaggttgttaaacacaactgttacactgttacttacaattaaattacataaacttataattaaatatattagactaaaagtgggtaacatatattcaaaatgtataacttcctaattattacattttattgtatttgtgcttttttttttttttttttttttggagacagagtctcactctgtcgcccaggctggagtccagtggcgcgatctcggctcactgcaagctccgcctcctgggttcacgccattctcctgcctcagcctcccgagtagccgggactacaggcacccgtcaccacacctggctaattttttgtatttttagtagagatggggtttcaccatgttagccaggatggtctcaatctgacctcgtgatctgcccgccgagcctcgtgatctgcccgcctcggcctcccaaagtgctcggattacaggcatgagccaccgcgcccagcctgtatttgtgctcttgaggttatttttgcctgttgtatccatctggcggaaatatgatataatgatgtgcttatgtgttactgtgcatctcttcccatgaacagtaatgtaatgttggtagcttgaaatcagaatttttttttttttttttgggatggagtttcactcttgttatgcaggctggagtgcaatggcacaatgttggctcaccgtaacctctgcctactgggttcaagtgattctcctgccgtagcctcccacatagctgggattacaggcatgtgccaccatgcctggctaattttgtatttttagtagagacaaggtttctccatgttggtcaggctggtcttgaactcccgacctcaggtgatccacccgccttggcttcccaaagtgctgggactacaggcgtgagccaccgcgcccggccttttgttttgttttgttttgagatgtagttttgctcttgttgcccaggctggtgtgcaatggcatgatctcagctcactgaaacctccgccacctgagttcaagcaattctccctccccagcctcccacgtcgctgggattacaggcacctgctaccatgcccagctaatttttttatatttttagtagagacggggcttcaccatgtttgccaggctgatctcaaactcctgacctcaggtgatccgcccacctggcctcccaaagtgctgggattacaggtgtgagccactgcgcccggctgaaatcagaatatttaaagcccaaagatcagcaaatgccacacatctgggcacttcctcccactctcctttggaagatcagttgttaaacatctaccagctcttcactcatggaagggctcagcagccatcttttctctggatggtacagcattctagtccgagcctcccaattccattacctctgttcacttttttgtttagaagctggagagcaaggcatctctagatagggggtgaagaaaatttccttctcaaagcagcgtgtctctgtagttggatatagtctctttgtcttccttcctttattccatattatttctggtaagggctttcttttcttttcttttctttctttctttttttttttttttttttttttgagacagacagaatctcactctgttgcacaatctcggctcactgcaacctctgcctcctgggttcaagcgattctcctgcctcagcctcccaagtagttgggattacaggcgcatgccaccacgcccagctaattttttgtattttagtagagacggggttttaccatgttggccaggatggtctcgatctcttggtcacgtgatccacccgcctcggcctcccaaagtgctgggattacaggtgtgagccaccacacccggtgggctttttttttttttttcttttgaccctgaacctacaagatgacagagagggaggggaaaaaaagaaaaaagataagaccctgaaccttcacttacacagtagtaactcctcaacctataaattaggtcagtagaagttggtctgtcctatattcctatgcttaaagttagaccacttttaattttgtgtttgactttatttttggggtcaattttagtttaaaagggagaaagccaggcacggtggcacattcctgtagacccagctactccagaggctgaggtgggtagatcacttgagtcctggagttcgagtccagcctgggcaacagagtaaaatcctgtctctgaaacaataaaaaaagatttgtttggctgggcgcagtggctcacgtctgtaatcccagcactttgggaggccaaggtgggtggatcacaaggtcaggagttcaagaccagtctggctaatatggtgaaaccccatctctactaaaaatacaaaaattagctgggcatggtggtgggcgcctgtagtcccagctacttgggaggctgaggcaggagaatcacttgaaccggggaggcagaggttgcagtgagccaagactgcgccactgcactccagcatagacaacagagcaagactccatctaaaaaaaaaaagaaaggcttcgtttgtttaaacatacagagtcttgctctgtcatccaggctggagtgcagtggcatgatcttcgctctctgcaaccgctgcctcccaggttcaagcaattctcgtgcctcagcctcccaagtagttgtaattacaggcgtgcaccactttttgtattgaggtttcgccatgttggccacactagcgttgaattcctggccttgagtgatctgcccgtgttggcttcccagagtgctgggattacaggtgtgagccaccgcacctggccaaaaaagttttaaaaattattattattatttcttttttgagacagagtctctctctgttgcccaggctggagtgcagtggtgtaatcatggctcactgcatcctcgacctcctgggctcaagtgatcctcccacctcgcctcctgagcagctgggaccacagatgtgtgccaccacgcccaggaattgttttgaaattttttgtagaaactggggtctgtgtggtgtaggctggtctcaaactcgtgggctcaagcagtcctcttacctgagcctcccaaagtgttaggattacaggcatgagccaccatggctcgccgaattttttttatttttagagatcgtctcactctgtcacccaggctgaagtatagtggcatgaacttggctcactatatcctctgcctcccgggttcaagagattctcctgcctcagcttccccagtagctgggattacaggcgtgagctaccacgtccggctagtttttagtagaaatggggtttcaccatgttcctgacctcaggtgatcgcccaccttggcctcccaaagtgctgggattacaggcataagccaccacgcctggctgccaaatattttttttaaagggagaaagatatataggagactgtagcagtgatttcctctggagagaaaggaactacttttcacaggataccttttgtactgcttgaatttttaccattgactttttaaataaatcaactttattgaagtataatttatatataacaaattataccaattgaaagtgtagtttgaagatttttgccagatctgtacaccatgtagctgccacaataaagtgtagaacatttctgtcacacccgaaagttctcgggcccttttacagttagccccttttctcttcatcctgggtcatctttttgaccctgtgtaattaggtcttaggggacaagctctttaccaggctcctttggtttcctgtccagtgttgacccgaatgatcagaaaaagacagcttgttatgacattgatgttgaagtggatgacaccttgaagacccagatgaattcttttctgctgtccactgccagccaacaggagattgctactctagacaacaaggtaggggtctgtgccctggatagttgggtaccaccagcccctatcacagcttcaaggcctccttttgattcttagtgttcattcaaaatacggtgacacccagtatatgtcaggtactgtgcttggtgctggtttgagccagactcaaatgaattctgattgtggggatactctcaacagcactgagcctcggtttctgatttgtggaatagagaccatagtaccttttttttccttttttcttttcaggagtctcgctctctcgcccaggctggagtgcagtggtgcaatcccgcctcacggcaacctccacttcctgggttcaagcgattctcctgcctcagcctcccaagtagctgggattacagtcacccaccatcacacccggctgatttttgtatttttagtagagacgaggtttcaccatgttggccaggctggtctccaactcctgacctcaagtgatctgcccgcctcagcctcccaaagtactgggattacaggcgtgagccaccacgcccagcccatagtacctattttaatcaggttgctatgacgattaaatgagggagtgtgtgtaaagacttgagactgtatctggcacataaaaacaacaaatggtaacttctgctactattattgttatctgggttgttattactagacgcagtccttgcaaataaagccaaaagtgctttgggaacatgaaggagaaagggaggctttgctggaagagttgatgccccaactaaatcttttcttttttttttttgagatggagtcttgctctgccgctcaggctggagtgcaatggcatgatcttggctcactacgacctccgcctcctgggttcaagcaattctcctgtctcagcctcctgagtagctgggactacaggcacctgccactacgcccggctaatttttgtatttttagtagagacggggtttcaccatattggtcaggctggtcttgaactcctgacctcaggtgatccacccgcttcggcctcccaaagtgctgggatcacaggcgtgagccaccgcgcccggccccaactaaatcttgaaggacaaagtgggtgttaatgaaagggcaaaaaggatagtagtgctgggggcataggaggcagaagacgttccagaaagagggaatagggcatgtaaaggtccagagaagagagagagagcctggtgtcttaaagaagtacgagccatttagtatgctagatgcagcatagagtgccgaggacgggatgttttgggaaggaaagctagatagggagccagatgcctaattatgaagaacctttgattcagggaaaactggtttatgtttcatcccgaagactgtgtaagacagctggttgagagatcattaccagtggagggactgatgctatttgtatatagaatgatcacttgcaggaaggtggatggagaataatttgtcaagagggcagggctggaggcaggaagcccagttaggaggctggtgcagtaatccatgtgagacgtgttgaggccctaaatttacagtcccgacagtgagggtggagataagtagatagatttgagaggtgtcaaggtggaattgaaggaatttggccactgtttggattattagagtgagggatgaatgagaaggaaatgttatgatgcctcccaggtctctagcttgggtggacagtagtatttactatgactgggaagaggggaggaggaggagcaggtattggagaaagggtagtgagtttaatgtcaagtttaagcagttggattggttggagtatagaagatagactctgggctgcagactggggactcattaccctgtcactggtaatggaagatatacaagtcaaagaaattgccgggaggagtatgcagaatgagaagagagttgagaacaaaacccagagatgagagcttatgagacagccccatatgccagtccttttcttcctgagaacacttttggacccatttgtgctgtggagtaagtattcatcatgtagctttgcccatagtgggcaatgtggagaccaaaaggaaagctttcctcacatggggtatacagagagacagaaacaagggcaaattacttgctgaaagaatgccaagggtcggagcagttggagctctatatgatggtgccagctgtgggcagcatggtgactaggttggaagtggcatgtggagttgtcaggcaccacctgccatttaacttctcatttttctagtttgaaaatggtatgagcttcgttcttcctttcagatccatgagacaatagaaaccatcaaccagctgaagactcagcgggagttcatgctgagctttgccagagaccctcagggtttcatcaatgactggcttcagtcccagtgcagggacctcaaggtaaagaacctaggagaggtctgaagggacttaggtcagtgaggtgcacagctgctttattcatgtagcagctggtaggagacccagaggaaggagtgaggggccagatttttctttagcatgttccagggtccattttgcaattaagcagggaaatgggggcagagccatcaagtgttgatttagtgcttactttgtctgtcactgtgcttcatcttgtcagggatacagagtggaagacctgatctctgctttcaaagcagcctacattctgtctgaagaaactaggctagtatagccgggcatggtggctcacacctgtaatcccagcactttgggaggccgaggccgacggatcgcttgaggtcaggagtttgagaccagcctggccaacatggcgaaaccccgtctccactaaaaatacaaaaacttagctgggcgtggtggtgcgcgcctgtaatcccagctacttgagaggctaaggcaggagaattgcttgaacccaggaagcagaggttgcagtgagccaagatcgtgccgctgcactccagcctgggtgacagagcgaaactctgtctcaaaaaaaagaaactaggctagtatgatacaaagtagtaaaccacataagacattatcaggccaggtgcggtggctcacgcctgtaatcccagcactttgggaggctgaggagggcagatcacctgaggtcaggagtttgagactagcctggccaacatggtgaaaccccatctctactaaaataaaaaaatcagccaggcgtggtggcgggtgcctgtaatcccagctacccgggaggctgaggcaggagaatcgcttgaacctgggaggtagaggctgcagtgagccgagattgtgccactgcactcccagcctggctgacagagtgagactccatctcaaaaaaaaaaaaaaaaaaaaagacattattagactgaccaggaccaataagatgattcagataagggagatcagtgagactagaatctctggggaaggcttcatggaaaatttgggatttgaagacgttcccagaaaggggagcacagtaagctcagacaagaagataggaatgggcacagagtatgaactcatccgttgtcacccctcctgtgctgactgtgacgagttagagaggctgagcagaggagcaaggaaaaagggatgccaggaaagatccctgaacaaggcaacgacttgttgattgcagaggtgactgggtgttgtatcagtttgctgaggctgctgtagcaaactaccacaaactgggcagtttcaaacaacaggcttgtctcacagttgtggaggctggaagtccaaaatcagtgtgggcagcactgcttccttccgcgagctgggagggagactctgttctgtgcatctctcagcttctggtacctcaggcattccttggcttgtaggtggtggtctctgtgtgacttcacgttgtcttccttctgtatgtgtctgtctccatgtctaaatttcccctctttataagggaacctaccggtcatattagggggtactctaatgacctcatcttaacttgagcatctgtagagaccctatttccaaataaggtcacattcacaggtactaggggttggttagacttcaacattttggggaaggatacaatttacccaataatgggtgtgaaggaaggaaacaagccttttctcctctctcttcctccaccctgcatctccatttccctcagacaatgactgatgtggtgggtaacccagaggaggagcgccgagctgagttctacttccagccctgggctcaggaggctgtgtgccgatacttctactccaaggtaagtacatggggtgcacgggggaaattgacaaaaggcacggggttttcacccctgatgggggtcagtggtgttagataccaacttctggtttgtctcatcttccactcccttcactattttctccttaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccacgcttgtagtgtttgttcattttatttgacaagtatttattgagcacctgctatgtgctagttgtgatgctagacacgggagataaagtggaaaatgagatttctacttttgtggacctcagggtcttaccttaagagattgctgtctgccccagtggtccaagcagcctagttgctggttgggattattgggcttcaccactggatcttaagagccctttcccgacttgctaggcaggtactaacaggttggtggcagtcattttcccccttgtccatctgagctccccagagcacttgttggctggagtgagccatagatgcccgtgatcccttaggtttgacgaacctgagccgcctttggaggagtttcacttcttccccagggcttctgtttagatgtgggcaggatctggacgaccaaagacatttttgctttttgtgcctgctactctttttttttttttttttttagacggagtctcactgttgcccaggctggagtgcagtagcgcgatcttggctcactgcaagctctgcctcctgggttcacgccattctcctgcctcagcctcccgagtagctgggactacaggcgcctgccaccatgcccggctaattttttgtattttttagtagagacagggtttcaccgtgttagccaggatggtctcgatctcctgacctcgtgatccgcccgcctcggtctcccaaagtgctgggattacaggtgtgaaccaccgtgcccagcctgtgcctgctactctaaggttccgctttcatggttcaaataagagttcagtttttgtttgcctgttttgagatggagttgtgttcttgttccccaggctggagtgcaatggcgcgttctcggcttactgcaacctccgcctcccaggttcaagtgattttcctgcctcagcctcctgagtagctggttcttaagagcaccatggaagttctgtgttgtcatcctcatactgtagacaactagcccctccttggcagagtttggaagacagctcaggagggattcccattagcaatcacttgaaactcgcctgcagttctgcctgcttcccacttggaggctcatgacttttttcctttgtcattatgcaagaatggggtttggaatataggatcagagtacaaccactttccaaagttgtagtttaaaaattatcctttgcctgtttggatgggaacattctagtattgcctgttcaatatatgtaatcaaacccaccaaaaaatccaaccactgttcctactccggaacttggggtttatcagacttgagaagggaaagcagagaggagtggttgggccgataactaggagtggagaaaattgatgtcaaggacattgaaatggcatctgtttttacccaggctaattacatgtgtaatgaatggctgatgaaccattattaatttcaagcaaatctacagtttgctcttgggaaaagagctctagtgatacagataacttcctgtgatgagccgattctgaatctctgcaccctctttattcccatgtaaatgagcacattcttagtc

SEQ ID NO: 13062 - DNA, 7001 bp, Human
ggcagaaaggcgtggaagaggatgagaacagagacacgcagcagggacggggtggagaggacagggagccaggaccacggagcgctgacaagagcctgctcagggtgagatgcccaggagttccctggagaggacacggtgaagtcgagacagcagggagaacagaaggaaatgggtgagggatgttactgggactcagacagggactggggaggaacagagcctgtagtccagagttaagatgtttctcttgaagatatcagagggctcagtcccaggtgggggaaggtatgagtatgaggctgaaatgcagcagacatagtcatctgccccgggaagtcaagaagtttttattcattcattcaacaaatatttattgggcagttactgtgccaatctctgtgcaagacactacatgcaggggtgaacaaaacttggttcccgccccccaaaggcctccccgccttgcctcactggggagacacattcacaccatgacaacaccctgtggtgactgcagtgtaggagaatgcccaggtgtggtgggagcacgcagaagggtccccacccaggaaaggagcaagcgacgtcaaagctgagcctttggaatgggagttacccaagcaaagggagtgcaagggatctccaagaagaggagagagctttttccaaggagaggccagcaagagtgtgcatttggtgaaaccagagggtaacagagtggggagaggtgagggagagctgcagggtccctgaaggcaggcacagagcttccagagggatgggaggcttggaagggattttagcaggggagcagcatgatcagatttgcattttagcacttgggctgcagtatggaaaattgattgaaacggagcaagggagcagacagagagactggtgaaaggctgcagggcggcaggggtggcaaaaagagggcacagtcaggagatatttaggattgaaaatcagcaggacttgatgcttttcctggatgggggaaggagggagaaaagggtcaaggatgcttcccagatgccaccagctgagctgcagaaaacaagaggagaacatgggggttggggggggtaccaggagacaggaggatcacatctggagacagattgcgtttgaggagcctgagaacaaccaggggacatctgtaggcaggtagatatgccagggatgaggtcaggacacccagctacggtgaagaggggaagactgttatttcaatagcttggcagactcttcttagggaggaacacttttgtttgagaagataccttgctatctgctagggttaaaaggggaaagcctagggcatgggtgaccatagggccagggaaagcctagggcatgggtgaccatagggccagtgcagccacaaaaaatggttaagctgccttgtgtgagaaaggagtgaaatctgtttggcccctgagaggaggagagcagagacggaggagccaagaagggaggggagcgcgggggagggcagggaggcaggaggaagtgagtgaagggccagtggaaatttcccctggtggacagcagaggtgcccatggccttgtgtgatctgacgcggtttgagtcgctgtggaataaaccccttctccacccgcccctctgcaaccccacaggccacagtgtccacagcgtccttggtaaagtcgactatattcacatctgcattctgtgagtgcgggtataggtgggagtggaggagggaacttactttctgggtttacgggcacggtgtggtgtcagcccatttggaagcaaagcctagatatggagggggccagacgaacaggacctgggaatgcacaggaccccctgaagcaggccggggatctgagtgatcttgctgtatctaagctgacattggaacatgaacagtctgaaatcccatgagccccgctgccctgcacctgcgaccctcaggctagaccttggactgtctacaacacgagtcaggcccaacccgccctggaaatcatcgtaggaggttccagctcagtgcccagagacagcccccacatcccaccccatcaggtcagctcaggctggagcaggcatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagccagggtcagccagagacaggacaccagaagagacaggagatcagagaccagaggaacagagaagaggccccagagcaaggcaaggaacggccaaggcaccaggacatggatgcagtggagccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaaggccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggtaggtgcagggaggggcacctggagggccaggaggcgggaatgcgcacaagtggtgaaggtggaggccaggacggaggcgagggagcaaaggaggaaacaagtcagctgcaggctccacatcctcccgggctgggccccaggacccagaggactgagactttgacctcagtctaggcagaatagaaatgggatagtggcgcgaagaacaggtggagaaggaagaggccacataaaggagaaggaatagaaggaccaggcgtttaagggtagatgcggccaagggagtgcggggcctgtgggtagagaaggggaccccacggggacttcatttttctcccaggctccacccacgtcctctgctctccgactgttcccaagttcttccctccacctcgaggcctgcctcactcgccccttctccatttcgtaaccatctgtgttccaccttcttcccccaaatctcctccttccacacctgctgccagtctcctctcaagcaagcctcctgaaccactggccccaaccaacccactggtggggtgggaggagcaccactcacttctgcagggagcaagggtccagagcagatatggacccctctgcacaggcctcccgaagtcctgaagctgggcggcagtgaggtgtcacccccttccagctgaggagaccaggcccagtggcaggggtttctctgtctgtccgtgggcagagcccgcgtctggtccagagtaactccctctgtccaggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattggggtaaggaacagaggggacaccgtgcacatgcacacaccgggtccgtccccggggaaactgtggagccctgaaggccaggcagtgtccctccctgagcccctcgtgccttggagccaaagtggtaccccctgcactctaggcccaggatatggcactacagaggccgtggctggggctaaggctctgagccaggactgagaaatggtcccctctcaggcctgccttaaaccttctcccaccctgaccctgcacttgctccccagatccacttcactggctgctccatgaatccagcccgctccttcggccctgccatcatcattgggaagttcacagtccactgggtgagcccctctgctggcagccctggggagggaagggagcctgagttgcctgtagacggtgggtttcacttgcagcttccctaagctcagaaggccagggtgaatgtcttggctgagacttcctttcttttcggcttcagttgcccaggatacccagtggactggcaagaaatgggccagggcaggagctgcagccttggcccagacttttaagtcctggctgtttccttattcactttctccagctggaccaattttcaaacttggataaagaaaaagacaaacagaaatagacacacacaccagcagagacagaaacagcaatagccaggactcctggctaaaacgggggaagtgagaggaaagaggcgggggcgggtgaggagactggccccaggccccagccacggctgcagagcctgggctcagccccagggagggcagggagagcaaggggcaaggtccccttaccttgtgggcttgggaaacacgactcgtggttctcaaatttagcaccttacagacagttgagggagacctgggagatcaagtcggcactggggaagcaggcagcggtcccagagccaccctgtggtcctgatagctcctgggtggggtgacgacatccttctcctcaggtcttctgggtggggcccctgatgggagccctcctggcctcactgatctacaacttcgtcctgttccccgacaccaagaccctggcgcagcggctggctatcctcacaggcaccgtagaggtggggacaggggcaggggcaggggcggagcccctgaagaaggaatcccagccgggttcgggagccgtggagatggagagtgtgtgaaacagcctacgcctggccgcgcccttgggcttcctgccttgcaggacctgcctggaggttctccctgggggtggcgggagggggaggcttgaccttttgtcctgaccaggtgggctggaggggacaagccctatccctggcattacgtttctaggtagaatctgggagtgaatttgtcccattccctctctgtagggcttccccacctctcggtgggacagagcagaggaaggcaggggatttaggatcgccctcccatcctctcacccactggaccccgtaggagtcctgaccccagatgcccaagtcttgggggagaaaggaatgggagcccagacagccactctgcttagacatgggagctatagggacctcagggagccccagcttcttacccacccaggaaacccttggtccagagaggacaggctttctggaggaatcaggccctgggacagcctctgagctcctgggggtgtttctctgaccttgggtgtggttttggggggtatatttcctccttcagactgggggcttcctgaggacagagactgctctaccaatagatctttgtttgttttgagacagaatcttgatctgttacccaggctggagtgcagtggcatgatctcggctcactgcaacctctacctcctgggttcaagggattctcctgcctcagcctcccaagtagctgggattacaggcgcctgccaccacgcccagctaattttttgtatttttagtagagatggggtttcatcatattggtcagggtggtctcaaactcctgacctgaggcgatctgcccacctcggcctcccaaagtgctgggattacaggcgtgagccaccgtgcccggcctctcccaataggtctttattcctcaatcctccaaatgctctggagaggcccccacccttgagaagaactgacacagagaagaacattttctcaggctcgtagagaggtgggatagaggaagggaggtttgagccagacaggcctttcccagggaagcctcctcccaggtgcttgccccagctcccaccccacagcccactctcaggcaggaacaatcctcagaggggaagtgcccatctagccattgactcatgacctgggtcaaagaagccgtctccaggctctctgtcagcattacaggatccccagaaagctgttgaataagccctaagggtggtaggaacccaggagggacccaggaaactaagatttgagattcagtgcctctgaaagactaccaaaatctaagttggtttaatagttaaaagctgctgtagatttattctgcccacaacttgggggtcctttctggatctcggcttctccagctgtaaaatggacacacaatcctcctccagggactgctgtgaaatcaagaaatcggaaaatactttcagaagttaaaatgctagaaaaacaaccccaataaatgatgattattgttgctgttactgtaattattgggtatgaagacaattgctgttggtaatgagagggaggaggggaaaagagagagagaaagatgattgagagggagggaagagagactgggttttctctcacatcattggatctacttaaccagggaccctgtgtgctcttctcctgggtctgctgaccttgaggctttgtgggtgtgaggggctgtgggagggccctggaatgaagaggcgaaccaataaaatcagttcttctcatctctatgacgcccatcaccatggtaccctaagatgcagcagccaaattcatataaaagatgggtcctggcggccaggcacggtggctcacgcctgtaatcccagcactttgggaggctgaggcgggcagatcacgaggtcaggagatcgagaccatcctggccaacatggtgaaaccctgtccctactaaaatataaaaaattagccgggcgtggtggcgcgtgattgtagtcccagctacttgggaggctgaggcaggggaatcacttgaacccggaaggtagaggtttcagtgagccaagatcacgccactgcactccagcctggtgacagagcaagactctgtctcaaaaaaaaaaccaaaaaaacaaaacaaaagatgggtcctggcctggtgcggtggctcccacctgtaatcctaacactttgggaggccaaagtggg

SEQ ID NO: 13063 - DNA, 16360 bp, Human
  misc_feature (1)...(16360): n = A,T,C or G
accttaaacaaagacactttccaggtgctgaattctgccatgctgtaagtgtgctctctagaggacatagtcatattcatcttggttatggaaggctgtggttggccttgtaacaacctgcaataattgcaccatctagatcaagagggcccagatccgtgtgactcagaggagagagcaacaaccttagtaggttctgcagcttctcactgtatctgtccttaagaacagaattaacaaaagttctgaggtgagtagtgatgttaatgagagaaggaaagaagaaaccagagaaagcaagccagccattgtgattgtttcatttgtgggagagagcctcaggaagcagatgatgtttatatctttccactggcccaggattccttaggaaatttgtttggggactgtaacttttattattacctagatgaattgttctgagtgttgggctgggtgctgattagagtgcttcattcagtaggtggcgtttcacacaactttatgtttgaatcccttcctccctgcccctccttttctggtagatttaaaatggatgggcattatggccctgataggagtttggaggatttatatttagaagagatgaaagttcttgactggatctttagtactgtagattgaacacgtttacttaggattgcatgtgaaataggggagggagcaaaacttaagaacttgactttatggtgttgatatgatctaacctggatatagttcagtttaaaaatgccctttttgacattgggacagttggcaaaaatctgaataaggtctgcagattagaaatagtattgcattagtattaatatcctgattttgatcattgctttcaggatatacacactgaagtgtttaggagcactgtgtctgtatggttagggaaaaaatatttttacatctgtctatatattgctatatagaaagaagatgaagcaaatgtgaaatattagcatttaggaaatctgggtgaaggttgtacaggaattctttgtactgttctaacctttctgtaggaaaggttctgaaactgtcaaaaaaataccccccaaaaaatcctcctttctgcataaattccttttttatggaggtaggaacctctctttttttaaaattgtgagtccttttcagttcagttcttaaatgtgttaggttaagaaaatttgatacgcatatatttaaaatgcaagtcttaatgccagacccagctttatagtttttgtttgttttgttaagactagtcaaagttttgttttttatctttgaggtgctgctagtgagataatttttttttttttttttttttttgagatggactcttgccctgttgcccaggctggagtgcagtggcgtgtcttggctcactgcagcctctgcctcccaggttcaagcaattcttctgtcttaggctcctgagtagctgggattacaggtgtgtgccaacacacccagctaatttttgtatttttagtagagacagggtttcaccatgttggccaggctggtctcgaactcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcgtctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataagctaacaaattaacttggccagaatccagaggacctgatgaaaatgtccagattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcaacgcagcagcacctgaagaaggtctatgcaagttttgccctttgtatgtttgtggcggctgcaggggcctatgtccatatggtcactcatttcattcaggtaagaacgattttctctcctggttgctgtggtacaaattacattaggaaaaaaccagctcagcaaggtggtccaagggaccctgttcctctctttaatctttatcagtagtttaggatttaaactcagacattaaatcaggacatgtaaagccattttaattttctggcaactgtgccccctctagataccgaaaaacagaatgccttaaccttggcactgaatggtgtgctgctgacgtacaagacccccacccactgagtaggcgcatggcatgcatgctgggattctttggcacagaagcttttttatcttttcctccattcttcctttacaaaactctgattgtgtgattaactatcaggagaggcaggattgagatctttttaaggaattgacctgttttattttccgataactgttgtctgcatggttgggtaaaaaccttcaacaatttgttttcctgtattgagagagaatctgggtttggtcagcaggagtagaaggtacagtttgaggaataaccagaaagtttgaagactccctaacatagtcttgtgcctttgtagagtattccttttagcataaatgtagaggtgggcctctgttggcatttgccactgttgagaactatccttatgttcaggcatctcctggcagggattgtgtgaaaaattactttagacactcaaaggatagggctttgatcgcttgagttttaggcaaggttagcccttaaataatttagtaaaatacagtcaatccttgttattcacagactctatatttgtgaattcacctactcattaaaatttgtaaccccaaaatcaatactcatggcacttttttttttttttttgagacagagtctcgctctgttactcatggcactttttgcagacagtcacagagtggtgaaaaagttgagtcaccctgctgttgcagtgttttcagctgaggttgaacaagacagtgctctgccttcttgtttcagttctcgtattgtaaacaaatgttcttttcatggtcatttagtgccacttcctttgtatttttgtgcttttaattggtgattttgctgggttttttgagtggaggtcttgtggtgtcgtcctgactggtctcaaactcctgggctcaattgatcctcgcacctcagcctcccaagtagctgggaatacaagcacatgccaccatgcttggcttaattttgctgttcagaatgcaaacagcatagtgctgaagtgctgtctagtattcctgagtgcagaaagaccgtaatgtgccttatgaagaaaatgtgtatattagataagcttcattccggcatgagttgtactgctgttgtaactgtgagttcaatgttaaggaatcaaaaataatgtcaaatgaggtgtccttaaacagaaacacatataaaagcaaggtatctattgatcatttgatgaaaatgttgtgaccttaggcttgcaggaacctacctaccttttatttccctcaggaacaagggtttactaattcattgtccactgtgattttataacataaacactgaataatgagaatcaacttcttcctttaaaggaaggaaggaacttcagtgtctacgtccatccttaatgatttctcttttttctaatgcctatagtttttcccacttggcgtttttaaaaaaagaaacacttttttcttactacaaagctaatatgtgttcattttagaaaattcagaaaacagactagcaatgagaaggaagtattttagaaacttccataatcccatcatccagaaataactactgttaacattttagtactttgcagtcttctgtatatgtatgtgtcttggtgttttggtgtttgggggttttgtttgttggtttttgtttttttgagacggagtttcactcttgttgcccaggctgaagtgcaatggcgtgatcttggcttactgcaacctctgcctccctgggttcaagcaattctcttgcctcagcctcctgagtagctgggattacaggcgtgtgccaccatgcctggctaattttgtatttttagtagagacggggtttctccatgttggtcaggctggtctcgaactcctgatctcaggtgatttgcccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatccgcccgtctcggcctcctaaaatgctaggattacaggcatgagccaccgtgcctggccctttttttcctttttttttgagacagtgtctccgtctgtcacccaggctagagagtgcagtggcgtgatcttggctcactgcaaactctgccttccgggttcaagcgattctcctgcctcagcctcccaaatagctgggattacaggcatgtgccaccatgcccggctaatttttgtatttttagtagagatggggttttaccatgttggccaggatggtgttgatctcttgacctagtgatccacccaccttagcctcccaaagtgttaggatgacaggcgtgagccatagtaccctgcctcctggcttttttttttttttttttttttaagatggagtctcaccctgtggccaggctggagtgcagtggcgagatctcagctcattgcaatctctgcctcccaggttcaagcgattccccttcctcagcctcccaagtagctgggactacagcggctaattttttgtattttagtagagacggggtttcaccatgttggccaggatggtcttgatctcctgacctcgtgatctgctcgcctcagcctcccaaaatgctgggattacaggcatgagccaccacacccagcgcttttttttgtttttttgtttttttttttgagactgagtttcactcttgttgcccaggctggagtgcagtggcacgatcttggctcactgcagcctccacctcccaggttcaagcgattctcctgcctcagcctcccgaatagctgggattataggcatcaaccaccacgccagctaatcttttgtatttttagtagagatgggccactatgttggccaggctggtctcgaactcctgacctcgtgatccgcccacctcggcctcccaaagtgctgggattacaggcatgagccactgcccctggccctaattttgtattttagtagagacggggtttcaccatgttggtcagactggtctcgaactcctgacctcaggtaatctacctgcctcagcctcccaaagtgctgggattacagacgtgagccactgtgcctggccttcctggcctgctttctaatctcatataggttcattttgtttccccatccattaggggaaactctgtgagtagccactgtgactctacttttgtgtccaaaaatagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttgaattagaacagcttgttctgagtgacagtctaatatacgtaggagaaattttagaaaggaagagatttagggattaaaatttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttctaatctctgtaccctccctgaggtcatccatgattttcagctaagaggacaattttgcagctatttctataaaaaaaaaaaaaacaacgcagtcaggtatacattttattgaaaacaattacagcggaggggagagagatttaattctttagtccacgtttgttaagagcatgagtatgcctatatttcgggatcagcttttggatgaggatcctattcaagaattgatcataatactgtgttctgggttttctgttttctaggagttggcctgggccctgccctggagttttgtattgctgtcaaccccaggtaactcttttggtagtgtcttatgtgcttttatctttatgaatataccttctaaatgtagaccgtatacctgtagcccttaatctaatggtctttttttctaacagcatccttcccactgctttcatgggcacggcaatgatctttacctgcttcaccctcagtgcactctatgccaggcgccgtagctacctctttctgggaggtaagtgtgaactgggaaacagggaatgggggctcctttttagccagaattctcactagtactccttccttacccctaactcctttgcgactattgagttgagattaaccttcattctgggggaagttaaggaatggctttaatgggattgctttactttgccttggcttctctcaagacagctttttgctgtgtcttataggtatcttgatgtcagccctgagcttgttgcttttgtcttccctggggaatgttttctttggatccatttggcttttccaggtaagacttagcctggaactttccagcagccatttgcctcacacttctttctttccttttttttttttttttgcacttctttctgtactactttgggcagtgctctctaagccttcccattatccttcataggatggagccttctgccacaagtgaaaacaggctgcacaaggttgggcattgctaagagaaaatggtttgctcagacaccatttgtgtaaggccagtctggcagtggctgattgttaaaatgattgaaactcttccagtgaccagtgcagtattgtgcctagggaagtaaagtggtcttcaccctaggctgcagttctcgtgaatggtaatgttcatagggttcacatttgatgtactttcaagtgactatgagccagaaagtatggctggtttttttttctctgcaacttctgctgtatagtaacttcatctcttacatttgttaggcaaacctgtatgtgggactggtggtcatgtgtggcttcgtcctttttgatactcaactcattattgaaaaggccgaacatggagatcaagattatatctggtgagtgtgggaactagtctttaacaagcatgaaggttgaggcataccgttcagcagctgaacttaggttggcattggctgaacataggtggccaagctttgggagtgtatgtggtaggaaacccacggttttggaactgtgtaccataatcttcctcaattcctgaaagatttcagattttttaaaaatctgggctaataggccaggtgtggtggctcacacctataatcctagcactttgggaggctgaggccactggatcgcttgagctcagaagtttgagaccagcctgggcaacatggcgaaatcccatctctactaaaaatataaaaaaattagctgggcatggtggcacatgtatataatcccagctactcaggaggctaaggtataagaatcatttgaacctaggaggtggaggttgaagtgagccaagattgcaccactgcactccagcctggcaacagagcgagaccctgtctcaaaaaaaaaaaaaaaaaagtgtgggggccgggcacggtggctcacgcctgtaatcccagcactttgggaggtcggggcaggcggatcacgaggtcaggagatcgaaaccatcctggctaacacggtgaaaccctgtctctactaaaaatacaaaaaattagtcgggcgtggtggcgggcacctgtagtcccagctactcaggaggcggaggcaggagaatggtgtgaaccggggaggcggagcttgcagtgagcggagattgcaccactgcactccagcctggacgacagagcgagactccttctcaaaaaaaaaaaaaaaaaaagtgttggggggtggctatatatttacatatccatagtggctacctccaagcagaagtgagggaaagagatctttctccttttcctatttatacttctgtattttttaaacaatgagtagaagatacactctttttttagagacagggtctcgctctgttgcctaggcagtagtgtggtgccatgaacacagctcgctgcagcctgaatttactgtgctcaagcagtactcctgcctcagcctcttgagtagctgggacaacaggcacgtgcgaccatgccaggctaatttattttttgtagagatggggtcttaccatatgcccagattggtctcaagcagtcctcttgccttggtttcccaaagtgttgggattacaggcttaagccaccatgcccagccacttttttttttttttttttttttttgagacagttttgctttgtcacccaggctggagtgcggtggcaacatctcagctcactgcaacctccgcctcctgggttcaagcgattcttgtgcctcagcctccctagtagctgggattacaggcactctccaccacgtccagctaatttctgtaattttagtagaacgaggttttgccacgttgccccgtgaggacatggtgtcgaactcttggcctcaagcaatctgccttcctcagcctcccaaagtggtgggattacagacatgggccaccatgcccagctcacttttttttttttgagacggagtttcgctcttgttgcccaggctggagtgcaacggtgtgatcttggctcaccgcagcctccgtctcccggcttcaggtgtttctcctgccttaacatcctgagtagctgggattacaggcatgcaccaccatgcccggctaattttgtatttttagtagagatggggtttctccatgttggtcaggctggtctcaaactcctgactcaggtgatgcccgcctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgagacagggcttgctctgtcacccaagctgcagtaggagagtggcactgtcatggcttactgtagactcaagctccctgggctcaggtgttcctcccatctcagcctcctcagtagctgggattacaggcacatgccacaatgccctgctaatttttgtagagacgggattttgctatgttacccaggttggtctcgaactcctgggctcaagcagtccacctgcctcagcctcccaaaatgttgggattacaggcatgagccactgtgcctggcccagtctcttttctctatgctgcatgacttcgatgagtctaaaggatctcagacaccagagttttacttccttagttgggggtaaagtgtgggagaagctggctcgtgggggtaggggtggggtttatattctgcatctttgtgggcttgtggataaaaaagtctgaagtacagatcctaatctggttcttgcctttcaggcactgcattgatctcttcttagatttcattactgtcttcagaaaactcatgatgatcctggccatgaatgaaaaggttagttagcctacaacccaaagatgagacaataatggctcctgagcttggcatgtgtgtatacttcagatttgaaaacttgctcacacactgtgttaggtccagggtaactgtaaggcaggccactgagtaagaggtaagccagaagtcttcagttgttagaaaaaaagcagcaagtgaaaaaaaaatttttttaactaattcctgcgtttagtatgaaagggaaaaaagcttcagtggcagtaaacacaacctgctacatgaataatttaaaggctatatagttgtgactcagagaaaggtattgtggaggacgttgtaaatttcagaagtagactaattttatccatttgttaatttttttttccaaggaagcattctatatagggctaatgagtatctaacgtagttgagtcaagcagtgggggaaacaaatgaaatgagcttttctttatagaccttatggagcttagagatagcatagtggtagcgggagtagttgaccagataggattgctggctctgtctgggctatgccatggttggactgagcactaggcagatgtacaagtttcagaacaagcaactgaattttcattccttaatacattgggcttccatccaagattgaatgaagaattctgctggaccaaattatttctgaatgtcagtttatgccagagtcatgctcactttgcagggtggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgtgtcataagtatgaacagagacaaagacctcccactctgtagccccagcatgccacaaatgttgagaattttctctgtcaaatatgtaagccagttttttttccagtcctctccaccccctgccacctttgctatatgttgtttgtggtgatatgtgcagttggttcagatgtgcagccaagctttggagtttgaggatgcataatggaaaaaaggcaaatgatacccactcattctgcaagtatttttgttcacccactgctgcccggctgtattctaagtgcattagttaataaagatgtaaaagttggccaggcatggtggcttatgcctgtaatcccagcactttgggaggccaaggtgggcagatctcgaggtcaggagttcaagaccagtctggccaacatggtgaaaccccatctctactaaatacaccaaaaaaaaaaaaaaaaaaaaaaaattaggcaaagtggcaggcacttgtaatcccagctacttgggaggctgaggcaggagaattacttgaacctgagaggtgaaggttgcagtgagctgagatgcaccactgcattccagcccgggtgacagagaaaaaaagtcggccaggcgtggtggctcacgcatgtaatcccagcactttgggaggtcgaggcaggcggatcacctgaggtcaggagttttgagaccagcctggctaataaggtgaaaccccgtctcaactaaaaataacaaaaaatagcccggcatggtggtgggcgcctgcagtgccaactactcgggaggctgaggcaggagaatcgcttgtacccgggaggcagaggttgcagtgagccgagagcgcaccactgcactacagcctaggcgacagagactcccatctcaaaaaaataataaaagtccttgtcatagttcagatatgagattatcaatcggaacttgcattacaatcaggttgctcaattctgtgtttgtgtttttgttttgatttttggagacagggtcatggtcttgccctgtcacccaggctgtagtgcagtgatgcgatcatggctcacagcaacctcagtcacctgagctcaagtgatccacctcagcctcccgagtagctgggaccacaggaacatgccactgcaccccgctgatttaatttttgtagaggtgggatctcaccatgttgctcaggttatgttgaactcgtgttcctcaaacgatccaccttagcctcccaaagtgctgggattataggcttaagccaccatgccgagcctagtagctcaattttaccatgcttgttctccgcttgtcatattcattgtagacccaggccttcctgttagaatttgaccattattctgactggttcatctaggttactcccagttgacctgttcggactccacatgtgcccgtgccaactaaggatagccattttccttaagcttgggaaatattccttaagcatcttttctctcttgctgactttgagaaaagactggtcctaaagactctttaaagcccccattttatctgctaggggagaagtacaaggtgcaacaccttttgagtgtttacaaggtcaggcactgtacaaagtgccttacatggattgcttaacatccccagtagtttaagaagatggtgtatttactacgtacggtcagttacttccagggctggcagatgtgtgcccagaaagaatctaggcac

SEQ ID NO: 13064 - DNA, 28556 bp, Human
  misc_feature (1)...(28556): n = A,T,C or G
ggacagatagaagttttgccgtggtattgagctgtcttatagtctcacgatatataagtgaatgccgagatgatagaaagtaataccttatattaaaactactgattagagtcttccatttttacctcaggagagccaaaggaaatcaacatttgaattgactacccaatgtcctgcccctgtttctgtcctgtagcacttagggtatgttgcctatttcattatatgttaaatccatggcatctccatgaattccacagctcttcctgccggttttaatgctatccttttagttttgttcttagtttagagaaagatctttgtaataaatttgttggtctggttgcttagcagcttgctgtgattatgtagcttggaacagatacttgccgtttgaaaatcttggtttccggccctgattcaggtatatgttgcatccaggcttggaactgagaactttttttctattatagcaattatcatatgagtataaatgtataattctgcagcatttaatatataaaatatcttcatgtttatatattctttttttttttttttttgagacagagtcttactctggcacccagactggagtgcagtggcaccatcttagcttactacaacctctgcctcccaggttcaagcgatcctcctgcctcagcctcccaagtagctggaattacaggcacacataactgtgcccagctaatttttgtgtttttagaagagacggggttttgccatgttggctcaggctagtctcgaactcctgacctcaagtgatccgcccgcctgggcctcccaaagtgctgggattacaggcgtgagctgccgtgcccagcctatgttcatatattctttgtcctttgtgcttttttatatattttttcttgctctcatagcttgtggtgcaatcttgtaaacattgcaaaatcactaacccttcataagagttcttaaaattttatttaggaaataaggacctggactagaatgttgaagcattggttaagagaaacacaagaatcctttaatggtatttctgaggacattaaatttctaataaaatttgactttttatttcatttccttgatagttttcataacatccagttaatgtctttctttcttgactgttaagtgaagatcttatttcctcaaagtgttcccagttaaagtctatttggaatagaaccgcctgtaacgacactgttttttctatagtatcagcaggcctttgaggggaaatacaaagtctgaaattcactatacaggacacagtagcaaatgatttttgctttgcccttcgaactgtgaaggtgctgtattgtctctctgatgccagaatgtggtacaacataatcctttgcctctacttagtataaatttattagacgtagttcctgcacgcagcccagcagagagccctgtattacagaaataattcttgtgctgctgagctggcgattttcccacttaatcactcatgtgacgtcatctgtgcttttggtaggaaatgtgctgaccatgtcctgcattttaaaaggcagttgcaacaggggcattagctaaaaatgaaattaaaaatagatattttaagttacattgtaggtcttcaaagcccacaaggaataaactggcaaaattattatattaatcaataggcttgacttgaagaaccacattttcttgttggtcagtcacttgctaatgaactgacatgctctttcctatttgttttctgctccaagtgattggaggggctgttatattcaaaggtctgaaatggttttctaattttcagatgagtcttaaacattccaagtttgtttttataataagaatcacacaaaacatctgttgttagcttgagattcttataatggtagttataaatggaagagtccagatgttggtcactaatggctggattgctatagaatcttttgttgtgggcgagaaggcaggacccctaatgtatatttgatttcttggcagaaagatggatactatgatgctgaatgtgcggaatctgtttgagcagcttgtgcgccgggtggagattctcagtgaaggaaatgaagtccgtaagtcattctgagctggcctgtccaaaggaaaaacagatttcaaatttgggatttttacaaagctgaagtattttccaatcttaaagttgttttccatttgggttacctaaaaagaaagcagtgatcacttacgtggtcaaagcctaatgggcactcattctaaatggtcactaaaattcttttctatagctgctcttaataggttttagccaggcttttttattatctttatttatttatttttttgagatggagtctctctctgtcacccaggctggagtgcagtggcgacatctcggctcactgcaacctctgctccccgggttcaagcgattccttgtctcagcctctcgagtagcagggattacagacacacgccaccacgcccggctaattttttgtatttttagtagagacgggattttgccatgttgcacaggctattcttgaacttctgacctcaggtgatccgcccgcctcggcctcccaaagtgctgggattacaggcgtgagccaccgtgcccggctgcttttttattatcaagattctttttccactgaatagttggcactattttctgtgccatgaactgggaaaaatttactaggatgttgcttttttctttagagtagtagttgtcttttttttatcctggattttctttgtgttctataaagcattttcagttgaagtgggaaaaattcataatttcttcttttttctttttttttaagaatctcattctgtcacccaggttgcgccaccatgcccagctactttaaaaaaaatttttttttaaatttttttaattttttttttatttttgagatggagtcttgcactgtcacccaggctggagtgcagtggtgcgatctcggctcactgcaagctccgcctcctgggttcacgccattctcctgcctcagcctcctgagtagctgggactacaggcgcccgccaccacgtccggctaatttttttgtattttcagtagagacggggtttcgctgtgttagccaggatggtctcgatctcctgacctcgtgatctgcccgcctcggcctcccaaagtgctgggattacaggcgtgagccactgcgcctggccttaaaaattttttgtagagataaggtctccctattttacccaggctagtgtccaactcctggcctcaagcagtcctctcacttctgcctcccaaagtgatgagattataggcatgagccaccaggcccagtccataatttctttttgaaggagatactaggcatttgctttcacctacttcatatatttgatgctaaataattaaggattgagagccaggtttggtggtttgcacctgtattcccagctactcaggaggctgaggcagaagaatcacttgaggccaggagtttgagaccagcttgggcaacatagcaagactgtctctgaaaatattagcggtcgggcatagtggctcatgcttgtaatcttagcactttgcagggctgagatgggtggatcgattgagtccaggagtttgagaccagcctgggcaacatggcaaaaccccatctctctcttttttttttttttttttgagacagaatctcactctgtcacccaggctggagtgcactggtgtggtctcggctcactgcaacctccacctccctggctcaagcaattgtcctgcctcagcctcctgagtagctgggattataagtgtccgccaccacactcggctaatttttgtatttttagtagagatggggttttgtcatgttggccaggctgatcttgaactcctgacctcaagtgatcagcccaccacagcctcccaaagtgctgggattacaggtatgagcacctggccacaaaaaccccatctctacagaaaaaaaaacaaaaacaaaaaaacccgccagtgtggtggcatgctcctgtgatcccagctacctgggaggctgaggtgggaggatcactggggaggcagaggttgcagtaagctgagatcacactcctgtactccagcctgggacagagcgagaccctgtttcaaaaacaaaaaaattagctgggtgtggtgacacatgcctgtggtcccagatactcaggaggctgaagtatcacttgagcccaggagtttgaggctacagtgaactatgattgtgccactgcactcccgcctgggtgaaagtgagacttcaattcctggggggaaataataaagagaattgagatggggtggtgagctggggagaaaaaggaggtgctaagaaaggaacagtctgggaaataaattagcaagaaagaataatggggatgatggtactgacatgtgatccaagggaattattctataccagcttctctttgtattaccatcctgtcctatttcagattttcattaatacctaatttagtaaatgttgctctcaagtcagcctcactggtgttaatgtaagaactgtgtcttgaactttttttatttctatagtacttacttgtggtatcttgcttatgccattcaatattttttttgaattgattgatgtttttaatagctcttatccacttacaggcctttcaaaacaatattctattttctctctctaatagctgctgcatgaccctgtcatctggtaccagctcagtaaccacaatggcatactaattaggtttctctttgaggtcacatcatctcagaagatggatcagagtgtggtggggactagagtagggaataagagatattaaaactcagattcattcagcaaatattttgtgagaacctatcagggcttctagcatttttgagttgagggaaagggatgactaaatggtgtcatggaggaaagggtttgagctgagctttagctgtagggtagaatcccaagaggcagagatgaaagggggtattttagatcaggcgacagcctgagcagagcaagagggtgtgggacttgagggaaataggagtaagggggtgtgacataatcagaaccgtgctttgggaagattaccctggcagaggtgtagtctgcattagaggtggatgctggtacactgactaggaatgacatggttgtcatagctcaggaaagaggcaataacagccctaactggaatggtggttatgaagatggaaggagggagaaatgggtagaagagattgtgataataagacctgtagaaggaggcagctgatagaatatgggggcagagggaagaatctgtggtttaagagtgttgataactagtgctggcttttacctgttatttctgtgtctgtttttccacctataaaataggaatttaaacatctttattttctttgtgggagtgctatgaggatttgggcataaattgagatattagttgtgaaaatactttgggaaatgattatgccaaaaatctcccaagatatttatttttacagaaatcctgattttattgtataagcaaatttttaccttcccatttatttctattataaaacagaggtacattttacctccttctccagatctctaatttggaatgttggctttttttattttttatttttattttttgaaacaagagtttcactcttgttgcccaggctggagtgcgatggcgcaatctcagctcactgcaacctccgcctcccaggttcaagtgattctcctgcctcagcctcctgagtagctgggattacaggcatgcaccaccacacctggctaattttgtatttttagtagagacggggtttctccatgttggtcaggctggtcttgaactcccgacctcaagtgatcctcccaccttggcctcccaaagtgctgggattacaggggtgagccaccgcgcccggccctcatttattttttattttttttgaaacagagtctcactctgttgcccaggctggagtgcagtggtacgatctcagctcactacaacttctgcctcccaggttcaagcaattttcctgccccagcctcctgagtagctgggatttcaggtgtctgccaccattcctggctaatttttgtatttttatttttatttatttatttattttttttatttttttgagatggagtttcactcttcttacccaggctggagtgcaatggcacaatcgtggcttaccgcaacctctgcctcccaggttcaagtgattctcctgcctcagcctcccgagtagctgggattacaggcatgtgccaccacgcctggctaatttttttgtatttttagtagagacgggatctcaccatgttagccaggatggtctcaatctcctgacctcgtgaaccacccgcctcagcctcccaaagtgctgggattacaggcgtgagccaccgcgcctggcaatttttgtatttttagtagagacagggtttcaccacgttggccaggctgatattgaactcccgacctcaggtgatccaaccgccttggcctcccaaagtgctgggattacaggtgtgaaccaccatgctcagcctagtttttatttttttggagacaaggtctcgctctgttgcccaggctggagtacagtggtgaaatcatagcttactgcagcgttgaactcctgggctcaagcaatcctcctacctcagcctccagagtagctgggactataggctcatgccactacaccagctaattttttttttttttttttttttttttgagacggagtctcgctctgtcgcccaggctggagtacagtggcacgatctcggctcactgccagctccgcctcccagattcacgccattctcttgcctcagcctcccaagtagctgggactataggcgcccgccaccacgctcagctaatttttgtatttttagtagagacggggtttcaccgtgttagtcaggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtttttatgttctatttttaatttttcataagctgcctgagctttttaaaaaaaatcattggtgtataaattaggaataagtataatttaacatttatcaggtgcctgttgtgtgccagtgacatactaggtttgtgctacactatgcatagtaggaaataatgaagtatatatgacatattgcctgtcttcaagaagattatggtattttagtttcagagacaggatttttttctcatgaaacagaagatagtacaagtatcaaaatatatgcttttgggtaatctagaaaaatttagtgtgtagcaaactgattaggaaaagattcacagaccagatgggacttggtaaatgggtatgtaataggtagggcattccatttggagtgcatagcttggtcacaagtgagaaggcaggaatgcctctgttctgggggcagggacagactggtttagctagaggggtatttattgcatagtggtgggaggtaagtttgattaaactggtaaggtggtcttggatgctggtaaatttaatttgaacagcggcttttcattcattcatttgttcaacagattatttcaagtgtctactgtgtgctaggcaggttacaacactggagataaaagagcaaaggagacatagggtctttgtctttaagaagcttagagagggtagtagggaaggcaaatggaagagcctgttcaaaggcctccgggagtaaatggaaaaaaaaaaatcaggatttctggacccacttaaatttgcttgctgagctatgaaccaaatcctgatttttaaattttaaataaatcaaagatcaccctcaatttgttttgaggaaatttcccttctctttcctcctttttgataggggcacttcatagtttagggtgtacgtaactttttaaaggaggtactgtaatttgaattttataaatctttttttttttttttttttttgagacagcatctcactctgttgcccaggctggagtgcagtggcacgatctcagctcactgcgacttctgcctcctcgagtagctgggattacaggcgcacaccaccacacccagctaatttttgtgttagtagagacagggtttcaccatgttggccaggctggccttgaactactgacctcaagtgatctgcctgccttagcctccccaaatgctgggattacaggcatgagccaccgtgcccggcctgaattttataaagcttttaatgtgcacttcatggcaggctggtaccaagctgaattgtgattcaccaactgaccaaaacagtgccatgattattggtcttcaacatcaaaattgtttctgatctatggcccaaaatgccttctgacccaatcccagcaaactttgctcatagcagaattgtacataaaaatagtatctttcggccgggcatggtggcttatgcctataatcctagcactttgggaggctgaggcaggtcaatcacttgaggtcaggagtttgagaccagcctagccaacgtggtgaaaccccatctctagttaaaatacaaaaattagccaggtgtgatggcacacgcctgtagtcccagttactcaggaagctgaggcaggagagttgcttgaacctgggaggcggaggttgcggtgagccaagattgtgctactgcactccagtctgggtgacagaggaagactgtctcaaaagtgaaaagtaggctgggcacagtggctaacacctgtaatcctagcacttttggaggccaaggcaggtgaatcacctgaggttaggagtttgagaccagcctggccaacatggtgaaaccccgtctctactacaaatacaaaaattaactgggcatggtgacacacacctgtaatcccagctactcaggaggctgaggcaggagaattgcttgaacctgggaggcggagattgcagtgagccaagattgcgccattgcacttctgcctgggcaacaagagtgaaactctgtctcaaaaaaaaaaaaagtaatatctttttttttttttttttttttttttcacatttctcacctgcacacacaaaaagtaatatattaatcaggtatgtaaatgttctgctttgggtctgacttaaactaagctgaagcagtaatttaataaaaggagtatcctaaagaacaaacaaaccagcaaaattaggtcagatgaaaatctttttattctcaaaattgtttttcagttcggtaaatattttgagtgtgtatgcatacggtatttagtttgcaaacatatatgtttttttctttaagctaaaaaaaaaaacccacaaaaaagtagtatgttccagactaacccagcatattatttcttaaaactatttgaattgtaatatttttttaattgttgatatccgcattgtttaagataactaggtcataataacctattttgctgaaatttgtggtttgtaaaaactaaagtttccttattacttggtttttctggaacaaattggtatcctgatttgtaagtttgatatttggtcaaatgattaaaattgtttaaaaaggactatgtattgtttctatgcttttaggttaaattcataggggaaaagtgcccttactacctaagaatctgctagctgtgtgtgaatttggcctagtttcagttttaactgggttagtttgaccagcagcagatgtacaccttgagaccttcttccttgatgttggtggagagtgatccttagagatagacggaggttaactagaaaattgtaaggcacttttgcaaatacattgcagaacagctttgccaatagcaggagataagaatgaatgccaacagggttatcttcttcctttgagatgctgccttggaagtgatgttctctttgcagacatttgaagagacttcacattctgctatcagggatgttccaaaagctagtttgatcttctcttcctgtttttttttttttcaactggaatgtttacatacccttcagggcagtgttaaacagcaaaagcaaattggctttttactttcaaatcaatatttgtataattatatagccaaatggaattgtaggtctagacatctgtaatattaatctacatctactggagcatattacagcagttacatttgaatttgctgtttaacatctctctggtgcagcaatgcgtgactgtaaaggaaactgtttttgttttatagctgtaactgtcctggtgcatgacagctgccccaaaggtatccccctttgattgccttctgttcaggagctttcagtgttagtgttacatctggagccaggtgactaatgagttacatattccatagcagatgccactggctaagccaaaagtaagtggcctattgaataggaattgctacccacaaagttctcatcagagtgacaaacatatccaggatctgctcctagttattttcagctggatttgcccatagttcagctggttccttaattatgaatttcaaataaagctaaccgtaggactcatttattagagcagttatactctgtttggtgcttgaattattaaagattccccctttcctcagaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggtgtgtattgttttccgtgctagaacagtgatgatgcaggagggggaaggcattgtctgacagtttccacttgccaaatatacctagtttcttcttccacattaaagaactgaaagtgacctgttctttaacagcttgcccatgattagagctgaaattgcagactaggaatcttgttcttcataatttgaaatttaaatgtttttgtcacttagacttgaaacttacttaacagacagatttcaaatgagaacttaaagaattagaggaaaagggagggagggagatcctaacgtacttgatctgtcacaagttattggccatccttcattgtttattttaagtgctacccggaatatccatccttacatgagtagctggtactttgtcatacatacaggcaagacaactgtgactcttcttttcatcacccctctctaattcagggtaaaaggctagatgtattcaaccagttgagcaatgtgactgacacagaacactatcattttgatgtgccaggatgggtcataatgcaaaggaaagcctttactgggagggactaatccatcttggtatacagtgttagatgcctcagtaaactcaaattgtctggttccagtgcattatagctttgtatccattttaatgcattttgctccactactttgagaggtgggtggctgctttgatccgtagaagccaatatttgtcctgataaaatgacactaaagtgtttttgctatgtgaaatctattttgggactctcattttgcattattctcctcttggattagcaggttaatccaaaagtcttgtagcagaaacttcgctgttctagatgtagttcattttaccagtcagaaatcagagacacaatctgggtttgatgtgaattaatatgctattggtgtagcagccttcctgaaggtccatttgcataatgctgcattttaatgtcttctggtctgcctgtcccataaacttgaggtgaagctttctcccctggctagttatgatgttttactttgctttggtctgtaggaacgacagattcagctgattcgagagatgctcatgtgtgacacatctggcagcattcaactaagcgaggagcaaaaatcagctctggcttttctcaacagaggccaaccatccagcagcaatgctgggaacaaaaggtggaggaactgcatctgttgttatcctatcacaagcaacacaggctgtcagatattcttgttatctgaattcttaaatatacttcttctagaatgtgtgctgaaaaaagcagaaaaagattttgcggggagagtaggtggggaataaaggcacagggatgtccctgtatattttattttattttatttttaaatctttcctaaggatgttgtttcaccatggatacaattttgatgttggtgctaaattgcacatcaataactaatcctgtgcattgctaagaaacccaaaggtgaaagtggcagttcagcaatactttcagtgtttactctccagagagctcttacagctcttctggtttagaaaggcctctgtgagccaagaccagacaataattttggttccactgcaccactgtttaaaatagtctcaaccaggctttgaatttaacatccccagtacaatatgtagggaaaggtcagctatttattttgttgcctggttgttttatggggaatctttataactaagaagatgtacaggcttaatttcttaaaaagtcagtgttgggtaatactcttgtttgtagaaaccagcacagttgggatcaaattaaacttcattcccttgattttgtgaatttggagtagcctgtaatacaaactcggtagagaatagcacccataaccctgactaactttcaactgcccttataaggtctttgctgaaaaagcaactgtgttgcacctgtactcatgcacacacactcctccgtggaaaccatacaaagtagcctaccacagggtttgagattgtaattgtctctatagtgaagattttgctatgaaattaactgatgttacctgaccagtaggacttgttctgaatgttggtgaattttacattccacagtctaccatgtctaacgttgtattgtttcactgatctagactatcaaccattgatgaatctggttccattttatcagatatcagctttgacaagactgatgaatcactggtaataaacatttgatctctgagaattacctacttttcttacctctgcttccccaggaatatctctcctgtcttctcttctgaacatcctatattactattttattagttgatgtgttatagattctgagctagcaatttaaaatataaatccacatgagctataagaggctggcttatatattagtttctgaagtgagaatatataattcagaatttggcataagttgagttcatttaatagatctctgtgtgccacatgtactaactgattatattttgacttattaaagccccagctaataataaaaatattagcaagactgtatgtcgtcagggtttatttgctgctcttaaatagacttgtgccttatttctgaattagtttggttcttggggaaagcatagtcatacttcacaattagaaggaaaccaaggtcctgggatttcagccagaaaagtgtgattagagtttctaggcactatataatgctttcatcaacaatggttaacatgttaaactatttgttgccctgcttttatggggcggcacacttcttttaacttacagtgatgcttctgcataaaaggtcatctcctgatacagtctttgatatagttcattgatttgtgcatcttttctgttactagctgaaaactagcaaacaaaacaaatcaggaagtttttggtgactggttttctggtatagcaaaacaggtgacaactatttgttacatggctaggagttttctgttcagattcagtgtttgaccagggaaaatacggccattttatagataaaaatattaggcatcacctttctcaaatagggaatgatatagtggaggtctggaatatataataaaactagatcatattatcagttgatttttgagctagacctatgatacgatatttcttgtaactgaagctgaatcaaacaaccagtaactaaattactggaccatgacttggggaagttaaatttatttagctaagctattatttgctgtataccactgtttctagatactgttttcagggatgatcaggagtaaggaaatcacaggtaactactaaaatgaatgcaaatagttaaaataggtgaattgaaatgagaccacaataaaagacaaatagttcttcagtggtggacacgttttagggcctaagttcctaaactgtagaactttttttttttttttttttttgagacagagtctcactctgtcacccaggctagaatgcagtggcgcaatctcagctcactgcaagctccgcctcccgggtttatgccattctcctgcctcagcctccagagtagctgggactgcaggcgcccgccaccacgcctggctaatttttttgtatttttttagtagagacggggtttcaccgtgttagccaggatggtctcgatatcctgacctcatgatccgcccaccttggcctctcaaagtgctgggattacaggcatgagccatcgcctggcaactgtggaacttgtgaagtggcaatattatgcagagcatttgattagacagtggcaatcccttgggggcaagaatcacatctaatacaatcagtatagtgcctaacattctgtaagttctaaaactaattacaaaaataatcagaaataaaggatcagccactggaaatatggcagaatttgattctttaacctcttcttgcctctgtggtattgattcctgattttattataatagcttcaatttttcaaagaaagcacattaacttactatagctctatagctacaacacttgagaccttcccttctctaaccctccccgaattgtacgttaggtagcctgactgaagaagcctttaaagttctctgtaaatttatttgcacagggtttagggatggcctaaccaaaaaaagaaattaatacagtgtaattgtcaacaggattgggactcttctttggtgaagactttcaaactgaagaagagagaaaagagggtatgtatgatttgtttagtctttttttaaaacaaagtaataatggagttatttttggaaattttgccatgatactgcattcctgtcatgttgctctagccattgttaagcacatactacagatgaattcatgctgtggggacagtattgatattcttttttttttttttttttcttttttttgagacggagttttgctcatttcccaggctggagtgcaatggcgcgatctcggctgaacgcaacgtccgcctcccgggttcaagcaattctcctgcgtcggcctcccaagcagctgggatacaggtgcctgccaccatgcctggctaatttttgtatttttagtagaaacggggtttcaccatgttggccaggctggtcttgaactcctgacctcaggtgatccacctgcctcggcctcccaaagtgctgggattacaggcgtgagccactgctcccaaccagtactggtactctttgaagtagtaacttaggacagaatcctgtccatttcactgtttaggctgcatttcaattcattcatacagtggaaaaggataaacttaagtttgttttgaattgtcatatgaatttttacacagaacttttgtgctctaatataagcttcatataatgggatatatagagatctatctgtgtatgcttgtttagggtacttaatgtgtttccaagacttcatgtccttagttaggattacagctgtactttttctggtggtgtcatctaaatttctccatagcttgctcattttttctagggcactgagagcatttttgtacaacatattcttttgaaacagcttattcttcatgtggaaataggcaaagagagagagagagagaacacattgtttgttatttactgtagccctaatccccaggacctgtatccaagttgtttgatggaataattttatcttctgtgcttcagatctgcttggcattaaagttacgggtctttgtctcctttctagcgctctactagccgacagtttgttgatggtccccctggacctgtaaagaaaactcgttccattggctctgcagtagaccaggtaagaatagtcaggccaaggtaacagagattactggccccaagcattaaaacttctctgagtcagcattgcagcattgttttgagagacatgatgtttagttaaagtttttgtttgttttttgagacagagttttgttcttgtagcccaggctggagtgcaatggcaccatcttggctcactgtaacctccaccttccaggttcaagtgattctcttgtctcagcctcccacgtagctgggattacaggcgcatgccaccacgtctggctaatttttgtatttttagtagagacagggtttcatcatattggtcaggctggtctcgaactcctgaccaggtgatctacctgcctcagcctcccaaagtgctgggattacaggcgtgagcctccgtgcctggcctttggttaaagtttttctatgcagtaggatccttatccctatgaatggaattactctgatgtagtaaacaactgtcagagtgagtcttagttgcttgaatatatacccccatgacctatgtttatcttcttaggtacgagatttctttatttttactttttaaagtagagggggagtctctccttgctgcccaggatgactcgaactgcggggctcaagtgatcttcccaccttggcctcccaaaatgctgggattgcaggcatgagccactgcacccagccaaacatcagatttcaacataagaatgtttcaggtcaggcgtggtggctcacgcctgtaatccctgcactttgggaggcctaggcagggtggatgatcacctgaggtcaggagttcgagaccagcctggtcaacatggcgaaatcccgtctctactaaaaatacaaaaatcagtcggccaggcgcggtggctcacgcctgtaatcctagcactttgggaggctgaggcgggtggatcacgaggtcaggagattgagaccatcctggctaacacagtgaaaccccatctctactaaaaatacaaaaaattagctgggcatggtggcagacgcctgtagtcccagctactcgggaggctgaggcaggagaatggcgtgaacccgggaggtggagcttgcagtcagccgatattgggccactgtactccagcgtgggcgacacagcgagactccgtctcaaaaaaaaaaaaaaaaaaaaaaaaatcagtcaggtgtggtggcgcatgcttgtaatcccagctactcagaaggctgaggcaggagaatgccttgaacctgggaggcggaggttgcagtgagccgagatcacgccactgttctccagcctgggcggtagagtgaaaaactctgtctcaaaaaaaaagtatcagactggggtcttaagtcttgactaagactaaggaattttttacctgctccaaaataccctatagtggagggtaagttagattctttgtttgtctttcctcattactacttttgttgcaggggaatgaatccatagttgcaaaaactacagtgactgttcccaatgatggcgggcccatcgaagctgtgtccactattgagactgtgccatattggaccaggagccgaaggaaaacaggtccattgaatttgtgactaaactggactgtgtaaaacaactagcaaaattttggagagttggtttcttagaaccctctggaggcggggattggatgtattgggtagtttcttactgctgcataccgaggaccagagaactgcttgtgtcatgctttacctttgaattgctagcccactggcataactttagtttttcttgaaactgtttttttacatagccattagttctcacttttggctatgataacagattactgtttatctcccagttaaaattggagctaaaatttagaaggagcaaaatacttaagacacaaagcttaaaagttgcttgttttctaggtactttacaaccttggaacagtgactccaccctgaacagcaggcagctggagccaagaactgagacagacagtgtgggcacgccacagagtaatggagggatgcgcctgcatgactttgtttctaagacggtaaatctgtgattgttgtttgtgttttaattttttaattgtgaaagtaataaataccaggaataaagttaaatactttagtgttataaagttaaatgtcaaatttccttcctcattccaattttactctccagaagtaactattggttacagaggtaagtttctttccattctgtgagtaatactaaattaaagagaccaacttttctgaagcaattgttagtacttttttttttttaatttgagacagagtcttactctgtcacccaggctggagtgcaggggtgtaatcatagctcactgtagccttaacctcccagtctcaagcaatcctcctgcctcagcctcctgagtagtagggatacagatgtgtgccaccacgcccggctaatttttaaattttttgtagagacttggtcttgctatgttgctcaggctggtcctgaactcctgggctcaagtgctccccctgcctcagctcccaaagtcctgggattacaggcatgagctactgtgcctggcccattgttagtactttttagtgacacatgtttacattttttcttgaatatatcacctaagattttcaaaatgttttgcttttgtaccattttatttccttataaaaatccaagcaaattaactgaggctcagaggagttaactgacatttttgagccacatgatagtaagtgacagatttcacatccaggttttctttttttctttttttttcttgagacagagtctcactctgttgcccaggctggagtgcagtggtgcgatttcggctcactgcaacctctgcctcccgggttcaagcaatcctcctgcctcagcctcccgagtagctgggattacaggtgcccaccaccatgcccggccaattttttgtacttttagtagagatggggtttcaccatgttggccaggctggtctcaaactactgacctcaggtgatcctcccgcctcagcctcccaaagtgctgggattacaggcgtgagccaccatgccctgccaacatccaagttttctgctctttgtaaacaagttctttccactatcacacactgctgccttccagtgggatgaccttaaacaagttacttaaactctctttgcttctgtttcctcatcttaaaatgaagaaaacaaaacctattttatgggattactgtgagaattacatatgtaaatatgtctaaagggcttagaaaattttttggcacatactaagtgctcaataaatgttagttgattatggctgggcacagtggctcacgcctgtaatcccagcacttagggagactgacgcaggcagatcacctgaggtcgggagttcgagaccagcctgaccaacatggagaaaccccgtctctactaacaatataaaaattagccgggcgtggtggcgcatgcctgtaatcccagctacttgggaggctgaggcaggagaatcgcttgaacccgggaggtggaggttgcagtgagccaacctctaccacgccattgcactccagcctgggcaacaagagcgaaactctgtctcaaaaaaagacaaaaaaaggccaggcccagtggctcacgcctgtaatcccagcactttgggaggtcgaggtgggtgaatcacaaggtcaggagttcgagaccagcctggccaacatggtgaaaccctgtctctactaaaaatacgaaaaattagctgggcgtagtggtgggcacctgtaatcccagttactcgggaggctgagacaggagaatcgcttgaacctgggaggcagaggttgcagtgagctgaaatcacaccactgcactccagcccaggcgagagagtgagattcggtctcaaaaaaaaaaaaaaaaaaaagttagttgattatgatgataattttctaattcatatcactctgttccttctgccctgttttatcccaggttattaaacctgaatcctgtgttccatgtggaaagcggataaaatttggcatattatctctgaagtgtcgagactgtcgtgtggtctctcatccagaatgtcgggaccgctgtccccttccctgcattcctaccctgataggaacacctgtcaagattggagaggtatgacttatgcaagccgtcattgttttatggcctctttattcgcctttcaaaggcttagtgtcagtttttgttctaaaattaatcatctcaaatatatttctttccacaaataatgactagaattgtaagatacttacttgtagaagagtcctgtttgggtttgtctgtctaatacctttctaaaccaaacttctttccccgcccctttttccttcttgctcttccctgcttctccttgcctcttcttccttccttcctccccttcatcccattttggaaaatttcagacatatataaaactagagaaattagtataactaacccctggttcttatcacttaacttccatgattactaacttgtgtccattttttttttttttttttttttttttttttttttttttcttagctctattgcctaggctggagtgcactggcaggatgtcagctcactgcaacctccgcccccctgggctcaagcgattttcttgcctcagcctcccaagtacctggaattacaggcatgtaccaccaccatgcccggctaattttttttggttgtattttttagtagagatggggtttcatcatgttggccagggtggtctcaagctcctgacctcaagtgatccgcccacctcagcctctcaaagtgctgagactacaggcgtgagccaccgcgcctggtcatgtccattctttttttaatgtctctcttttttttgagacagagtttccctgttgtccaggctggattgcagtgttgcaactttggctcactgcagcctctgtctcctgggctcaagtgattctcatgcctcagcctcccaagttgctgggactacagccatgtgccaccatgctcaactaatttttttgtatttttagtagagacggggttttgccatgttggccaggctggtcttgaactcctgacctcaagtgatccgcctgcctcggcctcctaaagtgttgggattctaggtgtgagccatggcacccagcctttatgtctgttcttgatttatcaatactgtcgttgcctcctcctgactctgtccaatgaattacttggaagcaaatctcagctatcatataattttatctgtgataaaattatcttttattcttgctcttatgttagacatacttcataataggttatcaaaatgaagttgcttatttccaaatatttaaccagtttaatccaaactgattaaatccattaagaaattatttattgctgagtgtggtagctcatgcctgtaatcccagcactttgggaggctgaggcaggaaaatcacttgagcccaagagtttgagaccagcctggacaacaaagcaagactccatctctacaaagaataaataaataagttagccaggttagtggtgtgcgcctgtgtttgtagctcctcaggaggctaggttggactattgcttgaggtggggaggttgaaactgcagtgagctgtgatcacaccactgcactccagcctggggaatagagcaagaccctatctcaaaaaaaaaaaaaattattatgtaagtaacattagcaagaatcaaaatgactatcttcctacctactcttcagcaaatcaaatattattttcccctgatcttacaagttcttatccatgcctgtacattttgttttgttttgttttgttttgttttgtttttgagagggagttttgttcttgttgcccaggctggagtgcaatggcgcaatctcgactcaccacaacctccacctcctgggttcaagcgattctcctgcctcagcctccctcatagctgggattacaggcatgcgccaccatgcctggctaattttgtatttttagtagagacagggtttctccatgttagtcaggcaggtctcgaactcctgacctcaggtgatccgcccacctcggcctcctacagtgctgggattacaggcgtgagctaccgcacctggccgcctgtacattttttttacacatgttctgtactctaatatagaaccatggagttctcccctacaggtaggtttgtgtcataatcaactgataagatatgttaaataattttttttactgagaataatgaaagtatacacaatttttttctcttgttccagctttcttctgttagaaaaaaaaatctgtttagagtaataaattattttatattaaaggctatacctgtaacctcattattgcttgttttctgctgtccttgagtggatgagaaggaggtaattatagctggtggtcttattccttgttcacataacagtgtggtgtatatatgaaaaagaaaaagtgtggtatatatgataataaatcagtcctggtgtggaggtaggaaaaataattgagagtctctgttttaatatatgctttgggaataggaatgtaaaagtagacatgatgtcccagtttgagaataagattggaggtggttcttcgcatgtggtcttcatctgttggtctacatggcgtaaataataatttaaagctcttttttttttccagggaatgctggcagactttgtgtcccagacttctccaatgatcccctccattgttgtgcattgtgtaaatgagattgagcaaagaggtctgactgaggtaagagtcaactgtaggagatggtgaatttgttatttgtgttaattcggaggtttttaaataaaaatgtcatcttgataatagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcaggtaagggcagatgtaatacttgaatatgaattcctccacggcagtagtttttcttactctctttatttttttatttattttttattttttagacagagtctcactctcgcccaggctgaagtcagtggcgcaatctcagctcactgcaacctccgtctcccaggttgaagcgattctcctgcctcagcctcctgagtagctaggattacaggcgtgtgccaccatgcctggttaatgttttctatctttagtagagatggggtttcaccatgttagccaggatggtctcgatctcctgccctgtgatttgcctgcctcggcctcccaaagtgctgcgattacaggcgtgagccaccgtgcccagcctctttttttttttttttttaagacggagtctttctctgtcgcccaggctggagtgcagtggcgctatcggctcactgcaaactccgcctcctgggttcaagcgattctcctgcctcagcctcctgagtagctgagattacaggcgttaacggtgttataccatgttagccaggctggtctcaaactcctgacctcaggtgatctacccaccttgtcctcccaaagtgctgggattacaggcatgagccaccacacctggccaccttcctctttttattagctcctgcctagtacaatgcctgaaacatagtaggtgctcaagtagtttgatggatgagtaactgtatgcgtgtcacccttgcctatcctcttgctttctcattacgttattgtgtacagtgttcttcctttctttccttcctctccagttaggttggagctttttcaattcttagaatataccaagtttactccctaccttaaggccttcacatttgttgtctcaacctgaatgctcttacattagatacagtatggtttgctcctttatttctttcatatttctcttcatataccttgtccccagaaacacctttcctgacaaccttgtctagattaacagctctcatttctttctagcttcttgcctgccttgttttcttcatttatgtatcactctacctgataggtatttgctttttgactgactccaccaatagaatgtaggttccataagataagggctttgtttacttctgctttatcctcagcacttgtacctggcacatcgtaggcccttaaatatgtctcatgaatgaataccttcttggtaattgtagtcactgcaattgtatgcctgtctgcctagcacatcagttgccaactgctttccctaactgcaaaggccgattttttaaaagttttgacttctaatattgagctgttggccagtatcctgcttgttaatgaaactagagtctgatgtagtcatgaactaatcaggagtttcagaagcttactgtatagatgagactttgtggtcgataacttggaagcccgctgtcaagggaaagaagtctaggcctcttggtgctttcttttcaattacagaaatcacagatgaagacaacagcatagctgccatgtaccaagctgttggtgaactgccccaggccaacagggacacattagctttcctcatgattcacttgcagaggtgagtacagcagaaacttgttctgggagttagggaatttttttccaaggggaagataatgtgggttgagtgtttgggagtatgagggatgaattgttttcttatagaatttatattttggtctgcatttaagcaaggagcaagacttctaatttaatattcttttgcttagagtggctcagagtccacatactaaaatggatgttgccaatctggctaaagtctttggccctacaatagtggcccatgctgtgcccaatccagacccagtgacaatgttacaggacatcaagcgtcaacccaaggtaggcaggtgcgtgtgtgtgtgtatgtgaacttgtgtaatgtgataacttgaaagacagttgagaagccctgagctttggaagtttgctaacagatttgctggcttttaggtggttgagcgcctgctttccttgcctctggagtattggagtcagttcatgatggtggagcaagagaacattgaccccctacatgtcattgaaaactcaaatgccttttcaacaccacagacaccagatattaaaggtaaggcccaagatgtgcttcttcagggacttgactctctctttagttttagtcatatgacctcttcctgcctttgctagagctgtttgaaaattctaacattaaaggaaaatttgtataattctaccatcgtaatttttttttgcttttccatgttctcctttctttatccatatggatatatgttttttaaatatagatataataggctgggcatggtggctcacacctgtagtcccagcactttgggagggaggctgaggcggacggatcacaaggtcaggggattgagaccattctggccaacatggtgaaaccccatctctactaaaaatacaaaaattagctgggtgtggtggcgcatgcctgtaatcccagctaccagggcggctgaggcacaaggaattgctggaacccaggaggcggaatttgcagtgagctgagatcccgccactgcactccagcctggtgacagagtgagactctgtctaaaaaaaaaaaaaaaaaaaaaaaaaaaatatatatatatatatatatataatagtttaaatataattcattcttatttcacttagcatgttgtgagaactttttctcatgtataatcttatttatcatttacttaaatgttctagtaggtattaacattatttttcaatttttcataattacaagtaatgctatagtcaatatagcatttctcttaatgataaattcctaagagtgggatcactgaattaaatggcttgaacatttttatgtgtcttggtatgttttaccaacttgatttattaaatttcttataggcttttgccaatttatattgctaaccaacaattttatatgaataggctggtttcactccagtctcactggcattggagacccattctttcattattgcaagttccttctaagggagcatattgcttcttctagtatagctaaaagtcagatgtttagatgttagatttgtgaagtgtggagttagagaatggcctaaatcaggacgtgtcagctattcattgagttcaaaagatacactagtgtgttacagaatgatgacaaaaatgatctctgggactttgctagatgtctaaccttagctcttaagtgcttcagagggtaatcagcttaaaactagccatctaaaaagatgccttcttttttcccacctctcttaaaaatatgtctgaactttgaagtgagtttactgggacctgtgaccactcctgaacatcagcttctcaagactccttcatctagttccctgtcacagagagtccgttccaccctcaccaagaacactcctaggtatgcagaattggccttcctaggaaataaaaaacaactactttcttagacttcttattatattgaagcttattgaaagaaaaattgcattcgattttagctagcaactagactttaaaagggaacgtggggctataaggattccttctttaaaaaggttctgaaagtctttactatttcccctctctcgttgttggtgactaagaatacttaagcaactattgcaaaatagttgtctagggtttcctacttataatgggttatatcaagtaatattatagttgtttattcaaccattttttatagaatatttttccagttcattctctttttattgtagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattgg

SEQ ID NO: 13065 - DNA, 25162 bp, Human
tcaggagtttgagaccagcctggccaacatggtgaaactgctgttgctactaaaaatacaaaaattagccaggtgtgggggcacgtgcctgtaatcccaaatttgggaggctgaggcagtagaactgcttaaacccaggagtcagaggtttcagcgagcagagatagtgccactatactccagcctgggtgacagaacaagactctgtctcaaaaaaaaaaaaagagtttgagaacatagggggacaaaaaaatttaaaaatttgccaggcatggtggcatgtgcctgtggtcccagctactcaggaggctgaggtgcaaggatcacttgagccaggaggttgtggctatagtaagccatgatcatgccactgcactccagcctgggcgacagagtgagacttcgtttcaaaaaaaaaagtcagaacagagaccaattgaatagaaagtaaaaaaaaattaatgaaaccaaaattaattaatgaaatttaatgaaaattaacgagactataaagctggttgagatcaatattcagtgcctcctggatcaggccctgcttgcatcactgggcatacagcagtaaacacaacagacaaaaaacccagtacaatccctcatctgggcctttgcaactgcagttccttctccttgaaatgctcttatcttgtttatctattgcctcattttcctgctttatttttctccaaagtacttaactacctctgactttatttccttttcttactttctatgtttctttctttctgcgtgtctttctttgtttcttcctgtctttccatttctttccttccttgcggtcttatcaatctgtttatttagctccactaaaatgtatgctccacaagggcttaagtttttgtttgttttcttcactgcctttatcactagcacctaaacggagcctggaacgtggtaatgtgtaaagaatatttgtttaacagatgaatccttggtctcatggagctaacattcttttttttaattttcctatttttttactttaattaggaattcaacatagaagagcttacattctctctctttgaatttaagatttgaagaacactgctcagaagacaggatcttagagtcagggaccaagtattaatttcggaaatcaaactctagggctcaaatcgggaactaagaatcaaagatcatatttggaggttagaagtcaggagaagccacagttctaacagaagtctcaggactggagtcaggtttgggtatcagtggatacaatgtggattccaggagctgagaatcatagttcaagaaaagaaggtaagaaatgattgggttaggatcatagctagatagaagattggttttgttaaaagttaggactcgggggttagaggtcaggaagttcagcatcggaagtcagatttaggagtatgaggttaggaagcctcagggatcagagattaatgaggaatgtgacgccgggtcctagggctccgtttggcagcctaaggttcactcacgtgtccccatcctcagtgacgtagccgaagacgaggggagcccacgacagccccgggcccaactccgcgcccaacccaggtcctccgggggccgctgcgtccggacccagggagcccaggccgctgtcgcaccattcatctgcgtcggcagcttttcccaagcacgcgaccccagccatggcccccgccgcctcaggggccccccgcagtcgcccgcctgtagctgggctttgccgggagttctggagcttccgccctgcgggaaattccccaccacgccccctgattcacccaatgataatatgctgaatcgctcacaccccgccctcgtactgcatcctgaccaatcagagtattcgggaggactacaactctctagccgttcccacattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtgagtcggggatccgggtaggagggtcgggccgcgccggggcctggctgaatgctgcaggccccggggcccaagggtggccgcggtggggcgggaagtagggagcgcttcggggagtgggattctgagggctgttgcttagcgatctgtatcgctaggctggtgggtttctgggtcgcagtgtgttcagggttcgtttaccacatccacttgccaagttgccaatgatcgcgtgtttctcgcaccttggttgctaaggtccctcgctgcaaagaacataagttgccccggtcccgcttgctatgggtacctgattgttagaggcaaccagaggatgctgagggacccctgctgacccctcctatggcttccccttgttccgcgcctctcctaaacctaccgcctccactgcaccactgcacctccctcctaaacctgcctcccagccaaagcgtctcttcccttctcttttcctttctaaacttccctctgccttgtaaatctaaccctccccgcacacacactcacacactgtcgtgtccttcctaactcctcctgagtgttccttcatgccctgaatcccctaggtaggaggaggaggatcgcttgagcccaggaatttgaggctgcagtgagctatgatcgcactattgcactccaacctgggtgacatgagcgagaccctttctctaaaaagtaaaaaagaaagaaagtaagtcagggccagaaacaatggctcatgcttgtaatcccagtactttgggaggccaaggtggttggatcgcttgagcccaggagttcaagaccagcctgggcaaaagcccctactttctccctgtccccctaaatcttcctctccagcctctctgcccctcactaatcacctctcccggcatcactttgcatgtagataagatcttttctccgtcccctccctccctctgctccatttttaccaccatcccatcccagtgtaactaggttggtgggtgttcttgccccctcactgaccatttgaacccctttattccccccttaatcgttctccccactgtaaccacctctgctcccctcccccagcctctcaccctctggagacccaggcagggaaggtgcaggaggctcaggtgagatgggggaaagggtggaggggaggagagagacggacttgttccacatcccacactggggggaggtggcaaaggggaaacagtcaccccagggccctcggctcattgccccaatccctcacaccacccagtgcagctttctggggaaaggcagattctggggattgtcagagaagagtttccagcctcaagtccaggcctgtcctcccaaactttccttcttccttgccactgcctgccatcccttctgaaccacatttgtcctgggactggaagagacaggtatcccatttggtcttggaacgcacagatctcgtggacaagtgatgggaaaaaatgatctcacagcgtgatgacgaaagtaactcagggggccagatgcagtggcttatgcctgtaattccaataactcaggagactgaggcgcgaggatcgcttgagcccaggagtttgaggctgcagtgagctatgattgcatcactgcactccagccggggtgaaagagcaagaccctttctctaaaaagtaaaaaagaaagaaagtaactcagggccagacacagtggctcatgcttgtaatcccagtactttgggaggctgaggtaggaggatcgcttgagcccaggagttccagaccagtcttggcaacatagggaggcccccacctctacaaaatatttaaaaattagccatgtgtagtggtgcatgcctgcattgccagctactcaggaggctgagttgggggaggattgcttaagcccaggaggttaaggccgtagtgtgccttgactgtgccactgcaccccaaccggggcgacagagcaaaacacggtctcaaaaaaaaaaaaaggaagaaaagtaaagaaactcagggtactgtgggagcacagagaaaattttctgggtcaaagaagattctagccaggccattccctggaggaatccacaggctggtctagctgtcagaccaagatacagacacagcataagtgaagagtgacttagaattttcttagacaaggtgagaaatggtgatccacacaacaggtatcgcttgtgcaaagacctggggggcatgaaggggtgtgatgtgttccataattgggtggctggtggtggtcagcttgttatagtcgtggttagcatttactgacggcttactaaagctgggcccactgtttagtgccaaacgtgcctcatctcaatttcatcttcctggcatccctgtgaagagaaacgcctatcacggccattttacagatgcagaatctgaggcagagttgttaagtcacttatcccctgtccctcggctacaggagcagggaagggtttgagtcccccagcactgggcacgccacctgtcagaggctgccaggagaggtggacaggcagtctcataggagcttgaaggcccccgtcagcacctccggctctcccttaggccaagctgcagacacatgctgggcacaggccttccacacagcctcactgtgtacagcctgaaagagtgccagcccacccacacccctgagattgcctttcagacgtggggtggtgcagaagcgggcatcagaatacctcacaaatgcacagtggagctttgctaaggatataagagcctcctgttaggctgtggcaactcactcgcctggctcccaaagcacgaccactgtcagagaaaaaggttgaatgttaaaaaggatcctcagtcccaaagagagagaggcgaggatgtaaaatgcagcattgtccgtcacagggcaaaactggaaacagtccaaatggctgtcagtggatgggttaaatgaactatggttcatccatacaatccaatactatgtagctgctctgaaaaacgaggtgaggccgggcacggtggctcacacctgtaatcccagcactttgggaggcagggggatcacttgagcccaggagttttgagaccagcctgggcaacatagcaagatgccgtctcttttttaaaaaattattttttaaattaggtgggtctgtagcatattgttctgccgaaaactcaagatgttgtattgtactatgacctatttctgtaaaaaatattagttttatgcagagaaaactggagtaatttccattaagcttagctaacagtggttatctttataagggtgggcttgggcaattacaaggtgagtgccgcaagttatatgttgttgaagtatacatgagtataatcaaggtttttgcagaggttgtccaatctctctttctctctgtctctctctctctctcattctcactctctctttctctctctctttttttttgagacggagtctcgctctgtcacccaggctggagtgcagtggggtgatctcgctgactgcaacctccacctcccaggttcaagcgattctcctgcctcagcctcctgaatagctgggactacagacacgtgccaccatgcctggctaattttttgtatttttattagacacggggtttcatcatgttggccaggatggtctcgatctcctgacctcgtgatccacccacctcagcctcccaaagtgttgggattacaggcgtgagccaccgtgctcagcctttctctctctttttaaatagagacagagtctcactgtgttgcccaggctggtcttgaactcctggcatcaagcaaccttcctgcctcagcctcccaaagtggtgggattacaggcatgagccaccacgcccagccggagttgcacagtcttaaaaagcaattttttaaattgtcgtatgttcggaagggagggtcttattcaaaaagacttggacgcagagcagtgagtatccggggaagggagttgtctgaggtggtggcttggtcagaactgcattttggtgaaatccattgcagggcccagccgtggtccagcctgaagcaggcattcattccaaggtagaggagctcctggagctcctgccaggagccagaccctgttctcagtgctgggcacccagacaaagtccctgcccttgtggacatcctggcaattccatagatgtctgggaagactgcagaagccagagagaagggcctttgaagtggagaggggcgagctgacccagacagcctcacatgcagggcagcagggtggatgggaggtggagactgaggctgggaggctgggggaggaggctggggcaggacccccggaggagaggacaggctggaccaggtggagcgccggggagggaaagggggttggtggacagacccttaggaggctcagcgtacatgctctggagctgaagggctgtggcaggagggtgaggagggaggcgggggcaggaaacatctggctgatgggggggacagtacgatcgcattgagatgaggcctgggaggaggatgggcttggaggagatgccagggtccatttgggacatagtaggagtgagaggctggggggcacctagggcaaggtgtccaggaagccagggaaccccggatctgggggcagagagatggtatcatgagtgacgaggcagaggtcattggcatggatgagacaggtaaccccaggaaagtggaaagagaaagcagagaggccctggacagagtcccagagacctgccagtctggagctgggctgaggggaggcttcgaggaaggagacagaggttgctggagaggtgggcagagtgtctgaggcctcgagcagggggcacataggtccttgaagtgagcaccaaggctttgcattggaatcattcccagagtgacttgggacattattcagaggcccccagggctgctgggaagggacagcaggcccacgctccaggggacccgggaacgaagggaagaccccaggctgtgataataacagcaacagccagcgcttaccaagcacttcccccgcccctggtgctgcgcccagcacccaagctccctttccaaggtgagggacaccaagacttagaaaatcaaagtcacgaccaggcacagtggctcacgcctgtaatcccagcactttgggaggccgaggcaggagacttgcttgagcccaggagttcaagaccaccctgggcaacagaggaagacctcgtctctacaaagcaaacaaacaaacaaacaaaaaatgagcctggcatggtggcacgtgcctgtggtcccagctacttgggaggctgaggtgggaggatcccttgagcttgggaggttgaggctgcagcaagctgtgactgcaccagtgcactccagcctgggcaacagagcgagacactgtctcaaaaaagaaaagcaaagcaaagccactcacatgaggtcttgctcctggggacgggcatggccaggactccaaccccggcagcctgtcccagagccctggagctagccccagtgcagtctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacagtgagtatcttcctggagggacagggagcagggttctggggggcggggggatttcagggcaggggtgtgggtgatacctcctcaactccatcaggagtgacatccaaagtatgtagcagtgggttgggtaccagtgccagagcaggctcctggaggccgctggctgggccgggccttgtgcctttagatgtggggaggccgggaaccccagggctggggccagggtgccggagacatccatgcccctggctgaatgcccgtcctgccgctgtctctcttctttccggtcagtggacttcctgcggaacttattctcccagacgctcagcctgggcagccagaaggagcgtctgctggacgagctgaccttggaaggggtggcccggtacatgcagagcgaacgctgtgagtcccctgtcaggattgggccactttgcctggctcctggccccaagtgacctcccatccccagccacttgaaccatttattgaaaccttttctttataagtagcaagaaacccagctggaactggcttaagccaaaaaggagtgtgttggctctaatccagcttgaagcacggctgggtccaggtgcttccactttgttaaaaatcataactctctctgatgctgcttttcttgttttggggtaaaggtaactcctggcagctgcaaatgcaggttccactagcctaggagctgccaccgagagagcaccttttcccagtagttcaaaccaaacagcagagattggctcccattggtcccggttgagtcaaatgcctgcccccatgcctctgattggccagacctgggtcgcttctccattgctgagtgaattactgcactctgattgaccaggcctgtttcataaaatgaggataatgattatagtatctaactcataaggttattggcggggctaaataaattaatataggaccaggggacagtggctcatgtatgtaatctcagcactttgggaggccatcgtgggaggatcactcaacgccaggcgttcaagaccagcctgggcaacatagtgagacccccccgccatctctacaagaaaaaaaaaatagtcagatatgggggcgttgcctgtagtctcagttactcaggaggctgagaagggaggattgtttgagcccaggaattggaggctgcagtgagctatgatggcaccactgcactgcagcctgggcaacacagtgagactctgactctaaaaaaaaataaagtaataaaatttaaaagataaataaaaatgcaaatgcttagagcagggcctggaacatagcgagagctgtggcagggtgtgccgtggttattactacaggaggcttatttcagatgtggtggataggtgtccacttactgagtcagcatgaaatttatatttctttttctttttttttttttgagatggagtcttgctctgttgcccaggctggagtgcagtggcacaatctcagctcactgcaacctccacctcccgggttccagcaattctcctgcctcagcctcccgagtggctgggattacagacgcacaccaccacgactggctaattttttgtattttagtagagacagggtttcaccatgttgcccaggctggtcttgaacacctgagctcaggcaatccaccctcctcggcctcccaaagtgctaggattagaggcatgaaccacccgtcccggcctgaaatttatatttcttgccacaagttgaggtcaccaaagtctgagaaaccaggcccttggcagtcctcaactagaacaatcgaccctttgtggttcctgagcagccttttgttgaggacatcttctcctgtgtccctgtcctccagctgccactgtctccctcctcaggcagccaggcctgctgccctgagcctccctctcctgcggcaggcgagcagctgtctgcagccatcttttagcctgggcaggccccaaagacaacacaggcagtggctacaaagcatttgttccttgtgtcctcctgcacctggattctggggtaattggctcatgagggtgcccaggaggagatagtaatgaaaaataacaattagttgaggccgggagtggtggttcaggcctataatcccaccattttgggaggctgaaagcaggaggatcgcttgaggccagtaggtcaagactagcctgggcaataagcgagaccccctctctgcaaaaatttaaaggtgaggctccaaccctcacctcactgctctaaaaatttattattattattattttgagacagagtctcactctgttacccaggctggagtgcagtggcgctatcatggctcactgcaacctctgcctcccgggttcaagcgattctcctgcttcagcctcccgagtagctgggattacaggcgcgtgccaccacgcccggctaatttttgtacttttagtagagacggggtttcaccatgttagccaggctggtcttgaactcctgacctcaggtgatctgcccccctcggcctcccaaagtgctgggattacaggagtgagccaccgggcccggccctaaaaatttctttttaaccacttaattgaggcttcactatttgccaggcactgggctcagcactttacaagtgccctattatttgatattcacattatacctgtaagatcattatggaagtgatctgaacagaggaggaaaaggaggcacaaaaaggtcacgactcagtgtagggtcaaacagttgccaagtggcagagccaggatttgaccccaggtcccctgaatccagaccacatgtagccaccactggattcaaccaggcctggcctgatggcatctcagagctgaagctcagggctgaagctgtggcaggctttgtgctctgttcacctttgctgtcctcccttggacagggcatcccagaggcatctgatccacagcatatcacacttgtgcctgtctatcagctgatgggcagatgccagggtactatggcctggtggctactcaccagccaccagctagctatttctgctcagcccagggttcttatcctaaagtggccttttctcaagtccaagttggtgtgatttccaacagtggattctcttttttttttttttttcctttttttgagatggagtctcgctctgtcacccaggctagagtgcaatggcatgatctcggctcactgcaacctccgcctcccgggttcaagtgattctcctgcctcagcctcccaagtagctgagattacaggcacgtgccaccacgcctggctaattttgtattttcagtagagatgaggttttgccatgttggccaggctgggctcaaactcttgacctcagatgacccgcctgcctcagcctcccaaagttctgggattacaggcatgagccactgcacccagcccaacactggattctttatccgctggctggctcttccgcagttgattgtgtgacttcttcccctatctgagccccagttttctcatttataaaatggggatgttaacaccatccccgtctagatgattggaaggcccgtcatgcatctgagatgcttgccccagggcctggcatggagtaaacgatgtcaggggctgtgatgggtggtgctatcgtagggactgagcaaacggtgtcatatggtgcataagttcctctcctccaggtcgcagagtcatctgtttggtgggagctggaatctccacatgtaagtaacccttctcccccagcagctacccccaggaactggggagtccctcccaagggctggggaggagccctatctgagccctgtcctgggagggttagtatggtatagaccaactgctccctgacccccctttcctagccgcaggcatccccgactttcgctctccatccaccggcctctatgacaacctagagaagtaccatcttccctacccagaggccatctttgagatcagctatttcaaggtttgtgctcccccaggaaggggcgtctgtgaggggtggggatggggtcacctggctccaaccctcacgctacctggggcatctggccctctggctgtctctcctacagaaacatccggaacccttcttcgccctcgccaaggaactctatcctgggcagttcaaggtgagatctttgttttgcagggggcgaaacaggaagggttgggggagggcacgcatgagaagccccgccaaggccctgcagacaaatattatgtagccattaagtacatgggtgctgggcccagactgcctcggttcaagtcctggttcctcgtgtcttcatcttacgaccttgagcctccgatttgcctcctgtgaagtgaagctaatggtactgtctgaagagggctgctgcgaggcttagctgactaatgatgccgttgagagcccgggaccctgcagccgggctgcctgggtgcaaatctcagctctgcagcttacccaccgtgtgactttggcaacacaatccccttccctgtccttcagtttcctcatctgtgatctggggatagcagtggtctctccccgacgcggctgctgtgacggttccctgggggtaaaacagtcacagtgcctagaacagttcctggcatgcggcagtggcctgtggctgttccctgcagtcgtcagcagtgctgtcgctcttccctgcagccaaccatctgtcactacttcatgcgcctgctgaaggacaaggggctactcctgcgctgctacacgcaggtaggcggatgcgagcatcctgggaggaggatgggcgggtggaacgggcatggtgtcctcagcagaggagcagagctgcgtgcccaagagctcaggcggggactccagcaatgcggggccagggcttggcctactgcctccttgctgcatgacctgccgtgagtcacgtcttctctgcctcagtttccccttccgtcaaacaggggccagaaaaggtttgccctctcaggtctgccctctcaggtctgcagtgcggtggcagtgacctcctctcagggccatcccatgtgtgatgtggaaggagcctatggctgaagggactctgtgtgcactataggcaccccagatttcacattggttatgagcgagtttccaaagtgacttcatctaacaaaatccatacactatgacacgtgtccaacaagtagatgttgtgccttaaggaaggggcacctttttatagttttttgtgctttgcccaattataaacatgtctcgtacacgtcaggtgcttagccaagggcctctccctggggcattcaagcaaggatggctcacattgttggcttctggtttggagagtctcacacccctaacagtaaaaaaatcttgatgggctgggcacagtggctcacacctgtaatcccagcactttgggaggccaaagcgagagatagctcgagcccaggcgtttgggacccgcctgggcaacatagggagaccctgtctctacaagaaatacaaaaattagctgggcagggtggcgtgtgcctgtagccccagctactcaggaggctgaggtagggggattgcttgagttcaggaagtcaagactgcagtgagctatgatggtgccactgtactgtagcctgggagacctggtttcaaagaaacaaaaaacaaatcaaaacaacaacaaaatgttgctgcctctacctgttttatgaatatgtatagaaatgacatgatgcactacaacagtattaattcaagctctagatcacacctcagaaccccgaattataaaacaggtggccgggcgcggtggctcacgcctgtaatcccagcactttgggacaccgaggtgggcagatcacgaggtcaggagttcaagaccagcctgtccaacatcatgaaatctggtctctactaaaaatacaaaaattagccaggtgtggtggtgcctgtaaccccagctactcgggaggctgaggcaggagaatcgcttgaacctgggaggcagaggttgtagtgagtcaagattgtgccactgcactccagcctgggtgacagagcaagactccatctcaatttaaaaaaacaaacaaacaaacaaaaaagagtggtaacattgaaaataaataagtgttctagtgttttctccctgtacctgcagtttggcacctgcagccccaaaagctaccgccagggggaggaacaactggctttaagttcagatttctcaggtgggcgaggtgttcccacctggggctggtaggaggcagagggcagcggaggcctccttcttccaagaggaggagtcctgtgatccccacactttgggaggccaaagtgggagatcgcttgagcccatgagttcaagaccagcctgggcaacatagggagactccgggctcagaataaaccttctgcccagagagtcaccattattccaggacgtggctcagatatgataacagcttgcttgaagccaagtgctttttgtggttgatgtcatgacactcaccccaagaccccgctggcccttgtttgtcagcttctgtcaaagtaaatgttcactgagttgattccctacagcagggagggagatgatggacaagatggagacaccatatactgagcatataagatggtcatgggtccctggaacacagttaagctggaaggggagtcagaaacggtgtatgtgttcgggaaagggggtgctgttgtaaaccccatctctacgaaaaatacaaaaattagccaggcgtggtggcacatgcctgtagtcctagttactcaggaggctgaggcatgagagttgcttgaacctgggaggtggaggttgccctgagctgagattgccccactgcactccagcctgggtgacagagagagactccgtctcaaaaaaagaaaaaaaatgacacatcacatacaaactattatataaaggccaggcgcggtggctcacgtctgtaatcccagcactttgggaggccaaagtcaacgtcaggagtttaagaccagcctggccaacatggtgaaaccctgtctctactaaaaatacaaaaattagctgggtgtggtggtgcgtgcctgtaatcccagctactcaggatgctgaggcaggagaatcacttaaacctgggaggcagaggttgcagtgagccaagattccgccattgcactccaacctgggcaacagagcaagactccatctcaaaaaaaaaaaaaaaaaaattagccaggcatggtagtgcacacctgtagtcccagctacttgggagcttgagagaggaggattgcttgagcccaggatttcaaggctacagtgagctatgatcaagctactgtactccagcctggaccagtagagcaaaatcctgtcaaaagaaaaaaaaaaaaaaaccatgttgtcaaagaataacagaacgcagaggtatttcggtggttcttttccacgctgttcagttatttgcttactgttcagttatttgcaaattgctcactcacatgtgagggagtcagtgggtagactgagtcaagtaccaaaggcaaaaccaagatttagaatagtgggcaagggaggaaagttacagggcgtgtgggaacagtgacagtgactcttgtctgtaggctttggagataaggtggttgctggtagggagcccagaaggcagttagagcattctttctgcccttgaagggaaacaaacccttcccgttgtttctggagtccctgggaaacgctgtcagtttggccctgggccacacatgcgagccatctctgcgtaacctctgccagtgtcctctgtcagcacctgttttagcggcattcctcacaggcaaacaacagctgctccaaagggggtggttgttttaagaaaaatgagcgcgcacaaatgtctgtgcagaaaagaacattcccacctgtttaatatggaaagtctcactgtcttaaaagaaaacagtggccgggcgcagtggctcacacctgtaatcccagcactttgggaggctgaggtgggcagatcacgaggtcaggagatcgagaccatcctgaccaacatggtgaaaccccgtctctactaaaaatacaaaaattagctaggcatggtggcgcgtgcctgtgttcccagctacctggaaggctgaggcaggagaatcacttgaacctgggaggcggagcttgcagtgagccaagatcgcgccactgcactccagcctggcaacagagcaagactccgtctcaaaaaaaaaaaaaaaaatagccacgcatggtggcgggtgcctgtaatctcagctacttgagaggcggaggcagggagaattgcttgaactcaggaggcagtggttgcagtgagccgagatagcgccattgtactccagcctgggcaacaagagtgaaactccatctgaaaaaaaaaaaaaagaaaagaaaagaaaagaaaacagtggctgggcatggtgtctcacgcctgtaatcccaacgctttgggaggctgaagtgggaggatcacttgagcccaggagttcaagaccagcccgggcaaatagggagaccaccccaccccccatctctacaaaaataattaaaaagataaaaaattagccgggcatggtggcatttgcctgtagtcccagctactcagtgggctgaggtgggaggatggcttgagcccaggaggtgaaggctacagtgagctgtgatcagaccactacactccagcctgagtgacagagcaagaccctgcctccaaaaaaagaaaagaacacaggtgaatatgccatctatgaaacaggccatagtaagaaaggaccctggctactaaaggggaagatagtgattaaagccaaggaagggccaggcatgatgactcacactgtaatcccagcacattgggaggctgaggcagaaggctcgctgaccagcctgggcaacatagtgagaccccatctctacagaaaattttaaaaatcagccagatgtggaggctgaggtgggaggattgcttgagcccaggagttggaggctgcagtgagctatgattgtaccactgcactatagcctgggcgacagagtgagaccttgtctcaaatacataaaaaaacatggctaggcacagtggctcatgtctataatcccagcactttgggaggccgaggcaagcaaatcacgaggtccagagttcgagaccagcctagccaacatggtgaaaccccatctctactaaaaatacaaaaattagccagtcatggtggtgcgtgcctgtaatcccagctacttgggagactgaggcaggaaaatctcttgaacctgggagtcagaggttgcagtgagccgagattgtgccactgcactccagcctgggtgacagagcaagactccatctcaaaaaaaaaacaaacaaacaaacaaacaaaccacacctagtaagccctcctgattcatttatgttaatgcttgcctagagctgccacatgcagctgtgcagggtgcgcactgcacaaggatgccacatctgagggggctccattaataacagagacattgtaaatgtatgttaatttcagcaattaatgacaggtggaaataaagcatctggctctaataaaacaacattttttttctgaaaaatgaaagcaaatggcctgaatttgcagaataaaagccacacaggctgtggagtggctgtgggcctggcctcatagatatttaggtttgggccccttttttttttttttttttttaattttttgtagagacaagcgtcttgatatgttgctcaggcaggtcttgaactcctggcctcaagtgatcctcccacctcagcctcccaaagtgctgggattataggcgtgagccgccatgcccagcctggcccctgcctttaagcagccttgactgtcaccctttaagtggcaccattgggatgaacagaagagtcttcagataaaccctgccacttgcttctcctccctcccttctccacctgtccccaccacctcactgctcctcgtggccctcaactccctactgtgccttctggcctacaaggggtggctcactcctcacccctcttccctccatctctccctctagaacatagataccctggagcgaatagccgggctggaacaggaggacttggtggaggcgcacggcaccttctacacatcacactgcgtcagcgccagctgccggcacgaatacccgctaagctggatgaaaggtgaggctggagggcatcctgagggcaggcctcctctcagcaccaggagcagtgtctccatgcagtgggcacccattctgtcctgctcaattctttggggtttttttgttttgtttgtttgtttttgagacagagtctcactctgtcgcccacgcggggagttcagtgggtgatcatggctcactgcagcccaactgcctgatttcctgtctttggctgtttttaatatatgatagtaggccaggagcagtggctcacacctgtaatcctagcactttgggaggccaaggcgggcagatcacctgaggtcaggagttcaagaccagcctggctaacatggtgaaaccccgtttctactagaaatacaaaaaaaaaaaaattagcctggtgtggtggcatgcgcctgtaatcccagctactcaggaggctgaggcaggagaatcgcttgaacctgggaggcggaggctgcagtgagctgagttcgcaccattgcactccagcttgggcaacaagagcaaaactctgtctcaaaaaaaaaaaaaaaaaaaaaacaagaagtcacttattccactcatggaaagccatttctgacattctttatgctgatttaacaaagcctctggtgtccctgtgagataaggacagctgcagcatttgcagaagggcctctggagtgtggctgttctgataaaatgccagctgagtgcccctgggctgaggattcctgaatagcccaactgcaagcagctgggggcagtgtacaattcacattacccccattatgtgtcattgacagcagcgtcacaggcagcacccacggtgtcatgctgtccatgcagaaatattttaaagaaaattaccgactactgacattgaaacaatgctttataaatgtgtgctgaatgaatgaatgggacagttgagcaaatgacttagaattcagtgggttgcaagtgacagaaatgctttctttctttcttttttttttttttgagatggagtcttgctctgtcacccaggctggagtgcagtggtgcaatctcggctcactgcaacctccgcctcccgggttcaagcaattctccctgcctcggcctcccaagtagctgggattacaggcacgtgctacaacccctggctaatttttatatttttagtagagacggggtttcaccacgttggccaggctggtctcaaactcctgacctcaaacgatccactcgcctcagcctcccaaagtgctgggattacaggcgtgagccaccacacccggccagaaatgctttcaagcttcctaaatcaataagaaataaggccaggcacagtggctcatgcctgtaatcccaacacttttggacgtcgaggtgggtggatcacttgagcccaggagtttgagaacagcctgggcaacatagggagatcccatctctaaaaaaaataaaatgtagccaggtgcgatggtggatgcctgtgagcccagctactcgggaggctaaggcaggaggatcacttgagcctgggaagtcggtggtgcagtaagctatgatcacaccactgcactcaaccatgattgcaccaccacactccagcctgggcaacagagtgagaacctgtctcaaaaaaacaaacaaaccaataaggccgggcgcagtggctcacacctgtaattgcagctctttgagaagccaaagtgggcagatttgcttgagcccaggagtttgagaccagcctgggcaacatggcgaaaccctgtctctacaaaaaatacaaaatttagccgggcgtgctggcatgcacctgtaatcccagctactcaggaggctgaggcaggaggatcacttgaagctgggaggttgaggctacagtaagccatgatcgtgccactgcattccagcccgggcaacagagtgagaccttatctcaaaaaaaaaaagaaagaaaaaaacaaaaaaaatgcaacaacaagaagagaggtcttttctgagcagagtggacacctcaggagacacccatcacactccaactgatggaggtgtgttcatgttaacagtggaagaggggtgggggtgctgcacctccagactccggcccagatcctcttactgccttctctttcttccccttccccatacccagagaagatcttctctgaggtgacgcccaagtgtgaagactgtcagagcctggtgaagcctggtgagcctctggccagggacctgcccaggtggatttgggtgggggtcccctcctccccctgaccccctcccaaaggccacacccgcacacatctggccacctctgtctctctgaacagtgccccagatccatcctggggagaatggggtctgtgcccctggccggtccccactgctcccaactcccactgtggcctccgggtctgccattgctcccacctgtcctctctgcctccccatgtcactgtctctgtccgtccatctgtctccacctcagatatcgtcttttttggtgagagcctcccagcgcgtttcttctcctgtatgcagtcagtaagtggccccccagcctccccgcatccccaaccgccgcctccacctgtgctgggccccatgggggcagcctgggccctgcctcaggaaaggtcacctccccagctatggggggcggcagggaggtttgctgctgggggcgggggagggagcggtggcgcagcctgggcggaggctcccaagctcacgcccctccccgcaggacttcctgaaggtggacctcctcctggtcatgggtacctccttgcaggtgcagccctttgcctccctcatcagcaagtaggttgggggctgtggctgggaggacggctgggcacccagggccaggacagaccctgaccccttagctccccctccccacagggcacccctctccacccctcgcctgctcatcaacaaggagaaagctggccaggtaagagcccttcttcaagcccccgtcgtcacaggctcccccttccctctcacccttttcctcagagggaacccccactgtggaaccccagcactttgcattcctcagctcagaacctggggctctagaatccagaggggtcgggttccaggcctctgggacattcactgcccttttgagcaagtgatagaattccaactcaaaccagctgaagccagataggaaggccgggcttccagggactgaggaggtgggagggggtgcaggggtcaggagagacagtgcggggggcggggttgggtccacgctctgggtctctcaggtctgtttttcctgggcagcctcactctagggcaggtgctccctcctaggtgttcccctcaggggaagtaggcagggtcaccgggcaagcagcgcacgctgtgggcagacactgtcccaagtcttagcctgcgtgaactcactggcgccacaaccccatcgcggttttgtgatcacccctattctacaggaaactaagacacagagaggacaagtcacttgaccaaagtcactgagctggctgggcgcaatggctcacgcctgtaattccagcactttgggaggccgaggcgggtggatcacctgaggtcaggagttcgagaccagcctgaccaacatggtgaaaccccgtctctactaataatacaaaattagccgggcatggtgctgggcacctgtcatccaggctactcgggaggttgaggcgggagaatcacttgaacccaggaggtggaggttgcagtgagccgagatcacatcattgcactccagcctgggcaacaagagtgaaactttgtctcaaaaaaaaccaaaaaaacaacaacaaaaaaaaaacaaagtcacagagctaggatacaaacccaggccacctggctccagggtctgtgctcttagctctcccttccctgctcctgcccctgacccaccccctccctgacagtcggaccctttcctggggatgattatgggcctcggaggaggcatggactttgactccaagaaggcctacaggtgaggccccgccgggggttggggcagcctggaagggacagggtgaggtgggagcgggggcacgaaggcagatgagaggagcaggcaggggcgagcccgcctgggaactctgatctcctgctgcaccgcagggacgtggcctggctgggtgaatgcgaccagggctgcctggcccttgctgagctccttggatggaaggtgaggagctgagcaaccccagcctgtcctgagccccatccctggaccctctccccaccccatgggtcctctgaccccatgatgcacagtgacctttgacttctgtgacctttgctcctgcagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatctaacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatccggtctggcctcctgtttctttctgtgggcacccagggaaatctctgaagggagggggttagatcttgggccactaaggaaccagaaagtctccgggatccagagtgaggggtaacaagagggtcctcacgggggccctcgtggctctgacccctggactcccagcctgccagtgtcccttcctctaagccccgtcactgaaggcctgaggccccagaaagagggaggaaagttgacttcagataccccagccccgcctcttccccctgcctgctcagcttcctctctccacttcctgctactgcaggcctctcctccgagaacaggtagggcccccaggaaccgagcatctggcatcttcagcccctgctgcctccctttggtatgaggcagctgccctgacccacccctgccacgcactgcccacagcctcctctcctgccacggtacacaagcaggcatctgcttccctctcccctcccctcccctcccttccttcctgctcttgcctgggcagggcacctgcgcctccctgcccacctccctccttcctaataacaccctggccttctggtcaatggcctaatgtatttgtttagctgcctattatccatatgctacacctgccccaaacaagaatggaaggccctgaggggaggagcctgtcctgttcatcaccctctctccagggcagaggcacctaattccagcctgtattcagtaaatactggatggatggaaggaaggaaggaagggagggagggagggagggaggatggatcctcccccgatccaggtctcctgctcctgggactgctgctgggataagtgccaccctaagtgataacctacgtaggactctgtacctggttaggagctggggcctgatgggtggatggagagagagaggaacagatgtgtgataaagcaagatgagtaaaatgttcatggtagaatcttggtagtgggcatagggatgtttcctgtacaattctttcagcttttctctatgtctgaaatttttcataataaaatgctgggggaagagattcagtggcccctccatggtgtgggaagggaggaagaggggatgttattacctttccagatatagggactgcctactctgggccaagaacttttccaggcgctgactgggttttgccaagggctggcccacatttacacagcccccatggctgttaaaaatcttaacatatttcctaccacttcagtaaagagctattgttttgagtcctctccccacaccgcaagacacactggcctctctcctgggatccccagattccccaccatccggtactaaagatttaacccctgccggccgggtgtggtggctcatgcctgtaatctcagcactttgggaggccgaggcggggggatcacttgaggtcaggagtttgagaccagcctgggtaacacgtcaaaaccttgtctctactaaaaaatacaaaaattacccaggcgtggtggtgcacgcctgtaatcccaactactcgggagactgaggcacaagaatcgcttgaacctacgaggcggaggttgcagtgagctgagatcgtgccactgcactgcagtctgggcaatacagtgagactccgtctcaaaaataaaataaagaattaacccctgccacggcaagcggcctctggggtccattctgattggtcagggtctctgccatattgattgtaaatatcttgaacatgacccgagggctagagcagctttgagtcttacctttctccctgccagaggccaggtcatgactcactggcttcctgcaacctgacgatggcccagccagaagacaaggcacctgaagtccccacagagggggtgaggtgaggctactagggctgaggctatgccctccttcccctgcatccagaaaccctttccatccaatacctccctcactacagaatcctgaatcacatctctgagcctctgccctgggcctgccccttcctgta

SEQ ID NO: 13066 - DNA, 25162 bp, Human; identical to SEQ ID NO: 13065

SEQ ID NO: 13067 - DNA, 41965 bp, Human
ctaatttttgtatttttagtagagacggggtttcacaatgttggccaggctggtcttgaactcccgacctcaggtgatccgcctgcctcggcctcccaaagtgctgggattacaggcgtgagccaccgcgcctggctgaggagcgaagttttctaaggttccttcttgtcctgtgttagccctcagagaggtaactcactcaccttctgcacctagagagcctcatccccagggcaatcatccccagggcagtgctggagatacagcagtgaccacaacagtcccaggtcagcctgcccagttggggagacacacccatccctgacagtgatgacacaaagtgagcagggatggggtggaggagctgagggggcaagggaggataggaaaagggctcagagagagtttcctagagcgagagctactgttacagggctgagacctagaggaaagtggaggaaaccgataataaaatgataattatatattcagaatatcccaatgcaaagcttactctttttccaggtaatatataaggttcataatcacagcgctccaaatattgaccacttaagcatgaggcccagggcctgatgttttccattcgccatctaactacgtcttcccaataacacagcggggcaaaacgggaagacgaagaacgagtacgattatatccctggtttataaaaggggagaaactgaggctcaaacatagatgtcacttgtcaccagcctggccaacacggtgaaactccgtctctacttacaaaaaaaaaaaaaaaatgggaggctgacgcaggagaattgcttgaatccgggaggcagaggttgcagtgagccgagatcgcgccactgcactccagcctgggtgacagagcgagactccgtctcaaaaaaaaaaaaaaaattagccaggagtggtggcgtgctcctgtaatcccagctactcgggaggccgaggatgcagtgagccgaggttgcagtgagccgagatcgcgccattgcactccagcctgggggagagtgaggctccgtctaaaaaagaaaaaaaaagagagagagagacgtcacttgtccaggatatcttatccagtcagtagcaccacaagggttagaaccctggccagacatccacccaatttcacgggtgaacagttaacagcctctgagagtcttgtcctctctgggcctccgtaacaccctctccaaactaagggtctctcagcagatggccgggtttagagctgtacgaagacacacagctaatgaaaaattgtggaattctcagagcccgtgaagcctagcccacggatgcgaggtttggaccactgagggaacgcgcatgcgtgctaggcagggcagtccgaaggcttgggggtgtatcatagggtctcatcggaggtttgttggccgtaagacccctggaattggaactctaaaaacacagaaaggatatgagctcaggagacttgaacgaaagagttgtcttaggaagaggggtcagaagacaagggtgctgggcaaaaggctagttcttcgaatcagaatacggtggccagaaaggttcctctgacgaaagaggggcgtggttcgaagccgtacagtggccggtaaagctcaagaaacatggaacgaaaaggacgcgaagaatcggcagggagaagcggacaggatgtcccgaaaggctcatataaccgaaaaggcgggttaatgtgaagggacggaagggacagaacttgcgggaggcacatgctggccgagaaagtcctggagttcggagcatacagtgtttttattaggtggaaacaaacgggctgggagaaagacgagtacggtggccaggttggtccttccatagccggaagtggccttcctgagaggcgtggctgcggcactcttgccggatagggtggcccggcggggctaggaaagcgtgaaatctcgcgcgattgcgctgcgaagtcggggacggggcggggctggcggcgggggcggggacccggagcgggaagatggcggcggcgcaggaggcggacggggcccgcagcgccgtggtggcggccgggggaggcagctccggtcaggtacggaggccgagaggggactgagggggttcttccccagccggggggcctcccacggggcgtgtcctacctcttgtcacggaatcccgtgcactgggggctccttggccagagggaccttgaatacccggcccaggcagggccggaccgcccgggaggccggacggtgccgggaacagggccctgttgcgggtcggttcccctgcacgctcgagccgggcggccaccaggctcattgctcgatccggggagacagtggctcggaggggcgcaggcttgtaccttggcgcgctgggttctcaactccgcgattccatgctctgaggccgttcctagagtggtctggcgttcaggtctcgttgtagtgtttgaggtgtgcgcagtgattaattgggagttttctagctgtggggaagtcagtattagcagggcacggccgacagacccattttacagacgggaattcaaggaacagtgagactaaggcgcttctagaaggtcatcctggttaggtttgtaactttatgtagaagttacaagacactgctgacacagggactggtatggttgtggttttaatgtaaaatagttctatgggttaattagtcctggtgcggatgacttctgccccactgctgtcttaacacactgcagagcataccatttcaggcagctaccgttcaggcatttggggaatagatggagagacatgaaggtgctgtcgacccacccactgggatgtcactgacatgtgggaggcagctcaggggaaaggagtgcgggttgagaggggagaatgaagctgactctctgtgtgaccttgggcaagttcctttccctctttaggcctttatctctcccgtgttaaatgcagaggttggacaggagggccagccatatccctgctgtcaggggacgaagagaggagactgacatgtaaacagttgtaatcctgaatgattaggttggtgacaaaagtctgtgtcagggactgggggagcccagagaaagagcaagtggtatcacttgggtaggacacatggatgaaatttgtgtgatagagcccactgtatctgctctgaatcttttcagcattctcagccagggcctggcttcagggacagcttaggaaatgtttgttgagttagtgctggaatgaaggctcagttcctgtcttcaagggtttcccagtcttgctgaaaggaggtcgtttcccctctgggtttctgttgattattgggttgatggtggcttgagagaccagggcccaggttgttctcattgccctgagcttccagatggcactctgatcttctcttgtaccaactctgcttaaaaacaatcaagagttacccctttgcctttaggacaaagtacaaattctttaataaatcacagtcttgcacgatccgacacttttcttcagactagactaggatttctcgagctcggcactatcaacattttgaattggataatgctttgtttggggggctgccctgtgcattttaggatgtttagcagcatccgtggcctctacgcactagatgtcagtaggatccacgcccctccccagttgtgacaaccatatatgtctccagacattgccaaatgttccaagagcaggggggcaaagccatccctgcgtgagaacaactgcgctaaaggggatccgctgctctgaacctattttatttctaaacctcttttattgcctctcagtctctttcctcatagtctatgcacaggtctctcccctctttagctagttgatgtgtattagtcctacagatttcagatgtcccttcctgcagaaagccctctttgactgtctgggctccgctgtcccagccctgccctactgggtttcactgtctggggactgggaaccccaggagggcagagccaggactgccttgatcaccactgcttccttagcaccactcagctcagcgccaggcacagaggaggtgctcagtgtttgtggaatgagcggatcttgaaacagaggctgggctgaggtggaattccctgatgccatggtggatccaggtaatcagtgaagacatgccgcaaaacctagcttcctcctgctcttgcctagccctggtggtctcagctacttcttggaccctttagcagatgttgctggggattgtgtgtgtgcgtggacgtgcagatccgagagcaggaactgtgtcttagtcactgatgtgtccacagccactgccacccttctcccatgcccagggcctagtgcacagcaggcacaccctctgcacagtctgctgctttagctagcctgctcctgtagccaggaactcggacacagaacccacagctttgccattccttccttcagcgaatgcgaattgagtctactccatgctaggcctttgctgatgctggagatacagctgtgaataaaataggtgctgccctcttgaaggcccttacacttatgttctagttggagctgaatttataggggaagcacagacagggacacacagtgaacaagataaataagaaaaacagcagttcagatggctctgcgtgccatggacagaaataaagctgggatggggataggaagtgaggggtgggtagaagagttgcaattaaatagggtagtctagaaggcctctctgaggaggtgacgcttgaacaaagacctgaaggaagtgagagagggagtcccaaagatacacgagggaaaagcttttcaggcaaaggagcagccagtgcgaaggccctaaagtgggaggtgcctggtgtgatgaaggaagggcgaggaggctggagcgggtgaggggagaggggtggctggggacagatgcagattatgccaagctttggaggccatggggaggacttggcctttactctgagggaaataggagctgaaaagagtgactctttttttttttttcttttttctgagacggagtctcgctttctcaccacaatctcggctcactgcaacctccgtctcctgggttcaggcaattcttctacctcagcctctcaagtagctgggattacaagcacctgccaccacacccagctaatttttgtatttttagtagagacagggtttcaccaggttggccaggctggtcttgaactcctgacctcaggtgatctgcccacctcggcctcccaaagtgctgggatttcaggcgtgagccaccacgtccagccttgtggtataatttagatggtataacgttcacctgttcttaggatagagtctattggctcctggtccgtttatgcagttgtgtggtgcagccatcaccacagtctggtctgagaaagcttctgtcccctcaaaaagttcccttttacagtctctgctgctcccaatcctaggcagccacagaggtgctatctctgtaattttctaaaaatgtcttaaacaaggatctaaacaacatccagtcttttgtgtccagcttctttcattgggcataatgggtttgaggttcatgttgttacatagatctgcagttgttcatttttattttattttttacaacctaggatcagggaaatttggcctttggggaaatcctaaagtacgtgctcacagttgttccttttcactgctcagtggtagtctgcagacatgacacagtttattctttcagtccttgaaggatatttggattgtttttagtttttgtctgttgccaataatgctgctatgaacattcatgtacaggcttttctgtggctgtattttgtttctttttttttttttctaagtaagagagacagggtctccctgtgttgctcaggctggtctcgaactcctgggctcaatggatcctcctgccttggcctcccaaagtgctaggattataggcatgagccaccacacctggccactgtttgtttttgagacagagtcatgctctgtcgcctaggctggagtgcagtggtgtgatcctggttcactgtagcctcattctccaaggctcaattgatcctcccgtctcagcctcctgagtagctgggaccacaggcatgcactaccacacctggctaatttttgtatttttatagagatgaggtcttgctgtgttgcccaggctggtcttgaactcctgggctcaagcagtcttcctgccttggcctcctgaagttctgggattataggcgtgagccactgcgcctggtctggcttcatgttttctgcctcctgggtagccattcaggatgggtttgctggattgtgtagtaggtgcacatatgacttgttcaataactgccatattttccgaagtagctgtacttttactttcccccctagcagcatacgagggttcctgtttttccacatccctgccagcacttgtgattgtctttctgctgatagccatcctaataggtgtgaagtgacacctcattgtggttttaacttgcctttccgtgggaaggttcccagccagattgcccatcactaacgggtaagcgaagagacctgggagtcagtcagatgcagcttcaaatcctgacctggcatcaagtgtcctttcctgaccccaaatcagctcagacccattgaaacccatacttggacccctaaatttcccaatagctaggctggccttgaggagggggccttgtgcctgtctgatttcccttccccagctgacccccgccccatagatctcctcatcagaatgtggctttctctgtctcagcctaagggtctcacccagacgacccagacgtcaaagggagctcctcagggaggcctctctgaccacccactccaaagtggatccctgttcccaactcagttgctgtcacttccccctgcttgttttccatgtaccatttttaattatcctgtttaccgttctagtgtgtttccttctagatccccagctctgggtaagcagggcccagatttctgtctaaaatgttccagtattttcacaacctggtccacaggtcagagaggtgaagtgatgtgcccaaggtgtcacagccaagaacggtgggaccaggactatagctgaggtctgtttgaccctggagcccctccaatggtgtcctgtgctttgggagattacaggaaagagctcttgctggtgaaggggacaggaggtgacaagtgacacatttaacacatgtagcccctctaaccatgctcctgggacatttgctatctggtgggtaaggtgaatggagaaaacattgcagaggagtggactaggggctgtggaggagagggccagacactggagcctcagagggaagtgggtttgggtgacctgagcgtccggggtgagtccttcaggcagcggtggccacacaggtgtttatcacagccttgctctgtgccactggtgctcttgagctaactgtgactgtgatagccctggtcctgcctcttgaaggctgatggctgaggggacagctgggaggaggggtgaatgagaacaggactggggagctagcagggtgcgtgaagggtgagcagaacatccccttccaaacctggcattcagagagtctctgattgtgaccttctgtgtctgagtgaagagtcctcctctgggaagccgtgcctggctcccttgcctgccccccttcccttctgtcattctgcttctgcggtccttcctgagtgaccagacaagtggcttcacctctctgagcctccctttgctcagcagccggatggagctggtcatagttttggcctcaggattagtgtgctgtgtgctgtcacagacatgtcttgtggccgtggcttatggtagcagctgatagtctggttgtgtttttctgtgtctgtcccacctgctggaccaggggcccttggagggcagggttggccacagagggggcctcaggaatggtttgcccagggaaggctctttcagctaagccccagccttgaagaatctggcacctgccataagactccttctgttgttgtccccaatagccacctccttgcatcctggctccagccccagggaacagtggacagtcatcagaatcagactgtgcctctaatcttctgtttctgcacctgctgcttctctcacttcctcctttgtgccaccaacttgctatgttttaggtctcagcttcaatgcccccttctccaggaagttgccccgaaccctagactggaccaggtgcctctcagggctcctgcattcctgccccgttctggacagtcactgtctagagatgaatctttctcccccaccgggctgttaaaccccaggaggacagcaaaagactctctaggtcaccactgtccctaggtcacagaggtgctctgcgagtgttttcctcctaaaagaagaggaccgcaccttcccaggtgttttcactgattcattctccagttattgataagcacccactctttgcccagcctgtgcctggccttcatgcatgatggtgtctaagacagcccccgtgtccattctccctccttaccctggcctctgtcccccacaggtgaccagcaatggcagcatcgggagggacccgccagcggagacccagcctcagaacccaccggcccagccggcacccaatgcctggcaggtcatcaaaggtgtgctgtttaggtgagcagacgggacttgggtttgttcaccgaaaacattcaaataaaaataaggaagaaaggaaaagtcagctgatcagctgaggatggtgatcattactgtatggtagagttgctttttttctttttttttttgtatgatggaatgttttctaaaccttttttttactctggtaaaacatactgaagtagggagtctccctgaacctgttctggtttttggggggctacctgatttgtgaaaaaataaaaacacaaaaaatactgaagtagtttgctagggcccttgtatcaagtaatatagacggagtagcttaaacaactgaaataggaaattcattgtcttacagttctgaaggctggaagtccaggatccagctgtgggcaggggcagtttcttctgtggcttctctcctgggcttgcagaaggccgtcttctccctgtgtcttcatgtggtctttcctctgtgtgtgtctgtgtcctaagctcctcttatggggacactagtcatactggcttagtacccaccataatgacctcactgaaccttacttttttacagaccctatctgggccaggcacaatgactcaccctcataatcccagcattttgggaggccaggttggaaggactgcttgagcccaggagtttgagaccagcctgggcaacatagtaagaccctgtctctactaaaaataaaaaaatctggctgggcacggtggcttacacctacaatcccagcactttgggaggccgaggcgggtggatcacgaggtcaagagatcgagaccatcctggccaacatagtgataccccatctctactaaaaataaaaaaattccggaggctgagacaggagaatggcgtgaacccgggaggcggagcttgcagagagctgagatcgcgctactgcactccagcctgggcaacagagaaagactccgtctcaaaaaaaataaaaaatacaaaaaaaatacaaaaattagctgggtgtggtggcacgtgcctgtagtcccagctactcaggaggctgagggcaggagaatcgtttgaacccaggaggcagaggttgcggtgagctgagatcgtgccactgcattccagcctggggacagagtgagactccatctcaaaaaaaaaaaaaaaaaaaaagccaggtatggtgacacgtacctgtagtctcagctattcaagaggctgaggtaggaggatcacttgagccttggaaatttttttatttttattttatgtatttttttttttttttgagacggagtctcgctctgtcgcccaggctggagtgcagtggcacaatcttggctcactgcaagctccgcctcccgggttcacgccattctcctgcctcagcctcccgagtagctgggactacaggcacccgccaccacacctggctaattttttgtattttcagtagagatggggtttcaccgtgttagccaggatggtctctatctcctgacctcatgatccgcctgccttggcctcccaaagtgctgcgattacaggtgtgagccaccgcacccagcctatttttatttttgtaatggagtctcgctctgtttcccaggctggagtacagtggcgcgatctcagctcactgcaacctccacctcctgggttcaagcgattctcctgcctcagcctcctgagcagctggaattaaggtatgtgccaccatgcccagctaattttgtatttttagtagagatggggtttctccatgttggtcaggctggtctcgaactcccaacctcaggcaatctgcccgccttggcctcccaaagtgttgggattacaggcgtgagccactgcacccagtgcctagctaatttttgcttttttttttttttattagagatggggtttcactatgttgaccaggctggtctcgaactcctgacctcatgatccacccgcctcagcctcccaaagtgctgggattacaggcgtgagccactgggccctgcctgaccctcagaagttgaagctgcagtgagccgagatcacaccactgtactccagtctgggcatcagagtgagaccttatcgcaaaaaaaagttggggggaccctgtctctaaatctagtcacggtggtactgaaggttgagactttaacatatgaattttgggagacatgattcagcccacatctgcacataacatcaaatttaccattttaacctatgttttcattttaaccttttttttttttttttttttttttttttttgagacagcgtctcactttgtcacccaggctggagtgcagtagtgcaatctcggctcactgcagtctctgcctcctgggttcaagcgattctcctgcctcagccacctgagtagctgggactacaggcacctgccaccacgcctggctaatttttgtatttttagtggagatggggttttgccgtgttggccaggctggtctctaactcctgacctcaggtgatccacccgcctcagcctcctaaagtcctgggattataggcgtgagccaccacgcttggcccattttaaccatttttaagtatgtagtcctgtggcattaagtacatctccactgttgtgcccccatcaccattatccatcccgagaatttactcttcccaaactgaaattccatacccatcagacacaagcttcccatttcttcctccttgcaacacctggcagccacttttctatttcctgtctctctttcactactctagttagctcctgtatgtggaatcagacagcatttgtccttctgtgactgcctggtggtgacccttttacctgtgggttcacatgctattcctgggcagtgggaccccagggcctgttttttcaaagcccagcttctgtttgaggccctggggagatgctgggtggtggcgggggaatatgcttggcactgggttctatccttcctgcctagacctagtgacagtcaccttctttgctctgagcctttgtttactcctctgcaaaatagatattccttttattttttttttgctttttggagatgtattttagcaaaataagagaccacaccatgcagttaggcaatcagcttccctacttatgagatagaaggaattgcacagcagagatgtttacaacaatcatcccgccaggtgcggtggctcacgcctgcaatcccagcactttgggagaccgaggcaggcagatcatgaggtcaagagatcgagaccatcctggccaatatggtgaaaccccatctctactaaaaatacaaaaattagctgggtgtggtggcacaagcctgtagtcccagctactcgggaggctgaggcaggagaatcacttgaacctgggaggtagaggttgcagtgagccaagatcgtgccactgcactcaagcctggcgacagagcaagactgagtctcaaaaaaaaaagagaaaataaaaataaaacaatcatggctgggcgcggtggctcacgcctgtaatcccagcactttgggaggccaaggcaagcagatcacgaggtcaggagatcgagaccatcctggctaacacagtgaaacgccgtctctactgaaaatacaaaaaaattagccaggtgtggtggcgggcgcctgtagtcccagctactcaggaggctgaggcaagagaatggtgtgaacccaggaggcggagcttacagtgagcccaggtggtgccactgcactccagcctaggcgacagcgagactccgtctcaaaaaataaaacaaaaataaaaaaataaaacaatcattcctttggctagaatgtcttcacatggccatggccagctgcacgggaggctgggaaatgtggtctttaatctgggaaactgagcaccctgctggaaagcagggctcctattactgaggaagaagaggagagtggttatggggggcagctacttatctcttccataaaatcttattactggtttcccttagcttataaattatgagtgtttattttacaaaattaagtagttcaaacaatacgaagagtgaaaagaaaaagctaatgaaaaagtgtaatgtgggccgggcgcggtggctcacgcctgtaatcccagcactttgggaggccgaggtgggtggatcacgaggttaggagatcgagaccatcctggctaacacagtgaaactgcatctctactaaaaatataaaaaattagccgggcatggtggcaggcgcctatagtcccagctactcgggaggctgaggcaggagaatggcgtgaacctaggaggcggagcttgcagtgtgccaagatgccgccactgcactccagcctgggtgacagagcgagacacagtctcaaaaataaaaaagtgtaatgtgttggtggccatcccataggcacacatttttgtaattggccctaaatgggattatatatagatgctcacagatagagttgtttaaaatagagaaaagttaggaggcggggggcaggtagtgtcagatagcgtgtaagagcacagccctgctgacatctcagccctgccacctctgagctctgtggcctggtcaggttatcacccttcttgagcctcattttccacctcacagacaggaatcttgacaattagctcagggtgcatcagaaggattccaagagaattcatgtcaactgaggggtgcaggagctggcacgcacacagacaatgttggccatgattccttttgttgttcaacgtggaaaaaaaaaaagcctgagcaacacagtaagacccccatctctctctctctctctcttttttttgggagacagaatctcgctccgtcgcccaggctggagtgcagtggcgcgatctcggctcactgcaagctccgcctcctaggttcacgccattctcctgcctcagcctcccgagtagctgggactacaggcgcccgccacagcgcccggctaattttttgtatttttagtagagacagggtttcatcgtgttagccaggatagtctcgatctcctgacctcgctatccacgcacctcgggctcccaaagtgctgggattacaggcgtgagccaccgcgcctatcctgaccccatctctgtaaaaaactaaaaaattagctgggtgtgatggcgcacacctgtagtgccagctattagggaggccgaagagggaggatcgcttgagcccaggaggtcaaggctgcaatgggccgtgatgatactactgcactccagcctaggcaacagagtgagactgtatctcaaacaaacaaaaaccttaggaaatatatagtgaaacagtgaaaaaaaaaagttcatgaggccgggtgcagtggctcacgcctgtaatcccagcactttgggagaccaaggtaggtgaatcacctgaggtcgggagttccagaccagcctgaccaacatggagaaacccatctctgcaaaaaatacaaaattagccgggcatggcggcttatgcctgtaatcccagctattcaggaggctgaggcaggagaatcgcttgaacccgggaggcggaggttgcagtgagccgagatcatgccattttactccagcctgggcaacaagagtgaaactctgtctcaaaaaaaaaaaaaaacaactcatgatccctgatgtagtcactgatcacattctagactagagcagaactgcctgcctggtgtcctccaagagtgtcacacaggacactgagaaactgcaggaaagaaacctccccactctgttaagttgcaaaactgacatgtgtgcctcaaaaattcctgccatgtgccctacgcttctcagtcatgcgcccctgtcccttaccgtctccacttcacctcccctccccatggccacgtaaagacttcagattttcttatatatcaccttcttttttttcatgctgcaagcagctctgcatgaaaattatttttatctttcccttcatttttacataagaggtagcctgttttacacactgttctgctccttgatttttttcattaacaatatatctttgaaatctttccacgtcagtgcatagggagcttccttcagagagacatttttaatacaagtcacactgtaggctaatttcctttcttagaactaggcagcatcaaacatcagttcgggtgggtgctcggagaccatcttggctgcagttcttaaaatgggatccagggtttgttttcaggggcccatgaactccttgtagcttgaagctgattatgtgggaatagcctttctagatagcgggtggcgtctgtgtttttgagcacatgtggttacctggagtgggaggtggagcaggaactgggtatataaaggaatggggtgggagggagagttttgattatacgtcttttcatatatttaaaaatgttctgaacctgtgactgtagaatacctatttgggtgggagaaaggatttaatgtctgttttctttgcttactcaagtacatcaggaagcattagaaaggtccagtctcctgcaggcctgggtgcatggatgaggggccatggccatgagccctctgagagggtccacagaactgtgggcgtgtggatacacacagacgttcttcaggggactggggatctggaatccaaaaaggcctggccttgttttatacatggggatctagaagcccagaggggttaggacccccacagccacacactaagccaggggcagagctgcctgggggcatcactgcttctacactctcccctggtgtgtttactaaaatgagagcctctgctggaggcatcggtatccccagagattgccaggtccagaccttccccagacgtgcatatcagggacttcatggggaggtagcgatggctcagctggaccgtggcccctaagaccctggaccccagggccttgtggcttctacaggcagaggcaagttcctgtgcctgatcctgcccctgatcagggctcagcagggaggcaccccacccacactagaatttactcatagtgtttttctgctccaaagttttttgtatgcctttttcctatgattaaaataacagtaatagctaacacttctcagtcacttactgggtatgcaccaggctccattctgaggtacgtgtgcgtgtgtcagatgtatatacacgctatataaacatatatataatttaatgtgtttaatgcttataaactaccctatgagagtaggcactgttattatccccatttcaaccattgaagttgaccactgaggtcacagtaagtagcagagctgggcttcagatgaagatactgtagtttagaggctgggctcataacctcttctgctgtatggttatcatacctataattaataagtacttgaatcatttaatcacatggctgcatgcagctgagaaacctccattaacacagtacaggttcatttctctctgatataccagtctggatggaggcagactaggattctgcagtcttcagtgacccagactccttgctgtttgttgtgccattgctaggtttttccctttatcctcatagcccaagacagctgctgaagattcagccatcacatccacactccaggcaacaggagagaagaataaatcaagaaggaatatttcttctctttaaggacacttttttttttttttttttgagatggagtcttactctgtcacccagactggagtccagtggcatgatctcggctcactgcgacctccacctcccaggttcaagcgattcttttgcctccgcctcccaagtagctgggattacaggcgcccgccaccacgcccggctaatttttgtatttttagtagagatggggtttcaccatgttggccaggttggtctcgaactcctgacctcaagtgttggcttcccaaagtgctgggattataggtgtaagccaccacgcccagcctcgttttggttttggtatctgttgttgctgctgattctcgctcataatgtcgtttccttttgtgcctggcttatctctgtctgtgtcctagtcattatacttgaaaagttatttgtaggaatttcagggctaggatgagcatattttcctacagagaggattgcctttgcttctgcctgggggcattaccaagtcctaggtttccttgcaccaggttcagggcttgagctgcccttcgtgactccttatcccacgagtggccttgcatacttcgccctgcatacctgttgtgcaactcctgggaatgggtaggccacctggttccttccttctcaggggtggaggcttgcaccttgtggggtcttagtttcctatagggtaggtctctggttacctcatatgttgtatgtgccctgggctagcatttttttttttttttttgagacagggtctcactctgttgcccaggctggagtgcagtggcatgatcgtggttcactgcagcctcgacctcctgggctcaggtgattctcccacctcagcctcctgagtagctgggaatataggcatggtgcgtgctgccatgcctggctaatttttgtattttttgtagaaactgtgtgttgcccaggctggtctcaaactcctgggctcaagcaatccacctacctcagcctcccagcgtgctggggttacaggtgtgagccaccgcgcccagcctaggccagcatttttgtcacccaccaaaacacctagcagatgtcctcggacacatgaagaagcttatagggctcctttacttattctttttttttttttcccctagacctgcaaatccaagatcctttacttctttttttttttttccttgagatggactttttgctcttgttgcccaggctggagtgccatggcacgatctcggttcactgcaacctccttctcctgggttcaagcgattctcctgccccagcttcccgaatagctgggattacaggcatgcaccaccactcctggctaatttttgtatttttagtagagatggggtttcaccatgttggccaggctggtcttgaactcctgacctcaggtgatccacccacctcggcctcccaaagtgctgggattacaggcttgagccaccgcgcccggccgatcctttactactttaggattcccactttcccttcagtttttgcctgaaggtttggtaacctacagtcgtgtccattcttcagagctgtctatttatatatattcatatgtaaacttgataaaaattacatgcatgagaacaaatacgagaatacgtgagcagcatatattctcattctatcaatatgtataattacaaatataaaatatattgatattttcttagtgtattaattttatcaagcttttccaattttttccagtgagagggttggtctgaataattaagcccactgttactaaaattggaactaacgtatcacttactatctgcttctccaaaaattctccaaaagttcagaaatgttgctctttctaagcttctgtgccttcggttcttttccttttcttttttaaaaaatttaattaattaattgattaatttttttgggacaagctctctatctcccaggctggagtgcagtggcgcaatcacgtctcactgcagccttgaccgtcagggctcaagtgactctctcacctcagtcccccaagtagctgggactacaggcatgggccaccatgcccagctaatttttatattttttgtagagacgggatttcatcatgttgcccaggctggtctcaaacttttgagctcaagcaatccgcctgcctcagcttcccaaagtgctgggattacaagcgtgagctgctacacctgacccaattatactttttttttttttttttttttttgagatggagtctcactctgttgcaaggctggagggcagtggcgcaatctcggctcactgcaacctacgcctcccgggttcaagtgattctcctgcctcagcctcccaagtagatgggactagaggcacgcaccaccaggcccagttaatttttgtatttttagtagagacagggtttcaccatgttggccacgatgatctcgatttcttgacctcgtgatttgcccacttcagcctcccaaagttacaggcatgagccactgtgcctggcctctatacttcttaagttattttaaaatgtgtaattaaattactattgactagagttgccgtgttttgctaccaaatactagatctcattcattctttttttttttgagatggagtctcgctctgttgcccaggctggagtgcagtggcgcgatcttggctcactgcaacctctgcctcctgggttcacaccattctcctgcctcagcctccggagtagctgggactacaggcgcccgccaccatgcccagctaatttttttgtattttttagtagagacagggtttcaccatgttagccaggatggtctcaatctcctgacctcgtgatccgcccgccttggcctcccaaagtgctgggattacaggcatgagccgccgcgcccgtcctcgttcattctattttttgtagccattaaccatccccggttctgtgcttttgaagcgctaggattccagattctttcttttaaaaattttatgtttattattttttctttatttcttttttcttttaattcatccatctgcacactgaaggggttccagattcttagtctcctctcgggggatcccagggggctggatggcaggtttcccagtctgagtcaagagtcagcccctgcagccctgtggtcaccaggagctcctgcaggatttagagtcaagggtctgcatgcagaccagggcagtgccagctacccccacacactggcaaacggtggcatctgggctccctccccagatgtggtctttagggacatcttatctccttgccagccctgtgactaccttctcagggcctccctgacttggtcactagccccaggtcaggcgccagcatgtgctaagtcagaaggaagtcaggcgggtctatggcggagagccaaggcttggggactcaccaccttgctgcttctctcctcaggatcttcatcatctgggccatcagcagttggttccgccgagggccggcccctcaggaccaggcgggccccggaggagccccacgcgtcgccagccgcaacctgttccccaaagacactttaatggtaactgccgggtggtagggcagacttgggaggtgatggggtgtggaggggtggaatgtggaggagtgatgtcagcagtcgggacagaccaggtccttgctcactggcaggtctaggaaaacaggtccagggttgaggaactctgggcccatccccaacacgtgagacctctgtcacctgggtccatccccagcacataaaacctgtgtcacccaaaagaaaaagcaaattcatttggttaaaataggttaaatcagggtctttggatgttatatttcaaaagtatgttcagcctttcagggttgcagagggagatgtgcaagggagagagtgtgagaggtggggagggcagggagccagcagaggctgacaggaggtgggcccggaaggagaggagacctgcacttccacagtgggcttgggcacaggcagggcagggcttcaggagcctccagagcaaaagcatttagatctgtcagtctaggcttttctgagcaaacatggccattggggcttgagaaaggaggaagttcttgttgggtcacagtgggttttttttttttttttttttgagatggagtctcactctgtcgcccaggctagagtgcagtggcataatcttagctcactgcaacctctgcctcccgggctccagtgatcctcctgcctcagcctcacgactagctgggattacaggcatgtgccaccacgtccagctaattttttgtatttttagtagagatggggttttacctttttggctacgctggtctcgaactcctgacctcaagtggtctacccgccttggcctcccaacgtgctgggatcacaggcatgagccaccgtgcccggtggctcacagtgcttttgtagctctggactgcttcgtccataagcctgcagagctctgaccaggaaggcccagcagccatgagggcaggagatcattcagggagctcctgccccttcctacccctaaattctaattggcaggctggccagtctccaagtgttctttgttcgttgacttcacaggctcagaccaggacaaacatggtggtatgagaaaagagaaaatatgtcctctctgctgctcttcctctctcctctcccctgtcctccataattactgttcccctgagtgtgctgaccgctgccatagctctttagccagcctgcagaggctctgaagagcaggcctgagctctgttcccttcctgtcccaacagaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacaggtgggggcagctctcggtttctggccccatggctgcttgactggcactgaaggacctttcctccagtccgctccttgctgagagcatgtggagttcgggctccaggcttggcccttccctgggctcacatggtctgtgaccacaagccagtccctgagatctctgggcttcactttcccctacctgaaaaaggtagataggggtggaattggcctgggaccctcccagctacctctaaggttgtgcagtcctccactttaaactggtgaaagattagtaattgtccttggggatgtttgcctatcaccagtttatcaggcagccccgtttcaaaataatattagttaatgttgattgagctaagtgcagggtactaagctaggctgactcatggaaatttcccggcaaccctgtgaagcaggaactgttattattctcatttaacatgtgaggaaactgagacagagagaaggaaagtgatttacccaaggccacatcgcatgagagattcagactcaggctctacggctgtggactctcgcagccctaggctcaaatccaacctcctccaggaagccctccctgactcacagagcactcaggcttggttaagcaccctctctgggttctcacacctgctgggcttccccatcccagcccattctggggcctcattgggactcctgtatgggactgtgagccttgtgataataaggctggggctgcctagatcacttccatgtccccagcactgcccaacgtggggctgggtgcagaatcagcaagtattgaacaagtaaaagggacatctctctttggggccttcttcggctgagtccaagacagctgccctcattcctttctccccagcaggccttctcagctttggggtggagggcacatttctgttctatttctgtctgggtagctagaagcagaatgtggacacagtcattctggtttttttttttgttttttgtttttttttgagacagcgtctcgctctgtcacccagtctggagggcagtggcgcaaccttggctcactgcaacttcacctcccaggttcaagcgattctcatgtgccagcctcctgagtagctgggactaaggcacacatgatcacacccagctaatttttttattttttagtagagacaaggtttcactatgttggccaggttggccttgaactcctgacctcaagtgatccacctaccttggtctcccaaagtgctgggattacaggcgtgagacaccgcgtccagccatcattcttttctttttgagatggggtcttgctctgttgcctaggctgaagtgcagtggtgcaattacagctcactgcagcctcaacctcctgggctcaagcaatcttttcacctcagcctcccaagtagctgggacaacaggcatgcaccaccatgcccagctaattttttgtagagatggggtctcaacatgtttcccaggctggtctcaaactcctctgctcaagcgatcctctcacctcagcctctcaaagtgctggaattacaggcatgaaccaccccacctggctggactttctgacctgcactgagaggtgactcccacagagacctcaagcccagcccccaggccttgccacgagatccaaggaaggaccagggcctggcaggcccagcagggggatctgcttccaagggcttggatctaagtcgaagcttcagggtggggtccaagtggacttaaaaggcaggagagctgggcacagtggcatgtgcctgtaggcacagctactcaggaggctgaggtgggagaatggccagagcccaggagtttaagactgtagtgtgccatgatcgcaactgcaaatagccagtgcactccagcctgggcaacacaggaagaccccatctctaaaaaagatagggagagtgaggagaacacaatgtggccaactgaattcgagctctgcacaaggatcagagaggttcagtgctcgcctttgtctccacccagtgcccctggacaacttgcctcccttcttgaagcctcagtttcctcatctggatcaagtgagaatagtcccccttccctgggaggcaaggagacttgatgagataatgaggaagacttgggcagagaggggccagctggaggtagcagggagtagcacccaggagcccacagactgggtttccatctgcgtacttgccacacactatgtgaccccttggcatgagccccgtttgcctcatctgcaaaatggggtggtaacatgacccattgcataaggttgacatgttatatgtgtgttaactcgttagattaggaagctgttgtctgaagtgcccagggcagggtctggcccatagtaggagctccatgtcggtcagctgcttcttcctgttgagtgagcttaacgagagctcgttgactgagctgtgtgccagtgctccaggtagtccctgcagtggtgccctcgggtcagtgctgtgggaacttcgcatcctctaggtggggccctgaggctcagagagaagctgagctcacacggccatggcaggtagagcgggcgtctgagtctgtctgactccagcatttacctctctgccacccagctacatgccccaccctgagtactcagtaaatggccagagagttgagggggaggaaactgctgcagatgggtgccaggcagggctttaacgtttccctcaccccagttgcccagcctgcccacctgaccttccgtcttttgcagagcgtccagcagaacggctccatctacatccacgtttacttcaccaagagtggcttccacccagacccccggcagaaggccctgtaccgccggcttgccacagtccacatgtcccggagtaagtcgctcccctgcagccaggacccactgtccaggaggccagcatcctgggagcccccaggctaatgtggcggacaaatcccaagtccaggagggcaggcaggaagcctgtgctcaaagagggtgggattggcagggcaggctcaagccccacccagcctgaaagagccctgtggacactaagcagggatacccacggaggaagggagacccacggaggctcagggaccagagagaaattggccagaaaaagcagctggagacagggactcttggagaggaggagacgtccttcaccaagggggaagggccagggttgacttttgcacagtaggggcctgatagaagtagacactcaaaaataatttgtgggctgggtgcagtggttcatgcctgtaatcctagcactttgggagacaaggtgggcagattgcttgagcccaggagtttgagaccagcctgggaaacatgacaaaaccctgtctctaccaaaaaagacacaaaaactagctgggcgtgtgcctgtagtcccagctgctcaggaggctgaggtgggaggatcgcttgagcccaggaggtggaggttgcagtgagccagaatcacaccactgcactccagcctgggtgacagaccgagaacctgtctcaaaaagatagatagaggccgggcacagtggctcacgcctgtaatcccaggactttgggaggccgaggcgggtgaatcacaaggtcaagagatagagaccatcctggccaacacggtgaaaccccgtctctactaaaaatacaaaaattagctgggtgtagtagcatgctcctgtagtcccagctacttgggaggctgaggcaggagaatcgcttgaatccaggaggcggaggttgcattgagctgagatcacgccattgcactccagcctggtgacacagcaagactccgtctccgtctcaaaaaaaaaaaaaaatagataaaattcaaagaacagtgtgggcaacataatgagacttcgttgctacaaaaattaatagccaggtatggtggtgagcacctgtggttccagctacatgggaggctgaggtgggaggatcgcttgaacctgggaggtcaaggatgcagtgagctgtgattgcactacagctttccagcctgggcgacagagcaagtccacgtctctgaaaaaacaatagtaataaaaaataagactaccacttctactcccatgataactcattaatccattaaaccactaatccatgaatgggttaatcagttcctgaggggagggtcctcatgacccagtcacctcttaaaagcctcatctctcagtactggcacattggggattaagtttcactgggagtggggagtactagagtacatcagtagtcccagctacttgggaggctgaggtgggagaatcagcatgagttttggccaggacaaacattcaaaccatagcattgtccgtcctcttgttttcgagaggttaataattgttgtcatctttctgcttgcctggctctttttttttttttttttgagacagggtctcactatgtcgcccaggctggagtgcagtggactatctcagctcaccacaatttccacctcccaagttcaagcgattctcccaccttagcctccaaaatagctgggactacaggcacacgccactacgcccggctagtttttgtatttttagtagagacggggtttcgccatgttggccaggctggtctcaaactcctgacctcaagtgatcgtctgcctcggcctcccaaagtgctgggattacaggtgtgagctgccacacccagccttgcttggttctctgtgagctttttccctgagtcctctgtctcctgatgggcagccgtagaaatctcttgctgtacctgtttgagcggagctggagaatggcttcctcagaaagccccccattcttctaacgggagttctgtgtactccacctagctttcactttattgaggactattccagacattccctgtggatttggttaagatccatctggctggttttgggtggcgcagcaacagacagaattctatttgtatgagttaggtcttacctacttcttttagtacaaaaatatcctaaaggatggtaatttttttttatcacctatactggatgaaatgaaaagttgactctatgtgggtccctagaaatgacttggaaaggtcttctggagttacttgagcccctttctgagtgagtgtgtctgcagaatgtgctgcgttggtatgtcccacccggctgacgtccatgtggtgagatctttggagaaccaggcagaagtggcttgagggggtgtgacctacagggttggtctcacagatgtttccctgcagggggatacgtcaggggtctgggctaaaatgcccgatgtttcagaggtcgctctgaaggtgacccaggtgggtggctcttcaccctattcttgtaccccgtttgacgatcacctaatcatcccgttgacccaaatcgatgccagtattttctgcagttttgtctttggtgagtgtgatccatgtcactgtgtggtgaggtttattcacagtcagtctggtctgtaaaatagaacctgcagacagtgaacctgaaaagcatactaggatcatccaggcctccctccccagccttggagctgggaccctcaaagcagggacatagaaggacttggagtgagccacccacaaactccagggtgaaggagagtgtgagttcagaaaagcccccttttggctggttgtggtggctcatgcctggaaacccagcactttgggaagccaaggcaagcagatcacttgaggtcaggacttcgagaccagcctggccaacatggtgaaaccctgtctctactaaaaatacaaaacttagctgggcatggtggcacatgcctgtaatcccagttactcgggaagctgaggtgggagaatcttttggaccccggaggcggagattgcagtgagccgagatcgtgccactgtactctagcctgggcgacagagcaagactccatctcaaaaaaaaaaaaaaaaaagaaaagaaaagccccttttatccccaagaggccaataatcagtattctagagcagctccgtcccatggagataggatgtgagccagagaaggcattaaaatttttccaatagaaaaatactaaagagtaaaaaggtaaagagaggccaggcacggtggctcatgcctgtagtcccagcactttgggaggccaaagtcagaggatcgcttgagcccaggagtttgaggccagccctggcaacatagggagacctcatctctacaaaaaaaaattttattttattttatttattttatttcattttatttatttattattatttttttttgagatggagtcttgctctgttgcccaggctggagtgcagtggtgcagtctcggctcactgcaagctctgcctcccgggttcacgccattctcctgcctcagcctcctgagtagctgggactacaggcgcccgccaccacgcccggctaatggtttttttgtatttttagtagagaccaggtttcaccgtgttagccaggatggtcttgatctcctgacctcgtgatccacccgccttggcctcccaaagcactgggattacaggcatgagccagcgcgcctggcctattttattttatttttttttgagacagagtttcactcttgttgcccaggctggagtacagtggcatgatcttggctcgccacagcctccacctcccaggttcaagcaattctgcctcagcctcccaagtagctgggattacagtcatgtgtcaccacgcccagctaattttgtatttatagtagagatagggtttctccatgttggtcaggctggtctcgaactcccgacctcaggggacccacctgccttggcctcccaaagtgttgggattacaggcgtgagccaaaaaatttttttaaattagccagatatggtggtgcgcaacctgtagtgtcctccgactcaggaggctcaggtagaaggatcatttgagtccaggaggtcaaggctgcagtgaactgtgatcaggccactgcacttcagcctgagcaacaaagcgagaccctgtctcaaaaagaaatataaataaaataataaaaaggtaaggccagggccgtgatggctcacacctgtaatcccagcactttgggaggccaaggctagaggattgcttgagcctaggagttcgagaccagcctgggcaacatggcaaaaccccccctaataaaaatacaaaaattagccaggcatggtggcacatgcctgtaatcccagctactcgggagcctgaggtaggaggatcacccaagcccaggaggttgaggctgcagtgatcacaccactgcactctagcctggataacaaaaggagaccctgtctcacaaataaataaataaaaaggtaaagaaaaaccatgagattaatatcaataatagtttaattgagctcaacatattctcgtttcaacatatgatcagtataaaaagtgagatattttacatttttgtttccccttgtgtcagttttcagaatctagtgtgtgtgactgggcacggtggctcacatctgtaatcccagcactttgggaggttgaggcaggtggatcacttgaggccaggagtttgagaccagcctggccaacataatgaaaccccagctatactaaaaatacaaaaattaggcgggcatggtggctaacgcttgtaattccgtctactcgggaggctgaggcaggagaatcacttgaacccagaaggcagaggttgcagtgagctgaaatcgtgccactgcactctagtctgggcgacagagcgagactatgtcaaaaaaaaaaaaaagggtctagcgtgtgttttatatcatagcacttcttggtttggaccagccatatttgcagtgcccagtagctgcatgtggccagcaaccctgatactggatggtgcagctctagaagattttcctccaagaaaggggggctttttcctccccacaggagccaggtccatctggtctggatgcctccaagctgcagaatgtgttctttgcctgagccaaagcctctctcccctgtgcctccccctccaccagccagcgctgccctctggggctctcccttccctggacagtctctgtcaggtgtggacacgattggggcatgtccccctggaattttctccaagtcaacccttgagtgttggtttctccccctggacacaggaggaagatccccaatgatttaataatcatagaaatgatgaggattggccaggtggctcaagcctgtagtcccagcaatttgagaggccgaggcaggtggatcacttgaggttagaatttgagaccagcctggccaacatggttaaactccgtctctactaaaaatacaaaaattgctggtcatggtggtggatgcctgtaatcccggctactcgggaggctgaggcaggagaattgcttgaacctaggaggcagaggttacagtgagctgaagtcatgccactgctctctagcctgggcaacagagtgagactccatctcaaaaaaaaaaaaaaaatgaggatgacgtttctgctaataagcagtaggccctgggccaagaagtggtgaggcttttcttccttctttagggaagtgacatcactcaccagcatcccttagcttgtaggattcagagccaagattgcccccagagcccccgctgttggccaggtctctttcccctttccctgtctctccctggccccaggggacaggatagagacttgagggagggcagactgagttttccttcatagcataaggaagagctgaaaagtccccgggctcagtggctcacgcctgtcatcccagcactttgggagactgaggtgggcagatcacgaggccaggagattgagaccagcctgggcaacatggtgacaccctgtctctactaaaaatacaaaattagccgggcgtggtggtacacgcctgtagtcccagctacccaggaggctgaggtgggagaatagctggaacctgggagtcggaggttgcagtgagccaagatcacaccactgcactgcagcttggatgacagagcgagactctgtctcaaaaaaaaaaaaaaaaaaaaaaaaaaagaaaagaaaaaagaaaaatacttagcttcttttcgggccaggtgcggcagctcacacctgtaatcccagcactttgggaggccaaggtgggcagatcacgagatcaggagattgagacaatcctggctaacacagtgaaaccctgtctttactaaaaatacaaaaaattagcagagcctggtggcacacgcctgtaatcccagctacttgagaggctgaggcaggagaattgcttgaacccaggaggcggaggttgcagtgagccgagattgtgccactgcactccagcctgggtgacagagcgagactctgtctccagaaaaaaaacagaaacgtccccaggccagggcagaggttgggagatggagcgtgggcacgcacaagccccttcctccccggcagcatttgggacaacatggcagggggcctgtggccaactgggcctctgcgagaggaagtgaggccaactcctggctggggattcacagcctcaaagtgtttctcatcttggtttctcatgttggtggcttcaggccttttttggaaccgtctgctgcctctttatagtcatgtattcaactggtcatcaccgagcctgtgcaggcgccccatgtgtattcaaacaggccctgcccctacccgcatttccgcacagagtttgcagactggttgcagggacagacagcaggcaggtaaaccactggctaagtggttttggatagtggtgaaatgttgtgaaggaaacaagctggcaggagaatgactgcataggctcattcagtggggtggccagggaagccctgtggaagaaggacattctgccagggacttgaatgccacggaggagccaggccacgaagattgtgtcagggcatgggttcctgggacacggggcagcacgcctgaaggccccgggttggcatgtttgagaagtggaaggtggtgagggttgagaggtcaccggggctacggtgagtgtctggggttccaaagctgcgggatgccatgatcagtcacttgtttttatttatttgtttgtttgttttctttttctttttgaaacggagtttcgctcttgttgcccaggctggagtgcaacagtgcgatctcagcttcctgtaacctccacctccctagttcaagcgattctcctgcctcagccttccgagtagctgggattacaggcacccgccaccacatccggctgatttttgtatttttattagagacggggggtttcaccatgctggccaggctggtctctaactcctgacctcaggggatctgcccgccccagcctcccaaagtgctgggattacagtgccctactgagctggggtttctgcctggggcatttggtgatggtggcgtccccatgatcatgaggaactgggattcgttgagatttggggaggcagttctggcattccaggtcacattgatctcagcaggtgagtgcaaggtggatgccaggagaccgtgagccgttgctggtgggcaggggtccgggctctggaggctgcaggtgccggcaggtctcacgtcccctcctttcccacctcccaaccacagtgatcaacaaatacaagcgcagacgatttcagaaaaccaagaacctgctgacaggagagacagaagcggacccagaaatgatcaaggtaaacgggcagggttgtcagggcctatagggaccaagccaggccattcacagctcatcccagaccactggggctgtcatctgtcaccaccactgaaccaccatgccggctcggtcatgccacctcccctccctgagcactgggctcctcctctgggaaatggggtcaggaggcagctgtctctcagggagtgaggaggatcccagacaaggttacctgagcctcttgccagcctgggaggggtctacatcacagtcccattgtcacatgaggacacttgctcagtctcagccggaagtggcaggccagggactctcacccacacagccaggccccagagcccaagctcagcctggctccaagcacacacacgagaatatggctttagtaggaactgcaggattcatagttgctgtcactcccggtgggctggggagccgggcagttaatctgtggttaacctgcagtgggcactaagagacttcctctctctgcgggtggtcctgtgttgggggggtggtccctgctcatggagctgaggccaccgtgcaagagtgtgtggagcctgctgtcatgaggctgggcttcgcagcctggcctaggatgccagccctgcctctacctctacctcggttttctacatgtggggtgggaggatcctgtcggtggccggaagggtcctgggtggcggaatctctaagcctagggaggagagccttctgccagcagttgctgtggtggctgatattctgctgccagggttgtcaggggagatggctcatgcctgttttcccagcattttgggaggccgaagcagaaggatcacttgagcccggaagttcaagatcagcccaggcagcatagtgagaccccatctcttccaaaaaagagaaaaaagaaagaaagaaaagaagctgtccatggtggctcacgcctctaatcccagcactttgggaggccgaggtgggaggatcgtgcttgagcccaggaattcgagaccagcttgggcagcatagtgagaccccatctcagaaaaaaaagaaagcaaagattaagattttctcgggaaccctggggaggaagtgtacagagagtgatagtccccgagcacttccacctgcctctgaggtccttccccccatgttgcctcagagggctgaggactatgggcctgtggaggtgatctcccattggcaccccaacatcaccatcaacatcgtggacgaccacacgccgtgggtgaagggcagtgtgccccctcccctggatcaatgtaagctccccagccctgccagctgcctgcagagcctttgagagggtgctcggggtccatctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcgccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtgagtgcggccggtgtgggcgggacttcccggtgccttcctgggcgcaagaggccaagaggaagtgtgccaggcctgggctgtgggacctcccgcctggtgctcctctgcccacagtttcacaacctcccaggtcccttctccacagtgaaaggaagtgggcacccagccctccagccctagatgactgggggtcctctccccaggctgttctgttggaccctttgggtccagacctgtcccttcctccttctgtcccagaccttgtgtccctggccctggctccaactctgtgtctctgccatctcactgggtcctgaaatgtcagcctgtgtctgtggcgtgaggctcggctttgcctcctgggctgtcgtcactgttgggtctctgctcctggctcccagtgtcccttcacccactccccgcagcactcccttggcctctgcctcttcccctagtgccatctccccgtctcttctgtctttgtgagtcaccctcctctctctccccatctgcccatctctgacccagtctcctcctggctggcccaccttcagcctccctctacaggcggccccaggggcagccctcgggacaaaagctagtgaaggtgctcctgggtggggacaggctgtgctcacatgtgtcccctgcaggtggccctgctggagaccaacccctacctgctggcgctcaccatcatcgtgtctatcgttcacagtgtcttcgagttcctggccttcaagaatggtaggaacaggaccccagggctagtgagaggctgtgcagggtgggggacaggacctgcccccttcctcctcccctccctccccacatgtcctccccctgcctggggtctctcagccccactctccagaggcctagtgagctggggaggggcagtggccccaaaactcccaacccagaaattcccacccaccgggtgtggagctgagggaggggctggcccgctggtggggcagaggccaggccaatactgccaggaagcagggctggggaactccagagccaagagcagggaagccccggagctgctcccgccaccctgcccggcaggctgcctgctgcgggaggccgcttagggctgagtggacggggcctgcccaagtgggaaggaggagcactgtcccccaaaggtccctaggttctaaggctgaccatactgatggccagcgtttgaggagaagcagccacatgccaggcactgtcctgggtaccctccccagtagctccttgagccctatgggagccagaggctcagggatgtcacttgcccagtcacacggttcctaaggggcagatggttccagccccaactctcatcttctaggccctgcaggccacttcttccttgcccagagcaccccagtctgaaggagtggcctgcggccctgtagctcccgcaggcggcaagaggaatgagtagtagtattcctggtattaagatgctattgccggcctggtggtggctctcgcctgtaatcccagcactttgggaggccaaggtgggaggatcacctaagccccggagtttgagaccagcctgggcaacaaagcgagattcgtttctacacaattttttttaagaattagctgggcatggcagcgcgtgcctatggtctcagctactcgggaggcttgggcctgaaaggtcaaggctgccgtgagccatgatcacaccactgaactccatcctaggcaacagagtgacaccctgttccaaaaaaaaggacgctcttgccattattgagaactaccatctggaagaatgcagtgtcatacgggcacaggagctggtgccgaccccagccagccatctaccagctgtcgctgggagacgggacccttctgcctaggagctggcttggctggggtccagtgagaaatgaggcacaagaaggctgtcctccccagtgtcatgcagcagggggcgcaggcctcacttggcaccagtgctgtgtggcctccctggtctaaggagaggcttgggcccaactgctcccacgagaacccaccagaaccctgtctccagacccattcttctcagttgggacaggggtcattctgatgggcaggggtgggtggggtgaggctatggagtgtgccagagctctgggatgtgggggagctctgggatgtgggggagctctgggatggggtagggtgcacatggaccagaattcacagccctcactccctgagtgcagagctggccctgactctgcaggactgcagacctggctccaccactgtgctacagacgtggtggctcagcctcctgtggctgcggttagatgctcagccgggcggggtcaagagaggggtgtccgtggtgagaccagggctcagagaggagcatgctgacatggatccttggcagcatctaggcggagcactggaaggagctccagactggagcccagggcccttgtcagtttcctgagcatggctgtgagccagttccttcccggtgtcagggcaggggcctggaggaggtggtcttgaagtgcatgccacagatcttccttcccagggagggcgagctggcaccatggtgtggcacagaccccgcgtcccttcagattctgccatgccaggctgtttggcctcagggaagcagcttccctgaccagtccttagcacctggcacgtggtgagccctgtccatggcaccagtcaccgtcaccatcagtcaagggactgcaccttggggtgctgggtgctgacgtcctatgggagggctccaggggtgccgcctgtctggtgctctgggggtcacccaatgaatatgagagccttcctgggagagaggggtctcgttcagcacccctcctgaggacccagccccaccccagggtgtgaggatgcaggccaagggggcctgagggagctgcagtagggtctcagcacctcctcagcctcctggttcccccctaccccctgcgcacagatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccgggtaaggctggggcgccatgctgtctcgggagctgcaggggttgggagggggtagtgtggcccagctggaccctggagctggcccccgggggattcccagcaagtgcctcactcccaggactgaggggattttctcaccaggggattttttgggtcacacatggggcaggggaactgggaacggtggggaagggcaggggctggttctggcttgtggggtgggagccagcgtagcaactgaccatggcacccacctcatccacagctggaccgagagcacagggtggcaggaatcttcccccgcctatccttcaaggacaagtccacgtatatcgagtcctcgaccaaagtgtatgatgatgtgagtgtcctgcacagtgggcccctgggggtggtctccaggtacccacgtatccctgaggcacccggggccggccatctgtctgccggacccatgctttacagcctgtgccacatcctctgtgtcccccatctgccataactgcttcctgggcgagtccggagtccccagggctacctggaaattccccctgcccggcctgccagaccaggtgtggtgggtgagggcggggagcagggctgccaggcagggctgaggagctggctgacagccccaccctgtggccccacagatggcattccggtacctgtcctggatcctcttcccgctcctgggctgctatgccgtctacagtcttctgtacctggagcacaagggctggtactcctgggtgctcagcatgctctacggcttcctgctgaccttcggtgagcggtccggccgccccaggagagagcaggccccatgctgcgcagggctcacagccccagtgtaggagacagacccatccccagacagggacaacctagggtgggcagagctgggatatagggaggcccgagggcacacatggccccatctggggtcagagaggacttcagggaggacatgaacagtacgcttcagtcctcattctcagggggcctttgtgtcttgggaacaagtaaacaagtagggccaggtgcagtggctcacacctgttatcccaatgctttgggaggctgaggcaggaggatcacttgagcccaggaattcgtgaccagcctgggcaacttggcaagacccgatctctacaaaaaaacacagaaattattggggagtggtggtgcgtgcctgtagtcccagctacctgggaggctgaggtgggaggatcccttgagtccaggaggttgaagctgcagtgagccatgattacgccactgcactccagcctgggtgacagagtgagaccctgtctcaaaaaacaaaagaccgggtgaatcacagccaatagtgagtactgtgaagggcagagtggtgggaggatgcacattaataggggtccgggggcccctctgaggacaggacatttaaacagaggcctcagatatccagggagagagctgtgcggatgtgacagaaggccccaccagtgcagaggccgctggtagagtgtgcccaggtataggaagtggtagagtgtgcccaggtgtaggaagtggtgagggggctggtatggccagtgcagagtgcacaggggagaggtgggagaggccatccctctgctcatgggtgctctcactgcaggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacggtgaggcccggtgggcaggtgggagctcccaccggaacagggccctgaggcagtctttagggcccaggcctgagggggtgccacggccccagatggggtgctcagtctgagggggctcggccccgcccttgcatcacgccctctccacccaggcccacctggctgtggacgggccagcccgacctcacactgcctcccacccctctccagatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcagcactgcccctcctcctcgtgccttccttcctctgttgccttggagaacagcttcaagcagggatgaggtggctttcctgggtctgggagagtgacctgcagggtacgggacgtgtaaaggtggggattgtgaccttgtgtcaagagccatacctggccgggcgcagtggctcacacctataatcccaacactttgggaggctgaagtggatggatcacttgaggtcaggagtttgggaccagtctggccaacatagtgaaaccctgtctctactaaaaataccaaaattaattgggaatgctggcaggcacctgtaatcacagatactcgagaggctgaggcaggagaatcatttgaactcgggaggcggaggctgcagtgagcccagatcacacactgcactccagcctggacaacacagcaagattccatctcaaaaaaaaaaaaaaaagccatacccgccaggccaggcctcttcctcacttctcgccctcccaccagccctctgagatttcattaactggcctcatttcagattgctggggaagctgcttgcagggagctcgctgccctataccctttcctgccagctgcccctgctgggtgcaggctggagcctgccatgtgcccgctgaatgtctcctaacccgacaccaccaggcagggccaagtacagctttcagccgggtcgccatgagcacctgccaccctgaggcctcagcacagcagttggggcacgctaaatgtgtgccattggctttttgcgctgacacccactcccaattttggggagcatgggggtgaaggctcagcctgcctgagtggcacctggttggctggctgtagcactctgtgagtgttggggtgtcatatcacatccccggggctgcctgtgctgacaacagaggtggcatgagttggatttcccatcccagcccctggtgctgggactcttcgcccactggataggtgagctgagcgaggcctctgtgttctgagggctggggaccctacattcccaggtttactgttttggggggtggtctcagcaacacttctgggatagggggcccaacgctgaggaccacaccaggttccttcaggctccagctgccaccccatattgcagagccagtcaggggatccatgaggccccagggagacgatggcaccctcggagccccataccacaggtccacaggccatggcagtctcccatccctcagggcagccatgggtctccattacccgccccccaactctataccattccatggatccccggtgcccttggaggaaccccagcctctgcaccatggcctgactgacaggctcctaggaaccccggaggtacagggctctgcagccccttgagactggtgggctctccagccacctggacttcctggcctcgtcacccctggttcttcctcctctcacagctccacgcccaagcctttgacaaggcccatcagctacccccacaactccctgggggtctcacctcttcattgggaccacctgctccacctgctccatgcccctccttaccctgtggtgttcttgctcagtgttctgtctggtcccctgtcccggtcctgccctccccacatcccattcacactctagctagcagctagaggaaactcttttttttctttgagacagaatcttgctctgttgcccaggctgtagtgtagtggtaggatctcagctcactgcaacctctgcctcctgggttcaagtgattctcctgtctcagcctcctgagtagctaggattacagacatgcaccaccacgcttggctaattttttgtatttttaatagagacgggatttcgccatgttggccaggctggtctcgacctcaagcaatctgcccacctcagcctcccaaagtgctgggattacagacatgaaccaccctgcccggcccagctagaggaaactttatagtttattctactaaagcacaaacctgaccctgcccagcccttgc

SEQ ID NO: 13068 - DNA, 9963 bp, Human
tatgaagtacctatttgttaaatgagtgaacatttcctgtaggcaattacacccaacttccaaatggagaaacaggctcagagataagcccctgcaccctcactcctcaactcaactgcctgtttctagcactttccatgacgatcccctctgcacggagagggttcatggggagtgactattgttctgtaatgaatgaccaggctgtgccaggtccggcagtaggccttttccttttccttttttttttttttttgagatggagttgagttttgctcttgtcgcccaaacaggagtgcaatggcgtgatcttggctcactgcaacctgtacctcctgggttcaagtgattctcctgcctcagcctcccgaagagctgggactacaggcatgcgccaccacgcctggctaattttcatatttttagtagcgacggggttttgccatgttgtccaggctggtctcgaactcctgacttcaggtgatccacccaccctggcctcccaaagtgctgggatttcaggtgtgacccactgtgcctggccaggccttttcctttctttcttttttcgagacagtgtcttactctgttgtccaggctggggtggcagtggcacaatcacggctcactgcagccccaaactcctgggctaaagtgatccttccacctcagcctccccagtaactgggagtacaggtacatgccaccacacggactaattttaaaagtttttgtagagatggggtcttgctatgttgccccagctggtctcagactcttgggctcaagcagtcctcctgcctcggcctcccaaagcattgggattacaggtatgtgccaccgtgcccagccgcagcaggccttttgtttttttagagagggtcttgcttggtggcctaagctggagtgcagtggtgcaatcacggctcacagcagcttccaaactcctgcgctcaagcgagcctcctgcctaagcctctcaagtagcctgggactgtaggcacacaccaccacgcccggctgatttattatctatttatttatttgaggtggagcctcgctctgtcacccaggctggagtgcattggcctgatcttggctcactgcaacctccgcctcccaggttcaagtaattctcctgcctcagccttccgagtagctgggactacaggcacgcgccaccacgcccatctaatttttgtatttttaatagagacggggttcctccatgttggccaggctggtcttgaactcctgacctcaagtgatccgcccgcctcggccttccaaagtgttgggattacaggcgtgagccaacgcacccagccactaatgtattattattattattctgtagagacgcagtctggctatgttgcccaggctggtcttgaattcctgcctctgcctcccaaagcgctggggttacaggcgtgagccaccgcgccctgcggctgcaggtctttataaggcaactgtgggccctggaccgctccctgaaaacctccccctcaactccctgtctcctccctcacctggtctaccccgaatccttcccctctcgccccctcgccctctccaggggaggtgagggactcaagaatcgcgccctgcttctgtccccaccgcgccgtccccaagcccacgcagtgaaaagaccacccttgaggctgattccgggtccagctgggagcggccagccgtaaatcaccgcccccgtgggccgtaccattctggccggggggacctgggaggggacgcgcggagggcttcccccggggactgcctgtatcgagactctctccagcccaacaggaggatgggaaggagacttgtgtgggggcctcgggctggcgggtcgcgggttccttatcctccgccttggcgcctctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattggtaagcccagcggccagcggcccccgtccccgacccccgccgggacccgattctcggagccggggtcagggagccccggggagaggacccatgggagcccttgtatgggaaaagggagcccctgtatgtgggtggggtgggcgtacggaggggcgaaaaacagagggcggtcgtccctaggccccgtcttcgacttgtgacacgctgggcatctcgggttataaaaggtggggctgagacgagtgtgtgtcaatttcgaacccccgactccggggctccgctggggaaggggctgggggtcagctttgtaaagggacctaaggctcctccaccctaaggcttcccctcccccaatatcccgaacagtcgcggggtggggacagtgagagcccagaaggttcgagaatgtctcagcctgtgttttagaagcacttgaattgttggcctctgcccagtgggttcccttggccacgaaccccactccttttctggcctcagttttccgtctgtggcaagagggaggctctgtgtcaataccgaacacgcttaatttctgcaagtctcaggaagggtataataggataggatataaattacgttctctccactccccagcacctaatactgtgtggcatgctgtaggtatttaataaatacgtgttcaatgaatttatcctcccaggaatcccttaagagaggggaattttaggccaggtgccgttgatcacgcctgtaatccaaacactgggaggctgaggcgggtggatcgcttgagcccaagagttcgagaccagcctgggcaacccagggagacccccccctcgtctctacagaaacttaaaaagttagccgggcatggtggcgcactcctgtagtcgcagctgcttgggaggctgaggcaggaggatcactggagcccggaaggcggaagttgcagtgagctgaaatcgtgccactgcactccatcctggacagcagagcgagactctgtctcaaaaaaaaaaagtaaattaaagagaggaattttagttctatgttacaggtgagaaaactgaggctgggactggggtgggggcaggtcagtagcttcaagtctggactgcaggtgacaggggtaactggaacctgggtttgtcggcagctttccaacgtctctgcctgctcgacaaagcagaggcaagagtgacattttgagacgcctaccaggcctgtacaccagattccagtcccgaaatagcctgctgtgggggttgggtgagcctgtatttcaccctggggactgggaaggtgttcagaatctaggagctgcggggccgggtgcggtggctcctgcctgtaatctcagcactttgggaggctggggcgggccgatcccctgaggttaggagttcgagaccagcctggccaacatggtgaaaatacaaaaattagctgggcgtggtgtaagaatccaggagccgcagggttttccttggagtgctgcgagggctgtgggtgagggtggtgggcacagggagtgggtggggaccttacgtgtgctgttcttctcctaatccagttctcctggttttcccccgtccccgtctctcgtatttgtggtctccttgtctcctctctcccctttttcccctcccccttctctgtctcttgcttggtgttggttttctgtgtgtctctgtgtgtccccgcgccaccccctgtgctgtgtcccaaaactctgcctggctggtgcctgtcttctctcttgagggcatctgtcacctcttctgcttggtcatctgtgttcctctttatttcttcctggccccatcttgctctctccccacaccgcctgtgtctaccctcctctccccgatcccccacttctccctctctcccctgggccccaatgtcttggactctcctaccagtggcgcttgaggctacaagtccaaggtaagcagagtggatgcccggggggcattcctgggagctggggaggggtagagtgcatattgggagggggctgactggtatgacccctgctgtgacctctcaccgcgttttcagtatcttcagctcaagaagaagttagaagatgagttccccggccgcctggacatcgtgagtcttgggatggggagaaagacttgagcacagccactgtgtcggtccgttaggcctggatggcactgcaggggggttaggtcagccctacgcccttcacccatgttctcatccccctgggaaggggagggtctccccaagaggacatcttagcccctccaacatctcccctaccccctttcctcagtgcggcgagggaactccccaggccaccgggttctttgaagtgatggtagccgggaagttgattcactctaagaaggtatgtctgtctgtccgtcctgcctggttttggggctagcatggggttggggctgaggttggtgtctcggtcccagctcaccccttccctcttcctcccctccctagaaaggcgatggctacgtggacacagaaagcaagtttctgaagttggtggccgccatcaaagccgccttggctcagggctaatgcgccctgaaggcagaggtgagggggcccactagacagggacaccaccctttggatcttctccctgccccatgctctgactccttggcccagggtggagagcctgggagatgggggggacatcacgtgtgtccccagagcgagcgggataaagttagacccggttggtggaggacaacaactgagatggggtcagaggtgtgcagggtgacagctgagatggtgatgggtcagagatatgcaggatgacagctgagatggggtcaaaggtatgcaggatgacagctgagatggtgatgggtcagaggtgtgcaggatgacagctgagatggtgatgggtcaaaggtatgcaggatgacggctgagatggtgatgggtcagaggtgtgcaggatgacggctgagatgctgatgagtcagaggtgtgcaggatgatggctgagatggtgatgggtcagaggtgtgcaggatgacggctgagatggtgatgggtcagagatgtgcaggatgacagctgagatggggtcagaggtgtgcaggatgacagctgagatagggtcagaggtatgcaggatgacagctgagatggggtatgcaagatgacagctgagttggtggtggggtcagagggctgccctaaaacagctctcctggtttgggaatgaaaagtgctagcaacccaacggttcagaatccggaactctaggtctttgtcccattgccaagaaacagttcccaacccagcaggtcatgtgacagcgtccggccaagttcccagcatgttttgagacagaatttccttgctccacaatttcgagtaggtcactaattatcaccgggctctgaacctgagaattagttctaggaatattccagacctgatccagctccagaaacttacccactttggaactgaacatgagtccaagaatgctctagaaacaaatgctaactctagaatggattgtctgctccaaaaaaaccctagagctgactcccagttctccccatagagccgagaatgaaatacaccaccagctcccaacacactgtaaacctgagccccccttcccaacccagcaattgaaaaatgtgaaccagctcctaagcactagaattgaccactagttcctggagttggctactggttccttatcactgtttttctttctttctttctttcttttttgagatggagtcttgctctgtctcccgggctggagtgcagtggcgcgatctcggctcactgcagcctctgcctcccgagttcaagcaattctcctgtgtcagcctcccaagtagctgggattacaggcacatgccactatgcccggctaatttttgtatttttagtaggtctgatcctgttggccaggctggtcttcaggtgatccacctgccttggccttccaaagtgttgggattacaggcgtgagccaccgtgcttggcctccttaagcactctgaaccaagtattgtttccagcctaatacattgtggaacaagtggcaatttctatatgaacctcaggaacaaagaactactttccagcaccttctgagtctgattttccagtttgtaagccagtatggtccagataagcgtgaaacccaacccattctagaacagttactagccctttttctggtctctggcactgcagggcctggagcatagtttattttttgaggtggagtctcgctctgtcgcccaggctggagtacagtagtgtgatctcggctcactgcaacatctgcctcctgggttcaagggattcttgtgtctcagcctcgtgagtagctggaattacagatgtctgccaccatgctgggcaaatttttttttttttttctaagacggagtctctgtcgcccaggctggagtgcagtggcgtgatctcggctcactgcaagctccgcctcccgggttcacgccattctcctgcctcagcctcccaagtagctgggactacaagcgcctgccaccacgcctggctaattttttgtattttttagtagagacggggtttcaccgtgttagccaggctggttttgaactcttgacctcaggtgatccgcctgcttcggcctcccgaagtgctgggattataggcgtgagccactgcgcctggccatactttttactcccctctaaccttcagcaccagttcccattccatgttgatctagaacagagtatcccatcccaacacactgtggacccaagtaccagctcccagtgtgccttgtgccagaaaactagttttcaaatgcgttaaactcaagttccatttcctaaaattctttaccagagcagaatgaggtcatgttcaatgtgaattgggacgtgccaatttgaagtaatgcagaaacgatatcttgccttatgtgcaggtctgaaacaaagcaaatccctctaacataaaggaaaagaaaaatggaattgcctaattccaaagctgcatcagctgaatgcattgtggactgttgctgttgagcgtggggtggggtgccaccatgcaggctttgaattcttttttttttttgagacagagtctcgctctgtcacccaggctggagtgcagtggcgcgatctcagctcactacaacctccacctcccaggctcaagcgattctcctgccacagcctcccaagtagctgggactacagttgtgcaccatcacgcccagctaatttttctagtttttgtagagatgggtttttttcaccatgttgcccagactggtctcaaactcttgggctcaagtgatccgcccgcctcagcctcacaaagtgctgggattacagacgtgagccaccacacccggctatctttcttccttttaacatgggccccacgcctggcctctgttcctgcaaactgactccctaccccaaccacctctttttctctccacagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaaccgaatgtgcctgtgaggagtgtatcttgttttacccctgtgcctcctccctccaggaccccgtcccagaaattagcaaccacgtgttgagtgctcagtgcaccaaccctctgtagggaagcaccttactgcaatgctgaggttgttattttttaagacagtcttgctctggagtgcagtggtgcgatcccagcttactgcagtgtccctctcctgggttcaagtgattctcccgtctcagcttcccgagtagctaggaccacaagtgtgaactgctatgcctggctaatctttttctttttctttttctttctttttttttttttttttttgagacggagtcttgttctgtcgcccaggctggagtgcagtggtgcgatcttggctcactgcaacctccgcctcccggttccagcgattctcctgcctcagcctcccatgtaactggaattacagatgcccgccaccacacccagctaattttttgtatttttagtagcgatggggtttcaccatgttggccagactggtctcaaactcctgaccttgtgaccctcccgcctcggcctcccaaagtgctgggactacaggtatgagccaccgcgccggacgtaatttttggattttgtaatagagacagggtttcaccatgttggccaggctcgtcttgaactcctgacctcaggggatcctcccgccttggcctcccaaagtgctgggattataggcgtgagccaccatgcccggctgtttttgtaactattgatagccatgaagtgcatggacactttcctcaaatcaggtacaattctaaactgtttcactctcaaaccttgacccactcattctgggaggacagaaataaaattgttcctcccccaagtcaaatgctgcgactcctgaaacccaccacattccatggatctctgctcagtgacatctgggaaacacaagacagccatcaacaatagcaacaagaggccgggtgcagtggctcacgcttgtaatccggcactttgggaggccaaggtgagcagattgcttgaggccaagagttcaagaccagcctgggcaacatggtgaaaccccacctctactaaaattagcccaagtgtggtggcaggtgcctgtaatcccagctactcgccacctgccactaggttgagaaccgcttcaacctgggaagcagaggttgcagtgagctgagatcgtgccactgcactccagcctgggcgacacactgagacactgtctcaaaaaacaaaaaaaccccaaaccaaatgaacaatagcaacaagaaacaagcccccacatggcttcatttctaatgattctgaggattttcttagtatgacagtcctttggcggtatagttctttattttttttctaagacaggttctctgtcacccaggctagaatgctgtggtaggatcatggctcactgcagcctcgacctcctgggctcaagtgatcctcctgcttcagcctcctgtgtatctggaatcacaggcacatgccatcatgcctggctcttttttttttttttttagagatggggtcttgctattttgcccaggtggtctcaaactcctggcctcaagtgatcctcctcctttggcctcccaaaatgctgggattacaggcgtgagccacggagcctggcctggtggtgtagttcttttttttttttttttttgagatggagtctcgctgtgtcgctgaggctggagtgtagtggcgcgatcttagctcactgcaacctccacctccctggttcaagcaattcccctgcctcagctcctgagtagctgggattacaggcatatgtcaccacgcctggctaattttgtgtgtgtgtgtgtgtgtgtgtgtgttttgtttttcttttttcaagtagagatggggtttcaccatgttggccagactggtctcaaactcctgacctcaggcgatccccccgcctcggcctcctaaagtgttggaattacaggcgtgagccaccgc

SEQ ID NO: 13069 - DNA, 27545 bp, Human
agaatgaagctggggctctctcttccaacaagcatttttgatatgctccgagtgtccctgctaggtagccaggagaccaggtaacccacttccctctgacaatggaacaattccccaaggaccctgaggggcagttctctggagtttgggcactagagtccctcttatttcctcttcttctctcctccctctagaccccataccactcaggagaggccaagtaaaaagacccagaattttgcctcttacaagcttagagatcttgaagaagtcactgaacctctgcgggacctactttcctcattctttaaatagaaaggcagtgggttttttgtttgtttgttttttgttgtttttttttttgttgttgttgtttttgttaatcgtggcgatggttatttatttatttatttattttgagacggagtcttgccctgtcgtccaggctggagtgctgtggcgtgatcttggctcactgcaacctccacctcccaggttcaagcgattctcctgcctcagcctcccgagtagctgggatagattacaggcgcacaccaccacgcccggctaatttttttttttttttttaaatagtagagacgggggtttcaccatgctggccaggctggtcacgaactcctggcctcgtgatccgcccgccttggcctcccatagcgctgagattacaggcgtgagccaccgcgcccggcctggttgttaatttttaaaactgccgttcatttttgctttgccatttatagctctgtagccttgcacaaatgacttcacttctctatgagtcatctgtaaaatggggctctttgtgaagacttaacgataccacgtgtacaaagcactgaatacaacatgcacattaagctccccgaaattgaaactcctataaaataggaatcggggattctcaagagcaggagttctgacttcagcagaggaacccagagctggtggggaaagcagacgtggctgtgacatccccagggacactaaacacatcctcccagccccatcttccccgcagagtcccgccaccggcccgacccctaacttgctccaaccacccgccgacgcccgcagcccgctgtttgggggccgccccctgcagcgccaggtccccgcgcggactacagttcccagcgtacatctcggtcggggggtccgaggggccgtcctgcctcagggataaggtccaggctgcgttcgcggctccgggcagtcacagtcatgcacgcagctcctatttttcgcgttgctaatcgcgtccgctgcagtccaacccatcctgggccgcggcccccacagggtctgtgaggagcgcttccccccgccccgggcgcccgctacgccgcgtccgaaggaggggccgaggccgggctcatctccccgggaggactccttcggcttcgtggggtgtcatgtccattgcggcccgaggctggccgcggggctctgctggagggcgctgagagccgggccccgaggccgcacggccggagactacaactcccaggaggcaccgcggcggcggcgcccacacgtcactcgggccccgccggtggcccggggaagcagcacgggcggggggcaggggctggggccgaccgggaggccggtgccaaggatgggggccgcccggctgccccgcgcgtgaggaggccgaggggcgcgccaccccggcccggggcggccgccccaggggccccgccacccccgcccggcccggcagtcgtggcccgggatgcggagccgggggccgccggtggagctgcgcggggtgagcggcgcggggaacggggactgcctgccgccctcgccctcgtcccccaccggcggaccccggcgggcattcgagagccgcgcggccaggccctcttagccctctgccgtttggggggcacgggtgaacctgccgccccactcccaccccgccccgccccgcccgtacagccaaatcggaagggacgagcctgccctttgaaagggttttttttcttgctcctgcggagggcgccccagccatggccctcaggagctccctagaccccgcagggactgccctccatcccggccgccggggcccgccctctgcatcccgcgggcagcctgtgtgaagcggcctcccgcagcccccggcccctcccccatggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacagtaagtggtgtcctctccccaaaattccttccacagaacctctcaaggccaggcctaggtggtgggaaacagggtgagggacaccagatgacactgtgcctggagtgagaaggggcagcagtatgataccttcagggtgaaggtgaggtaggccttgcctgccttaagggagaaaaaggaggctcagaaaggttgaaggacttacctgcctcccaggctgcagagtcacaatcgctcagtaaacatgtatccatgaacacctgcgttccctgcatgaacaggacagatgcagtgcctgccttcaaggtgcttgccatccagccatgctgccagagtccaccaggcagagacaaaaagagcctaccccgtctggagtcagtgtctctcaaccccagcactattggcacttgaggccagatcattgttgtaggggctgtcctgtaaattgtgagttgcttagcggcatctttagcctcttcccactagatgtcattagcattccctgccccctctccccagctatgacaaccaaaagtgtctccaggcattgcaaatgtcccctggggggcagaatcacccccagttgagaaccatttcctggagtcttcataggccgagctggccaaggcaaactggaaaagatgagggaggaattaaattgatgtggcttatataaaagcttccaggctgcctgataggttctccaaagttgattggttggttgaataaataatggagccaggtagaagggaacattctgcaagactcatttctagatggaagagcttcatgtggtgtcaacaagtattaattgagcacctattaagcaggagcccagctgggagtaagacagccatggtttctgccctgacagtactcacaggctagcaatttcattcattcattccacagatatttccagagtgctgtgtgccagaccctgtcccagggatacagcaagaaaaaaaaaatcttacattcctggctctcccattcgtgctgtgccccatctcactccctttcatttcttcattcatttgttcattcttccatttggtatttaccaggccagatcatgtgctaagcaaaggcatcagcagtggagaaggccagcatgtccccggccctcacgtcactcacagttaagccccaaaatgtgaaggtgccccctttgctctcaacacccacatctcatctattcctgatttctgtcacttctacatcttgaaatttattttaatccatcccactatttttaggaatatattgctattccccacccatagcaattgtaagcccctagaatagagggactgcatcttccttgcctcccaagcctgacatttgtatatcaacagagagcttggctgggcgcggtggctcacgcctgtaatcccagcactttgggaggccgacgtgggtgcatcacccgaggtcaggagttcgagaccagcctgaccaatatggtgaaaccccttctctactaaaaatacaaaaattagctgggcatggtggcatgcatctgtaatcccagctactcaggctgaggcagaagaatcgcttgaaaccaggaggtggaggttgcagtgagccgagattgcaccactgcactccagcctgggtgacagagcaagattccatcgcaaaaaaaaaaagctaacatgtgaccacgatgtgccagagctggtgctgtgtctggggaactgatgcttatgccccagcacctctgaaatgttgggtaaatggaggcagggccacccagcatgctcctgttgaaggctgggactcctcagcccttcctcacctctgctgattgacagcacgccccacacccccaggttttttgtagccagtgctatctggtcaaagggtcagtgggcctcttatggccagggcttcctcccggggtgatgggtctgctctgtgccagaaacagaggacacagcgcctccacagcactgcttccccactcatcctaccctaaggagcgcctcatctgccatcattcattcattggttcattccaccagtaattcttaagtgcctactctgtactaggcactgcctcagctctgggattacagaagtgaacaaggcaagatttctccctcccccagctatggaatttatattccggtgaacaggaataaatgatggatagatggataccaaaatttcagagagtatcaggggctctcagtggactaaggcaaaggctggagcagagggttctctttatttagatcgggtggtcagggaaggcaacatttgagcagagacctgaacaaaggggacccagctttacaaagatctggggaaggggaacagtggggcacatgccctgaggtgggagtgagtgtgtctcactggagaacagcaagaccagaacagcaggcattgaggcagagatgggaggaagtaggatcagaaaggctggcaggagccagatcacataggaccttgggggccatggtgaggacttggggtattttatttgatgtagtggaagccattagaggatttgaagcagggagtgacatgattacataaagattttgaagggggactgacttaggcccagcctgggaaatacagaaataaagcataaaaccatgagatgttccctctgtcacagggtttcgatacaaacaggagaggtggggacctaagaagggaaaacttctgcagaggtggagttacagactaggaatttacagtgggggcttccaggaggaggtaacactgaagcccgcccggcctttttttttttttttttttttttttttttttttttttttttgagacagagtcatctcactctgtgacccaggctggagtgcagtagtgtgatcacagctcactgaaccttccgcctcccgggttcaagtgatccttccacctcaactttccaagtaggcagggctacaggcgtgcgccaccaagcctggctaatttttgtatttctagtagagacggtggtcttgccatgttggccaggctggtcttgaactcctgacctcaggtgatccgcctgccttagcctcccaaagtgctaggattacaggcatgagccaccgcgtccaatctgaagctgggctttaaaggatgggcaggattatcaattgtgtgaccctgggtgatttgccaatctctgccaccttcagttccttcatctgccaaatgggcatgatagtagaactaccttactattattattatgactgggaagtagccaggaatggcaaaaagaaaagtggagaaattcggaacaattatggcaatatcacacactaataataacagctaacacttttaaaggccctattgcttcaggcaataaatttttactataacgctagaaggtaaattctgttacgagccccatttcatagaggagaagtctcggtgtgaagattaaagtaaactgtacagggttatgcacctaggaagaagcagggctgagactcaaacccaggcagcacactgtatactttggagcctctatgtgatagaaggtagtaaaatatctcagcagttaagagattgagctctgatgacaaaactaattcaagcctttgtcctgccattttctaaccatgtgacctcttggccaagtgacttctgagcctctgttagctagtcaagaaaaatgggttgtggctgggtgcagtggtttactcttgtagtcccagcaatttgggagtccaaggctggaggattgtttaagcccagaagtttgaagctacagcaagccataatcacaccactgcactccagtctgagtgacagaaaaagaccctgtctctttatttatttatttttttcattgagatggagtctcgctctgtcatccaggttgaagtgcagtggcacgatctcggctcactgcaacctctgcctcctgggttcaagtgatcctctcgccaaagcctctcaagtagctgggactccaggcacccgccaccacacccagctaatttttgtatttttagtagagacagggtttcactatgttggccaggctggtctcggtctcctgacctcaagtgatccacctaccttggcctcccaaagtgctgggattacaggcatgagccactgctcctggccaaccctgtctctttaaaaaaataaaaaagggctcggggtgggggtcattcatgagtcaattcctatagagagcttagcacagtacaaacactagccatgatcctcatggctgttagtgacaacccgggtagaaagtaagctagaaccatccagtatgtttagggaatacttcagtcagattttgtcacgatcatgctgtgtaataagctacccccaaaactcggcatcttaaaacagccattgtgtattactgctcctgcatttgcggaccagctggagggtaaactgatggaggctgggctcagctggagaggctttgctccaagtagctctcatcttcttggacaagcaggctagctgaggcatgttgtcatggtgatgacacaagtgcaagagggccagcagacatgcaaggcctgggcttggaattggcaccctgtcattcttagccaaagcaagtcatacggctgagccagagtcagggtgcactctgcctttgtttttgtttttgtttttgttttctcggagacagagtctcgctctgtcacccaggctggagttcaatggcgcaatctcagctcactgcaacctccacctcccaggttcaagtgattctcatgcctcagccttccaagtagctgggattacaggtgagcaccatgatgctcggctaatttttgtatttttagtagagatgaggtttcaccatgttggccaggctggtctcgaactcctgacctcaagtgatccgcctgccttagcctcccaaagtgctgggattacaggtgtgagccaccgtgcctggccatactctgcctctttagcagaaagaatggcaaagtctcatggcagagtgtggacacaggaaggggtagaattgggaccctgactgcagtgtgccacgggggtgatagacacgagggggaagccacgttcctcccttctgccccaggtttgcacttcctgcttccagggtagctgggaactcaaggcctggaggactaaggccttggctgttgtttcttttttttgagacgaggtctcactctattgcccaggctggagtgcaatggcaagaccatggctcactgcagcctcaacctcccagcctcaagtgatcctcccaacttagcctcccaagtggctgggactgtaggcatgcaccaccacacccaggtatttttaaaaagtttttgtagagatgaggtcttgccatgttgcacaggctggtctcgaactcctgggctcaagtgacccgcttcagccttggctgttggttcttgaccattcatggagctccccaaagcccaggacagaatcaggagggcagaggacacaggaggagctccctactccctcatgggagcctgggacagggattagacctgggcggaggggctcatggatgttccaggccaggaaaggacctgccacagagcggggcagcctgaggcagtgagaggaaagacgtgtttctagctgaggcagcgggccagaacacttgggtctgcggcgtggcaggtctggggtgacccacctttcttcccaccccacagtcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggaggtgctgaaaggcgcggccgggatggcctctggggagtaagggagggaggaaggggtgagggcagagtgggagggagggtctcctgctgaagccaggatctcagtctgacaaagggacctgctggcaaggtcaggccaccagacaagtgccagttacctgttcagctagcacaaatggcaactagggggcacactggattagaataaaaagctcataggatctagagacaaggccgggcgcgggggcgcacacctgtaatcccagcactttgggaggccgaggtgggcggatcacttgaggtcaggagtttgagaccagcctgaccaacatggtgaaaccccatctctactaaaaatactaaaattacctgggcgtggtggcagatgcctgttgtcccagctactcgggagactgaggcaggagaatcacttgaggccgggaggcagagattgcagtgggctgggattggccactgcactccagcctgggtgacagagcgagactctgtctccaaaaaaagaaaaaatttaaaaaagcatagagacagcacatggatgctagcactgaaagccccctcagacactagcccatgcactgtcccatctgtcagacaggaaaatgattaattcactcattcattccttcatctaactgcaccgggttctagggatatagcagagaagaaaaatacatgcaatccctgccctcaggaatagtaagtcagtcaacatacaagaagctcttttttataaagctgttttttaagaaaattataatttttaaagacaagtacaccagaaaaaagtgttagtacaaagtgcgaggaggctgagaggaaggcactttaagggctggaagactacttttgggaacgcttctctgagcaatctgagaaatgatacttcatctgagttccaagtggcaaaaaggaaccagtcacgaaaagtttggaggaagaaggaggtgctgaggtgagcatggtgtgtcccagaaacagcaaagaggcccatgtggctgccactgtgcaggcaaggaagagagaggtaggaaattatgtaggagagggagctggaaggccctgtgggtgagggagtggccttcaggttttattctaatgaagtaggaagccatgaggagccatgtctgaatagagtggtagctcacacctataatcccagtactttgggaggccaaggtgggaggatcacttgaggccaggaatttgagaccagcctggtcaatgtagtgagaccccatgtatatgaaaaagaaatttttaaattaatttttataaaaggaagtaaataaaaactcctttggaggccgggtgcggtggctcacgcctgtaatcccagcactttgggaggcccaggtgggtgaatcccttgacaccaggagtttgagaccagcctggccaacatggtgaaatcccacctctactaaaaatacaaaaattcggccaggcgcggtggctcacgcctgtaatcctggcactttgggaggccgaggtgggtggttcacttgaggccaggagttcattcaggactagcctggccaacatggtgaaaccccatctctactaaaaatacaaaaattagccaggcatggtggtgggtgcctgtagtcctagctactcaggaggctgaggcaggggaattgcttgactgcaggaggcagaggttgagatggcgccgttgcactccagcctgggtgacagagcaagactccatctgaaaaaaaatacttaaaaataaaagctcctttgactgttaggtagagacagccaatgatgggtctgttgctgtcaccagtgagagttgatggtggccatggagactttcaacccaggaccttctgcttggttggagccaaacctgggtctccccatttactgttcccgtcaattcccagctgaggctccagattgtccaagcagcaaattaatgggtatgggactgagacagatcagacaggaagtctccagctcagcctagagcagagcagccctttgggagaatttccaactggctgtacatcaggcgttcatttgtgctaccttttttttttttttttttttttttgggacagagtctcactctgccgcccaggctggagtgcaatggcacaatctcagctcactgcaccctcctcctcccagattcaagtgattcttgtgcctcagcctcccgagtagctgagattataggcatgcactggctaatttttatatttttagtggagacagggtttcaccatgttggctaggctggtcttgaagtcctgacctcaggtgatccgcccgcctcagcctcctagagtgctgggattacaggcatgagtcactgcacccggccgggcaggctaattctttctgatgtggtcctgtcctgtacttagcaggatgcaggatatccacacctccccgccataaacttcagtaacattctcagtcattattacaatcacagtaaccccataggtttccaaggacatgggagagaggggtggatcatgctaccctccagttataaaccactgtttctcccccaccttgtatggtctccattctgaagtttacttcatgatccaaaatgactgcttgagctccagcgttttttgttttttttttttttttgagctggagtcttgctctgtcgcccaggccggagtacagcggcgcgatcttggctcactgaaacctctgcctcctgggttcaagcaattatcctgcctcagcctcccaagtagctgggactacaggcacatgccaccaggcccagctaatttttgtattatttatttattttttttaatttttcagtagagatggggtttcaccatattggccaggacagccttgatctcttgacctcatgatctgcccacctgggcctcctaaagtgctgggattacaggcgtcagccaccgcacccagccttttttttttttttttttaacagggtcttgctctgtcacccaggctggagtgcagtgatgccgtcacaaatcattgcagcctcaacctcctgggctcaagtgatcctcccacctcagcctctctagtagctgggactacaggcatgccaccacaccaggctaattttttgtagagacgaggtctcactttgtttcctacgctggtctcgatctcttgggctcaagaggtcctcttgtcttggcctcccaaagtgctgacattacaggcgtgagccactgtgcctagctccacacgccagctttttttttttttttttttttaattttaagttctgggatacatgtgcagaacgtgcagggtttgttacataggtatacatgtgccatggtagtttgctgcacccatcaacccatcatctaggtttgaagccccgcgtgtgtcaggtatttgcctaatgctctccctccccttgtcccccaccccccaggctccaggttttatgtctacattccaaccacaagaaggggaaaaaaggaaaatggcaccccttctttttattttttgagacgtagtctcactctgtcttccaggctggagttcagtggcacgatctcagctccctgcaagctccgcctcctgggttcacgccattctcctgcctcagcctcccgagtagctgggactacaggcgcccgccaccacgcctgactaattttttgtatttttagtagagacggggtttcaccgtgctagccaggatggtctcaatctcctgaccttgtgatccgcccgcctcggcctcccaaagtgctgggattacaggcgtgagccaccgcgcccggcctcattttcttacccatgttgtttttgttcctgcgctcctgtgcctgtctgctgtgctgagctgcagatgtgtcctgccgcggcttcgcaggacagggataagttgagacaggaagcaagaagccttgcctgtcaggctgcccttggcatgactagagtgtatgtggggattttcacctcttattttggggtccattctgttccttctttgaacaatagtctttacaggatagggtgtttggggacagatttcatcttatttaagatataaataatataaaattaacccactataaatttatttttcatttaaaaaaatttttaaaagacaggctctcactctcccacgcaggctagaatgtggtggtatagtcatagctcactgcagccttgaactcttgggctcaagccatcatcccacctcacactctttcccggccgggcaccccttctttttgaggatacttcctggaagctagttgcctactacaccccctcctacatcccatgtaccagaactgtggtcatgtggcatgcttagctgcaaaggagaatggaaaattcatgcaggcagcatgtggccagctcaattcaccagcactgtcactgaagaatgggaggctgtcagctgcatatgggggcagtgattgtgtctatctcttcccaatgtctaaaatggtgcttggcacacagtaggcacttaataagtatacgttgaatgggccgggcgcagtggctcatgcctgtaatcccagcactttgggaggctgaggcaggcggaacctgaggtcaggagttggagaccagcctggccaacatggtgaaaccccatctctactaaaaatacacaaattagctgggatggtggtgcacatctgtaatcccagctacttgggaggctgaggcacaagaatcacttgaacccaagaggcggaggttgcagggagccgagatcatgccactgcactccagcctgggtgacagagactttgtctcaaaaaaaaaaaaggatatgttgaatgaatgcatgagtggatagtggggagaccagggatctactccaggataaacaccacacagaatggccatcaggatctgggaggatgtagagtttgcagaggaagatagccttgcagggaccacagcacagtgacgcacgctctggtaccatggagccactgagagcactgtcgtgggcagcaggcagacctgagtccaagtgtggctccaccactcactagctgtgtgaccttgggcaagccccttacctctctgagcgtgtacctgctcatcagctaaagcaggggtcataccaaatccttctgccttacagggctgttgtgaggattaccgagtgcctagcacagtgcctggcctgcagtaagtgctttataaatgttaaataatgttaactggtttttagaggtaagtgctgagtgttttggggaaacgtagaggaggggcctctaacctagctttggaggctgtggaatcaaggaaggcttcctgacagagggggcaacctgtgttgagacttgagggacaaatagttacacaagggaagagtgttctccacaaagggaacagcatgtgtgaaggccagaggttagaaagcacagggcctgctcagtattcagtgtggctgcaagatgaagttggggttagaatgggctgagagtgtttggaagtgaggctgcaggggtcatcaaaggccagggccaagaaggatggatttaggtgggatgcagtggctcatgcctgtaatcccagcactttgggaagcccaggcaggaggatcacttgagcccaggagtttgagaccagcctgggcaacatagtgagacctccatctctacaaaaataaaaataagaaagatggatttggccagtaggaacacgggacctgaagattttcaggcaggggagagggaagacaggccgagcaaaggagagacatcagagagccaaacccaccccatctattggagaacaaggccatggaggtcaaagcaagttcttgtgacctcattggccgggggtggctgttggggtgagggcagccctgcatgggaccaagggcagggctgggtataggtgaggattggggtgggctgcgacatcacccctccctctcccctgcctgcagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggagggtgagccggggccccgtgacgagggtaggctcagcttggagtggcagggacctgtgggcccagacctttccccttcacacctatccataccagtgggcccaggagtgaggaagaaggggctggaacccactggactctaaacagcctccccatggttggctccatcccccacatcccagcccttgtttgggccaggcccagagctctcaggacaacctgttaggattccttggccctgggattccaccttgatcctgattccactaccagcccctcctcggggtgcaggtcccagggtttctctcccagcgtttcactgagtggaattggccaggagcttggctttgaatcccttcccctcagctccatagcagctgtttgtctgccatccccagaaattctgccttcctctgagcaggctgagtccccagagcatgaccactgacacctccatgccccaccactgtccttcctcctcccaccccagaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaaggtgaaggcagggggcaaggtgggaaagatggagcaagacccctgagttctgatgccttgggctgctcagagactcctcccctgaaccccagcctttgggtccatgcagggtcaagggagccttttttgcatattaagaaaagacagcctcctgttggtggattaataagaaaaaggcaccctgtactgaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaagaaagaaaaagaaagaaaaagcacccctttctttgagctaacacagttccctgccctggcacccagcttggctagcaaagcatgagtcgggtggtgaaaccagtgtaccccacagcaaggtacccttgtgtgaggcaccaaccagacgcagcagccctgggtccctccccaggaagcagagcagctaagcccctccccccagccaccgcctctccttcccaggagcttcggagccgtgaggaggagctgctgcgggcggcacaggagcagcgcttccaggaggagcagctgcggcggcgggagcaggagctggcagaacgtgagatggacatcgtggaacgggagctgcacctgctcatgtgccagctgagccaggagaagccccgggtccgcaagcgcaagggcaacttcaagcgcagccgcctgctcaagctgcgggaaggcggcagccacatcagcctgccctctggtacccacccgtgtccccagagcgccccccaagaggctgctgggagcagccccgacctaggatttatctcttccttttctttttcaacttgtttttattgctaaatatatcgcacatagtcagtgatcagcccagtgcagtggcgagcacttgtagtcccagcctactcaggaggccaaggtgggaggatcacttgaggccagaagtttgagaccagcctgggcaacatagaccccatatttaccaaaaaaaaaaaaaattttttttaattagctggccacgttggcatgcacttatagtccaagctactggggaggctgaggtgggaggatcacttgagtccaggagttcgaggctgcagtgagctgtaattgcaccactgcactccagtctgggcagcagagcaagaccctatctctaaagggaagaagaagaaaaaaagaaaatgaccaaaaacctgtacagccaaatgagttactctagtcacccccatgaaagcagagagaacctcacagccatcccaagtgctttctacctgcccctccagacaacctcacaccatcccctgagaggaacatctgtcttgacacttaggacagtcacttctgaactttctttttcatgttatctctctttaaaaatatcttttaatctggccaggtgcagtggctcacgcctgtaatcccagcattttgggaggccaaagtgcgtagatcacttgaggctaggagttctagagcagcctggctctagaacatggtgaaatcccgcctctactaaaactacaaaattagctgggtgtggtggtgcacacgcctgtaatctcagttacttgggaggctgaggcacaagcatcgcttgaacccggaaagcagaggttgcagtgagccgagattgtgccactgcactccagcctgggtgacagagtgagactctgtcacaaaatatataattaagatatacatatatatgctgatatttgaccatttttttacctacaaaaacagaagtttcacatggatcaacctaatagttggatctcaagacttaatcagattcagattcaggtttgattttttttttccccacactgcttcccaggtaatgcattcaggagggaggcacgtagtgtctacttgtctctttctgtgatgttacaagccagaaagcagtgccttaagcagcagtggccagtggaaatataatacaagccacgtgtataattttaaattttctagtaagctacacataaaagcaaaaagaaataagagatgtcaattttaatattttttattaggccaggtggggtggctcacgtctgtaatcccagcactttttggggctaaggcgggcagatcacctgaggtcaggagtttgagaccagcctgaccaacatggagaaaccccatctctactaaaactacaaaattagccgggcgtggtggcgcatgcctgtaatcccagctactcaggaggctgaggcaggagaatcgcttgaacctgggaggcagaggttgcagtgagccgagatcgcgccattgtactccagcctgggcgacaagagcaaaactccatctcaaaaaatatatatattttttaatttagcccaatatatccatgcaatcaatacaaaataattgtgagatattttaccttcttttttcacactaaatctttgaaatccagatgtattttatatttatggcacatctaaatttggacagtaaattttcattaaaaatttttttttttctgagatggggtcttgctatattgcccagggtggtcttgaactcctgcgctcaggcagcgctcccactttggcctcccaaagtgctgggattacaggtgtgagctactgtacctgacccatcaaaaatattggatctgtatttagatttcataaaagttagagttgaaaaagtacatatacatacccaagttgctccaaacatgcttaaatgtttccaataaccaaatggagtacctgttttttgttgtttgtttttttgtttttgtttttgttttttttgagatggagcctcgctctgtcacccaggctggagtgcagtggcatgatctcggctcactgcaagctctgcctcccaggttcatgccattctcctgcctcagcctcctgaatagctgggactacaggcacccgccaccacgcctggctctttctttctttttttttttttttttttttttattttttttatttttagtagagacagggtttcaccgtgttagccaggatggtctcaatctcctgacctcgtgatccgcctgtctcggcctcccaaagtgctgggattacagacatgagccaccgcgcccagcccccatacctgtttttaaaatttaaactcaaattgcggtaattacaataaaataaagagttggctgggcatggtggctcacacctgtaatcccagcactttgggaggcggatgctggaggattgctcgaggccaagagttcaagaccagcctggtcaccacagtgagaactcatcctttatatatatatatatacagtttaaaaattagataaataaaggttaaactccaattcccccattgcacaagccacatttcaaggtgctcagctgctacacgtagctactggcggccatattggacactgaggcctaggtccttgatccacaagagctcttgtgcttgtacttattaaaccacagtccattgctgagcctcaccccaacttgctgattcagggagggcccaagaatttgcattgccaagaaattttcagctgatggtgatgctgctgttctggggcccacactctgagaaccactgcattaaggaatgaaaaatggcggtgttcccattctagaattccttctctacttctacagaagaaaattccctttggtaatccctggaaccatttgcttaggaaagcttctctttctttctgcaggctttgagcataagatcacagtccaggcctctccaactctggataagcggaaaggatccgatggggccagcccccctgcaagccccagcatcatcccccggctgagggccattcgccgtgagtatctcccaaggccctgaccagtcagtcagtcagtgaacaaacattttttagcacgatgtttatacctggcaccaagccagagtaacagcaagaaagaagacagacaaggcccttttcctcattcttatcacaggaaacagatagtaaacaaataagtcagtaagcaggataatttcttttttttttttttctttttttttggagacagacagagtctcgctctatctcccaggctggagtgcagtggtgcaatcttagctcactgcaacctccgcctcctgggttccagcgattctcctgcctcagcctcccgagtagctgtggttacagtcacacatgaccacgcctgcctaattttttgtatttttaatagagatgggggtttcaccatgttggccaggctggtatcgaactcctgacctcaagtgatccacccacctcagcctcacaaagtgctgggattacagcatgagccaccgcgcccgggcgcaggataatttctagtagtgataagttctttaaaggagctcagggaagggaataaaagaggagatgtattaatcggagttcttcagagaaacagaatcaacagcatatgtttagatatatagaaagagatgtattggctgggcacgatgactcatacctgtaatcccagcactttgggaggatgaagtgggaggattgcttgagcctaggagttcgacaccagcctgggcaacaaagcgagaccccatctctacttaaaaacaaaaacaaaggccaggcgcggtggctcacgcctgtaattccagcactttgggaggccgaggcaggcggatcacgaggtcaggagatcgagaccatcctggctaatacggtgaaaccccgtctctactaaaaatacaaaaagtcagccaggtgctgtgacaggcacctgtagtcccagctactcgggaggctgaggcaggaaaatggcatgagcccgggaggcggagcatgcagtgagccgagatagcgtcactgcactccggcctgggcgaaagagcgagactccgtctcaaaaaaaacaaaaacaaaaacaaaagaaatagatgtattatgagggattggcacatacgattatggaggctgggaagtcctgcaatctgccttctgcaagccagaggtgcgggaaagccggtgatgtagttccaaatcaagtccaaagacctggcccagcacggcggctcacgcctgtaatcccaacactttgggagaccgaggcaggtggatcacctgaggtcaagagttcaagaccagcctggccaacatggtgaaacccagtctctactaaaaatgcaaaaattagctaggcgtggtggcgcatgcctgtaatcccagctactcgggagactgaggcaggagaatcacttgaacctgagaggcggaggttgcagtgagccgagatcgtgccactgcactccagcctgggcgacagagtgagactcagtctcaaaaaaaaaaaaaattgtccaaagacctgagaacctgaacaccaatgtccagtgtctcagggcaggagaagatggatatccacgctcatgcagagagcaaactcacccttcctctgccttcctagacaaaaagagctaactctctttttgttctgtctgggccctcagtggattggatggtgcccacccacattggcgaggatgatctctctttactcagtccactgattgaaatgctaatcatccagcaacaccctcacagaaatcatgtttaaccagctacctaggcgtcctttggcccagtcaagttgacgcataaaattacccatcacagaagggttgcgattttccatctggaagccctatgggaggaggtgaggtttgagcagggaccttcctgctgagtgagacaggctgagacctcagggaagcatgcccctggcggagggagcagcaaaggcaaaagctggaggtgagaacagcatgggctgcttgttaacctgtttggctggagcagagtgaatgggaggaggacataggttttgtgatcagggagttctcaggggtcagatcaggcagggccctgagagcaggataagagtctggattttcctttctttttttttttttttttaattttcatttgacacctttggtatggatttttttgtttttaatttttgtttttagttctggggtacgtgtgcaggatgtgcaggtttgttacataggtaaacgtgtgccatggtgatttgctgcacctgtcaacccatcacctaggtagtaagcccatgcattagctatttttcctaatattctccctcccccaccctaccccccaacaggccccagtgtccgttgttcccctccctgtgtccatgtgatctatttgctcagctctcacttataagtgagaacatgcagtgtttggctttctgttcctgcattattttgctgaggataatggcttccagctccatccatgtccctgcaaaggacatgatctcgttcctttttatggctgcatagtattccatggtgagacagacgctcgctctgtctcccaggctggagtgcaatggtgcgatctcaactcactgcaacctctgcctcccaggttcaagcgattctcctgcctcagcctcccaagtagctgggactacaggcctgcaccaccatgcctggctaatttttgtatttttagtagagatggggttttcaccatgttggccaggctggtctccaactcctgacctcaagtgattcttctgcctgggcctcccaaagtgctgggattccaggcaagagccaccgcacctggcctggtatggattttcttttaactgccctggggcagcccccagagccatgcgagcaaggcactgagggaatcaaattgacctttttccctctggctgctgtaagaaataaaggtggagaaagcagtgagatgatggaggccaggccagggtgggggacttggaagggacagatgtccacagtcggggctatatggcagagacacggtcatcggagtttcctggtgggttgaagggtgaaaggctagctcccaagttccaacacctcattcaccccagcactgtccccacccacagcccccctgccctctgtctgggcacctgctttgtaccaggcccaggaggtcagtcctgcaggggacacagagacaaatacccataccatggcagcaaacactggcaccagataggtccagagcattgcaggtacagagatgaaggcagctgacccccagggaactaactacccagagctggagaccagaagcgcaggcagcccgccagaatgaatggtgaagggttaggctgtgaagaggaggggaggctggaggagttggcagggaaccgctcatggccttcagtgccaggcggaggagctggaaccttgtcctgacagcagtagggggctatggggagatatatagcagggagggtcatgactggagttcaaaagagcccttggactcccaggcggagggtgggcctgagctgggggcactggaggctgggagcccagtggggacagatcctccacccagtaaccaagtggcttctctggacccagtgactcccgtggactgtggtggcagcagcagtggcagcagcagtggaggaagtgggacatggagccgcggtgggcccccaaagaaggaagaactggtcgggggcaagaagaagggacgaacgtgggggcccagctccaccctgcagaaggagcgggtgggaggagaggagaggtgaggtgtggtgtggtcatgcccaccctgtgcccaagccccagctcccaggctccaggccacaggactgaggtctccatctctccctggaccccgcaggctgaaggggctgggggaaggaagcaaacagtggtcatcaagtgcccccaacctgggcaagtcccccaaacacacacccagtcgcccctggcttcgccagcctcaatgagatgggtaagagcctgggttcttgtaagggggtgggggttccctggccaaaggggtgagcctcctggggctgagcgaagagaccaggtttcactgggccagtgagtggaaggccttcctgggaagggagatggtggcccctggggcatggggggtcatttccaggggcagggaccacccttctctgaggcttctcctggagacagattcaagaacgatgctcgtgggtcttggtcttgctgttggaggggtcatcgggggctgtcccttggcacaagtccccgtggggccctggccagccctgcagcggagtgatggccctctccggttgcagaggagttcgcggaggcagaggatggaggcagcagcgtgcccccttccccctactcgaccccgtcctacctctcagtgccactgcctgccgagccctccccgggggcgcgggcgccgtgggagccgacgccgtccgcgccccccgctcggtggggacacggcgcccggcggcgctgcgacctggcgctgctaggctgcgccacgctgctgggggctgtgggcctgggcgccgacgtggccgaggcgcgcgcggccgacggtgaggagcagcggcgctggctcgacggcctcttctttccccgcgccggccgcttcccgcggggcctcagcccacccgcgcgtccccacggccgccgcgaagacgtgggccccggcctgggcctggcgccctcggccaccctcgtgtcgctgtcgtccgtgtccgactgcaactccacgcgttcactgctgcgctctgacagtgacgaggccgcaccggccgcgccctccccaccaccctccccgcccgcgcccacacccacgccctcgcccagcaccaaccccctggtggacctggagctggagagcttcaagaaggacccccgccagtcgctcacgcccacccacgtcacggctgcatgcgctgtgagccgcgggcaccggcggacgccatcggatggggcgctggggcagcgggggccgcccgagcccgcgggccatggccctggtgagtgaggcgccctgcacccaggtcacagaaaaccccttctttcctcctctgccagggtcgcaagtccagcccagccacgacccctcaggcagccacctcctgcttcttgtggaggagggagggtctgtgtccctttaccgctcactcctggaggcatcgggggtctccaggggactgagacacaggcggcaaactgatgcctataaggccaggcaggtgcctatagcggttgtgaccagcatgaccatcgccaattcttacacagcctagacactgttctcctccatctgttaactgggtgggagatgcggccatagcagtgttattaagtacccacgtcaggcactgtgctgcttgttttaagttatggttattctatttgctcctcacctgcgtggtgaggcaccatttttatcccccttcagagctaagccatgcctgagcttagcccagtgcaggagagtcgggaagaccagggctttggcccccgaggctgccgctaagcagcagttccagaaggttgaggaacatgccagggtccacccagaggagcaagcagctgggagtggtcccagtctaggtcaaggtcccagcactgccacactacagatggaaactggatgcagcaagatccacggatttctcgagagaaaccagaacttgtgcttttcatgtaacagctctgggctttttaatgccaccctctgccccaccccactcacctcctctgaacctctcttaccaggccctcgtgaccttctggacttcccccgcctgcccgacccccaggccctgttcccagcccgccgccggccccctgagttcccaggccgccccaccaccctgacctttgccccgagacctcggccggctgccagtcgcccccgcttggacccctggaaactggtctccttcggccggacactcaccatctcgcctcccagcaggccagacactccggagagccctgggccccccagcgtgcagcccacactgctggacatggacatggaggggcagaaccaagacagcacagtgcccctgtgcggggcccacggctcccactaaggcctgcccaccaccgcccgcctgggcagccatgaatgtagcgccccaggccctgccccagcccgccatgccacaaggtgggggaggccctgggcaggatgttcactctatttattggggaaggagggaggggggggacacttaacttattcctttgtaccccagggggtggagccctgtgcccaccctgcactggggggagggtgggcagggatactcagggacagggcatcatgggggatttggcacaaaatggagcattaaaggtaacccctgccccctaccgcacttgattgtgttcctttttcctttttttttttttttttttttttggagacagagtcttgctctgttgcccaggctggagtgcagtggcaccatctcagctcactgcaacctccgcctcctgggttcaagtgattcttctgcctcagcctcatgagtagctgggactacaggctcccgccaccacacccagataatttttgtatttttggtagagacagggtttcaccatgtcgaccaggctgctctcaaactcctgacctcaagtgatccacccatctcggcctcccaaaatgctgggattacaggcgtgagccactgcgcctggcctagactgtttctttccctggcccaggccctgatgctgggtcatcccagtggaacattcccccccaccccacacaccctccctgggcttctctgggtttctaaggtccaagggatgaggccctccctggtccccccaagaacaccacacaagttatgatcaccagtgacaagtgttttaccaacaaacacatgagtcgggggaagttacatggtgaggtgggagggcgagggatagagaggtccccctggattggcctcagccaattacatcccgagtctgggacccagccccactgtcttcccgctggaggctgcaacgattcatcttcagctgagtcagctggatgtagcggagcacattggtgtctgcaggggaggtgggcagggcatcatctgggtgtcccggggcagcaggtgacttccacacctccctggctcacaccccattctccgaagtatccagcagctcgctcacacagccagtagagccagagcccttccccaaagccccagtcacagtcggcagtccccagtcacagcggagccatcgcacacctctgtgcgcctgtatttgcggcaccctctgccaggaatgcctcttcgcagaggctcccgtcacacttctcatcctccagcgacatctgcaagaagtctgttctctccgagccacttaacaggaaaactaatctcgtctcggctcccacaaccctgcacctgttgtaatccctcttccttcttcattggctcttaatacaaaactgagtgttgtgtctgccctcctgcactcatgtgtgtaagtgcacacatgcacgcacacacacacacaccccaatttcctggcatcgcccacccgagtggatgagtggatggtgcaggaagtgaatgaataggtgtgcgtgaatgggtgagtggaggaatgagtgtgtgcggtaggcaggggtgggacggggtaatggagatgacagtgggtggatagggaagtgactgagcaggtgaataggagatatcagatgtggcaatgacggtagatgagaaatggccggggagatgtcagaggagcgataggtggacggatgtttgaatggcgggtgaagggcggggtggatgaatggatgagtgggcgtgtagggagtaggtgggtggcgcagccctacctagaagcagctccgcgggaggagggctctgctattctgccctgatcttcctgcctgttccctccgctgcagcccctttccccgccctgggcccagccctcacctctgccccgccccgccactcacctgtgggttcccggctgcgggcctcctgcaggtagcgcagcgcgcgtgcgtagtcgcccaggtggtagaaggcaatgccggcacggtaggtggccttgaagttgccctgctgcttctccagtaccttgagacagtactcgcgcacgcgctcgtagtttaccagctccgactgcagcaggcaagctgcgagggccccgcggccggcactctcagagcctgct

SEQ ID NO: 13070 - DNA, 9132 bp, Human
agcctggccaacatgctgaaacccctactaaaaatgcaaaaattacgccgggcgtggtggcgtgcgtgcctgtaatcgcagctactcgggaggctgaggcagggaaaactgcttgaacccaggaggcggaggctgcagtgagccgagatagcaccactgcactacagccagggtgacaagagtgaaactctgtctcaataaataaataaataaaatggctatccttactgggtagctaggggtttgctgatatcctgttctgggaatactgccagcagtttggatttcaggagataccagagtagtgccccttttttttctttctttctttctttttttttttttttttgagacggagtctcgctctgtcgcccagcctggagtgcagtggcgcgatctcggctcactgcaagctccaactcccgggttcacgccattctcctgcctcagcctccctagtagctgggactacaggcccccgccaccatgcccggctaattttttgtatttttagtagagacggggtttcaccgtgttagccaggatggtctccatctcctgacctcatgatccgcccgcctcagcctcccaaagtgctgggattacaggcgtgagccacctcgcctggcccaagcacatgccatttcaatggccttgtgctacacaactcccaccctcctattctgctctctgttccaggttctggccatattgggctcttttttttttttttttttggagacagagtcctgctctgttggccaggatggagtgtggtggcgtgatctcagcccactgcaacctccacctcctgggttcaagtgattttaatgcctcagcctcctgagtagctgggattacaggtgccagtcatcatgcatggctaatgttttgttttcaattagcaataattgcgcctcggataaacctcattggctatgatactgccactgcgcaaagctaatgttttgtagttttagtagagacagggttttaccatgttggtcagactggtctcgaactcttgacctcaggtgatctgcccgcctcggcctcccaaagtgctgggattacaggcgtgagacactgcacccagcccatctgtcgttcttctctctagactgtgagctccaagaacgcagcactattcctgtaatgcatctgtgcatgctttcccttggtagaccctggaacacagcaggtgaatgcttcaagggacagtctcaaccctgtgcaccctgccttagtggctactgaatgcttgcatgattgcatttgaacctcacaacagcctgagacgctgccagcactcaaaaaattacctgccatctcgctgttgagaagaggggcctgaaagaggcgatcaagctgcaaacccaggctcagaagccaactgcctggatttaagtttagctcaattccttaccagatatttggcaagccacttaatatttctctctctctcttttttgagacggagttttgctcttgtcgcctgggctggagtgcaatggcacgatctgagctcactgcaacctctgcctcctgggttcaagtgattctcctggctcagcctcccaagtagctgggattacaggcgcccaccaccacgcccagctcttttttgtatttttagtagacacagggtttcaccacgtgtgccagactggtctcaaactcctgacctcaggtgatccacccgctttggcctcctaaagtgctgggattacagggctgagtcacagagcccggccacgccatttaatctctccaagcctcgtttcctccactgtacgatggggatagcacctacttcagagattgctacgccgaataaaaggagctggcatatcatgcctaacatataacaagcacgtgatagaggtcagtgactagctttagcctcaggccagcagcctcccgctctccctaccctgcgcgccccacgtgcctcctgtaaacaagagaacgcgcaggcgccgcaaaccagcgcccattggtcggcgtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcgaccgtccgccgggtgaggacgcgccgggggcgggggcgccaggcccgggtccaagggataggagctttgacctaacattgggatggggcctgcccgctggacgaaccgatctctggtgatggggaatgggcagcgccgcacgggcggggccttgggcgccgtcaagggccgactgtgcccgcctcacctactcctctctccaggcgggccaggggtcgctgtactccctggaggccaccctggaggagccaccctgcaacgaccccatggtgtgccggctccccgtgtccaagaaaaccctggtgagtgatgaggctcttggggttccccgccccgaggccgagtaaagcagcagttggatgatgacgggtcaggtcaagacgcagggatctgaggtagctgctgccccaccttgagccacttcccaggccccgagggctggaaaccaagatgctatgaaggggaggatgccccggtgcaggccgtgcctcactgtccactgtgatggggtgattgccttaggggtggctctcatctgaggagcctccagctccatcttggccagatcttgctccccagatccagatccaggcccccagagcagcttcttcctctccctccagctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggtgaggagccctcagcttgaggagccctcagcttgaggagccagccgctgcctcatcacccttctcccttccctctggagtgggtttctctggtcagcctaaagactggtctgcctatccaggacttgcctgtgaagatggcttcaatcttcaagaactttgtcattacctataaccggacatatgagtcaaaggaaggtgaggacccagccttggctgtacctgttcctatcagaacaggactttccccccaacttggcaccttggtgtgtgggaggagaaagacaagaggcagtgtacctgttcaaggaccccataattcctgagctctccctaagccttcccagcctggcagccaccctgagtacctggccccttctcctaccttatcttcccgctcagaagccatgggtcttggccgggcgtggtggctcacctctgtaatcgcagtactttgggaggccgaggtgggcagattacctgaggtcaggagttcaagaccagcctggccaacatggtgaaaccccatctctactaaaaaaaaagtacaaaaattagccaggtgtggtggcgcacacctgtataccagctactcgggaggctgaggcaggaaaatcacttgaacctgggaggcggaggttgcagtgagcaaagattgtgccactgcactccagcatgggtgacaagcgaaaactctgtctcaaaaaaaaaaaaaagaagctctgcatctccatcactctggcagggtgggatggggcagaggctggattttttgtgctggagagtccttgacaacatggcctttccccaccacctcttgtgggtggtgtcctttagaccccatttactgcttttgcacctgggaagtcatcacttcagtttggccctaaaagttgatcagacctcccactccatcacttgcatgtctggcccccacccctacctgctccccggggaaacccctgcctgctagccccaattgcccttccttttatctgcctggggtcgaacccctcctcttctgctccttggtcctcagaagcccggtggcgcctgtccgtctttgtcaataacatggtgcgagcacagaagatccaggccctggaccgtggcacagctcagtatggagtcaccaagttcagtgatctcacaggtagggatagtggccacagtcctcatggatccaggaagagacaggaccttgctcgcaaggcctctggtcaggtctggcttagaacactcttcctccccatgccctgcccacctttgcccgcagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccaggttggacccctggaagtgagggtgggacatgggcactgcactggggctgacgaaggggcccggctctgactccaactccacccatctcttgtagggcatgtgtggctcctgctgggccttctcagtcacaggcaatgtggagggccagtggtttctcaaccaggggaccctgctctccctctctgaacagggtgagcatctcgctctactcctctgtccccagcctagcccctcaggagggcttcttgggaccagccttctgtctcctagagctcttggactgtgacaagatggacaaggcctgcatgggcggcttgccctccaatgcctactcggccataaagaatttgggtatgcattaatggggtcaggaggggcaaccggagccacttctccctgtacaagaagttacttcataatgggggggagacatgagcatgagagttacacagaactgggtccaggtcttaatgctgacccagccaggcgtggtggctcatgcctgtaattccaacactttgggaggccaacttgggaagatcacttaaggccagaagttcaggaccaggttgggcaacatagcaagaccccatctctacaaaaaattaaagacattagccaggcatggtggcttgcatctgtagtctcagctacttggggggctgaggcaggaggatcgcttgagcccaggaggttgaggctgtagtgaggcatgtttgtgccactgtactccagcctgggtgaaagactgctgggatgagctcttggtgaggagtcagaagttggagttgagttctgtctctgccacttttcttgctggctactggtccctcctccccatctctcccagcctcagatgtgtcatttctagaatgaagacattcttcagaggggatggcctgtggcctggggtggacgaggaatgtgaaacctcgcgtagagggcttagttcatttctggctgtgaatggcaaatgggagcctgcccttctctactcacccccaccgttccccaggagggctggagacagaggatgactacagctaccagggtcacatgcagtcctgcaacttctcagcagagaaggccaaggtctacatcaatgactccgtggagctgagccagaacgagcagagtgagtgaggggcagggtgaggtgaggtcaggtggggccggggcctgggtgcctactgatgccaccccttcccatctcagagctggcagcctggctggccaagagaggcccaatctccgtggccatcaatgcctttggcatgcaggtgaggccctagccccactgcccctgccccatctcttgttgacctccccgacctcttcttggagtcgatcccctactccttctccacctccagttttaccgccacgggatctcccgccctctccggcccctctgcagcccttggctcattgaccatgcggtgttgcttgtgggctacggcaaccgtgagttccgctgcctgtcctgcatccagccaggccacaggcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaaggtgagtcttgctggcttggcccctggccctccagccgccatcctaccctggtgccctcaccagctccccctctcccccagggttactactacttgcatcgtgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgagtgtggtataaatgctcagtccccgggggtgaggagagatggcagggactcctggcgggtcaaggtgggatagctggtcctgcccaggagcctgaggggccagcttctgcttcaggaactaaaaggagatggggagagacccagagagggatctttattcagaagcacttggctggcttttctcttaggcccttgctccgagggacggatgggatcagccacagggtgcatcctctctccatcttgcatagagaacctcagtggttggggtcaaaggtcgctctccccatagagggcactggagaaggccacgtagtccagggctccagccggggccccggatcccttgtagggcaccatacggcggatgcagtactcggcctgcttggcagggagctcgcgccgcagctcctcgggggtgatgtagttctggggagaagaggcgttgaggacccacaggtcccgtgccctgccctagcccaccagcccctccaccgcctgggactcaccttgtctcctgccaagatcttgaaggaagctacaacttgctcagtcgtgtcagtctcggctgtctctcgggtcatgaagtctatgaaggcctggaaggtcaccaccccagctgcgttggggtccaccatggtcatgatgcgagcaaactccacttccccctgcagggatagaggccaggcactatgcccatgagcactaaagccaggagggctcccagtgtcccctcctggggactgtccaacctcagctagcagagccccagtaacaagggagttcccttcctccagagaccttagccctggctgtaggaagtcctttatggtaggctgaaatctgcatcctacccacagcaggaagcagatttgctccctggtcctgattttttttccagggccacacccgtttctgtagtgctgtttccctacaggtaaaaatgttgcaagctcagactttgggtccacacagaactgggtccaagtgagttttacctccctgagccttgctagcccctgtgtggatgtagtgaagatgcaggggatggtgtatgtgaagatgggaggtgcacagtaggtgatcagcacagaggagggggtactttgggactcctgggaaggagctggggagctctcaccaggtcatagcccatggagatgaggcaagctcggaagtcatcaggctccatcatcccattctgcttctgtagggggtgagtggttatcaggcttggtctccagcctccaccagcccccaagtgtcttaccccacagggccaggcccctgctgaccctgtcaaagtggttgaaggatgctcggaactcgttgagctgctcctggctcagtcccttggcgtctcgggtcagtacctggttctccacttcattgatggtgcgggcaatggaggtgagcagctgctcccagcccacgcggatgtgctggcggtcaggggacaggccactgtcagtgggcggccagtgcctggccactggctctagctccacatccagttcactgaatgaccctgggcaagtcctccccctcactgggcctccatccccatctggaggctccactgagtaacccacccccaccccagcagtccttcctgtcttttgataaccagctatggccaatcttggcctggttttggacggctttgtgactctggaagggtcactttccatcgctgggtcttaagggacctggccaagctgaactggggactctgctgggacacacatgctctgtccagctgtgatctccctgggcctcctcagccagtgctgcctccccactctcctgagagggtgtgatcccacctccatgctgtagacggtgtgcttattgtcgaacaccaggctctcctgcagcagctggtggtcaccctccagccggtcaatgttagtcttgtagttgataatgttctgctcctgctgccgtagcccagccatctgctcctccagagagccagctagccctgctgccagcc

SEQ ID NO: 13071 - DNA, 22928 bp, Human
ccctcgggatcctgaaacacccctcccacctgccagtacccgccaagatgggtccctgatttgctgtgtggccttagaccagtggctgccctctctgggcctcactcccagctgagacctacaggctcagcccctgcccagccctgcctggcacccgctcaatctggctgagctccagagaatggcagggctgggctgtcacatgctgagccacgtgactggcagtggctgggggctccatcccacacagaggacaggggctctgcagtccttcacccccaccctaactatctaatcacgggccaccggtgtgggcatggtccagaagacctcaccgccctcccaggtaggcagggagctggcgggtggggggggccatgatgagcacctcccaggtgccacgttggcccagaggccccggggccgggagctacggaggcccagggcaccagggagatggtagcagcggcaggcccaggaaggggcatagaggaggctcttcctccacacctgtcaccctgtcccctgcctgtccacacccacagcagcttgcacatcatccccacagcacgctggctctgacaggtgtatccggggcgggctgggggcaggcagggacaggcttaggcacagctgcctgtgccgaacttgaggaagatcgggactacaggaaccaccaaggcgacacgtggcatcatgaccacggtcctaagcagagaggcaggcactcctcctgggaggcagaggggacatccgaaacgggtgcagccccagctctggagcaagaagctctgccacacacacgccccatgttcacatcccaccccctctctgcccccacttcctcgtttgtaaaatgttagatctgcagaaagacaggctctatgaatggggcggcccatggggtggtgtggaggaacacggaagcacagggcgctgggagaggagcaggcatgaggtatggtccctaagatggtatttctagactccagccacctttgggtctgacctctttgttttgcagaaggggaaactgagtcttgggtagggtgtagcaagacaagccacagacaaaacacctcagacactggattaaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgcgtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggtagagtatcccggggaggctggggctgtagtgggccagcagtcgggccagagtccagctcagcaactccgggttacaggcagcccaggcgggcctagccaccggcagctgcactcagaggccactgtgtcctggctgagctcatctgcctgcctgctgggggagaaagcggaaggaggagaggcagatctggggagtggcagcgaggtcccgggcacccccctggccagcaggcacccttccgttgtccgagctgggttgccaccgcctccttttcctgggattcccggacaccctccaagggaaccaagggaacagctctgggtccagctgccccaggaaggactgtgcgccccttccccacaggggtcaagtatcccttccagcaacagccgtttcctgggcaccagcctgcatgcccagtgctgatgcagggatgtggccatgaatgactctgggaaagaatcattcttagcaatggactttgtcagggtccaagaaaggagtggccagccagccccgccccgcctgcaggaggcacttctcatcccgggaactgtgccccatcagggagccgaggctgttcagcctctttgtgacccggggctgggttggcccgagccacaaatgaggggatacgctggtccctggctccccaagggaggggctgctgagctttgggaggcctcatgaaaatccagcttaaggccatcaaaagacaaaatgacaacacatttagttatagatcaaattggcttctattcatgattcgtgaatccggacagcctccattctacaaaatggagtgagagctcccaccaggcagtggcagagcagggggttcataaggcagaaaggaggaaacagaaaaataggaaacaccaaaccgcctaataccggatcgctgcagactgcttttttctaagcggactgcttttttctaaggggtaaggcagaggggacctgatgatgccggctcaggtggactggaatctcctgcttcccggagaaactggtctgtggttttgggctctgtctgcttccttaaagcttcggtttgatgatgtggcatttggcatgagtgcctccattttggtttggtctggtctgttggggcctagtacaggagctcagttcaaaatcacagcctctcatcatgtttgtttaatgaagctacactgcaggagatcagaatcggagaccctgcggtattgggcctgtgggtcccctgaagttggcctagtgatccccgccttctggctgccctgatgggggtcccccaggccctctacccaccatgttcagtccctctgtcaccacatccctgtcctcagttgggtctcagggtgatgtccttgtctccccaacacccaccttggatcaaggccccttcaggcccctgccccaggggtctcctccctgagccctcctctggtacatccgtcctccatggatactgagcacttcccggggtcccagtgcttgaattctcccgacagtggtatgggtgccacaggcagtgcccaattttacagatgggaaacgtgaatacaaagaggtcaagcaacctgcccaaggtctccccactcacacatgtggttgctgcagtttaaacccaggtcattgggcccccagaccatgccatgctgggaggatgctcttagaaggcccatggtgtagatgaggaaactgaggcaggaagaatgagagaacgggcagagcctccgtttccctggaatccaacccacttgataggccagggtgtgaacgagcagggagtccctgcccagggacggtccctgctgtgaggttgggggcagcggctcggccagccattcactccctgtgatatgtcagccccgttcctccccactctgttcccggagcctgtgggcacccacagcgagcacccaggctggcatagtgcccagcacatgggcacctgagtattgtttttagaggcccgtggccttgagaggaagtggctggtcctgccctggcccccaggccagaggaaacagccgctatcttcatcaccaaatgatgtggcaactcccccccaccccagaagctgcaggtctgggccaaatgcacctcaacctgtgatggggggccacgccccagagacccttgggcccatcagcccctggacctcagtggctcagccgcaggaggcaagaggcagtctcagaccccacaacctaagcagtgtggggagtggcagcaatagtgaggagggaggccgaggaaatggaatccaaacagcaagagacctcccctcaccggtcacccctcccacagctggcctaccggagtccacccagccttgggtctgccgtccaggccccagcccagtgtcccttcccccaaggacttggctgcccatccccaggggactgtgagggaggtgggagctgaggtggatagccttctgctcttctggatttgggttttccaatgtgaggagctgggtggtatcaggcaagctctggccctctctgagcctcagcctccatctccttcagtggggtgaatagtggtccctcagtgggcggccgtggtggtgaaatgagcgagggcaggcatggggatcacactccttacaacctcacactgtgggatgagtgccgcgggggtgggcttgggggaccccagcccagtgcctgattcaggagttccctattctgtgtgtccacaatggctgcccagcaccctcgggagataacaggcccaggatccccccaatctcaggcagaaggcggccttggcttctccgcttgccagggtcctgccctgggcactccctgggggcctcagtccagagtgagtgacccgtaggggcaatgccagggctggttgccctgtgggagagatgtgtcctgtggccctggtgagttggtttcagcgttgctaggagggttgctggaatgttccctgcagaactccatcccccacagagctcccggcccacagtccaccattcacgttacgtgccttgcatttttgtggtttctgcagagattcttacaaagggtgagagaggcacaggcgtggtttgcctttgaccactggcagaagtctgaaggtgagagtagaatggagaaggacccaggagagtgcggagttgagggagataaatatttgcaggctacttagcaaaacacccagagctgacctttgtcgagtactttctgtgggcacaacagcaaatgttttatgcagcgtgatgtcatttaatcctcacaatgacaccaggtgccattagcatccccatttcacagatgaggaaaccgaggcagagaaggtgagtgatttgcccaaggtcccacaaccagtaagaggcagagcccggagacaggcctgatggtggctcgagaggctcgttcttggctcctgggtctcagtcctgctcccgtgacgagccatcccctatggggaccatggtgcctgtcctgtgtgcgggccactgcccagcttctcccaatcagagcaggaagatggtgggttcagcctggccccacaatcactccagctgagggctggcctggggctcctgaccaggctctcagtagcacactggtccagcagggccatcctgcagaccggagcaggtcccgccctcaaggtggccacttaacaatcacccacagccttgcgctcaccgatgctgggccctgggctcagaaccgactgtgtggtctcatcattagctggcaggtgccatcattacaccggtaacatgagaggcttcaagcactaggtctcaaataagtaggcacagaggggcctgcctcccagtctaatgagggggaaataagggagatgtggacagggttgggaggtgggtagagtgtaaccagacatttatcacatggcacaactcagaacgctggggagcagagtcaaggggccactgtgacagtggatgagggcataatctgggtgggctgcctggaggaagcatcagccaagctgagatctggaggaaagggactcggagagggaaggaggaaagggtcaccacgggtccttggcaccaggccgaggaacgagtgcgtcagagtgctcctccgatgaacttcaagtaaacaggcagggctcgggggaatgtctaggcccctaccctgcctgccagctctggctggcaccagcacggaggcaggaacgccctctcccccgccctgatcctctcccccacagctgtttctgcctcccagcaccacagccccggcagggtgggcagcagggcctccaggaggcccgaggtgttctccccctcttcctgaggaagctgaggcacagggagaagaggctattgcccactggcctggcctccctgggcagtgcccccaggctggggacagaggaagacggagaattctgtgtctggagtgctccaaggtggtggccatggtggcagtgagtcaccccctctactcatcaagctcctgcttacaccattcagactggcaggggtgaggctgccccgcctccaggaggggcatcagggcagggcagaggccatggcttggggttaatttctgtgcggcaggaagaagcatggcgctctgcctgcctgctcaccctcgggggctgtggtggagcagctgtccccaagcccacacccagtcctgcagccgcctccaggtccatggcagaggggagtggtgcgagggtcttcatgtgtgtctgggagtgctcactgttgggtgaaaggggttgcaggcagcctcagtccctgtggggtcatctgagtgggtccctgtgtgtgtataaggtagaggtgtctgcaagcccctgtgggtgcaggcaggtcaggggtgcccagaccctggggcggctgggtggtgcccatgaaggaggggcagccctggccacccagttcatgccaccccatctggcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggtgggctggggttgggggtatgagagggtgcactggggcaggggggcatggagggcagctgggacagcaggggatgaagacacctgcgccctccatgaagcggggctaaaagcagctcctcccctaggccagagccacccttgcacattcatccagtcacttatttctgtattcatgcagcaactatttgctgagcacctactatgtgccaggtactgttctaggctctggggatatagcagagaataaaacacagttcccatgcctacgaagatgaccttctatcggagacaataaaacagcaaataaataattgcacagcaaggccgggcatggtggctcacacctgtagtcccagcactttgggaggccgaggtgggcggatcgcttgaggccaggagttcaagaccatcctggccaacatggcgaaaccccgtctctactaacaatacaaaaattagctggatgtggtggtgggcacctgtaatcccagctactcaggaggctgaggcatgagaatcgcttgaacctgggaggtggaggttgcagtgagccaaggtcacaccactgcactccagcttgggcaacacagtgagactccatctcaaaaataataataaagataataattacacagcatattgggttgaaatatgtgccctggagacacacccagggtgaaggggagagagggggccaggatcagggtgctgttgtatatgtgggggtcagggaaggtttctctgagaagggggctttagagcagagacgtgaagatggaggggaggctccccatggatgctggggagatggcagcgggcacagcacgtgcaaaggccctgaggcaggaggtgctgggtgtttctgcttgaggagcagcaaggaggccagcatagctgtcgggggtgggagaggaagaaacagcaaagatgaggtctggggtatgggccacactatgtagggcctcggaggccgtgaggccttggccttctctctgggtacagcaggcatcatggcctctgtctagaccctgaaggcttggggcctcagcccctcccaatcccagtggcagccaaggcagaaccccaagaaacacacttcccccaacccctcacccatcagggcccatgcacctgcctgcccctgcctcaggacacctgcccctgcctcaggacaccacctgcccctgcctcagcacatctgccccaggggctgcccccggctcctattctctggacaaaatatctcctccctttgccttgaaggctgtagtgttcagaccttcccccagcccattgggctccctggggactgactcccccgccaccactgagcttctgccaccggccgcctgccggccttcatgagacttgacctgacgtctgtctggtcccttttctcccttcggctctgattccacctcctgccttcccatcccagctgcaggagcggggccctacaaaggcagcagtagcccagaacattcaacctggtccctccctctggacctggtcacccccctgtccccaccctcagcaggcagcatctgcccagcgtcacgtgcaccctctcagttaaccctttggtgaatctggttgggcaaccacacccagtggcccccagaagaggctcagagagagtgtgttcttgcccaagggcatgcagccaggaagagcagagccagagtttgaacctggctcaaaatagcccagtctcccaaagtcaggtcccaggtgacctaggaggtgtggcgggcaggccaccaggctcatggggccagagcacaggctgtgggaaagtccgtgtggaaggcaccttcccccagcctcagtggctaggaggtgccagtgggcgtggcgtcttcctccctcttggggctcagctgtagccctggccttgcccctggttcgctgagtgacctcaggcagggcatctccttctctgggcttcgctggtcctctggcccatccagcaccccactggcccgtccccctctgccctgacccgggagagcctgcaccccataacctcaggcgctgcctcagccagggagccagcctggccccagtgtccctgacctgttctccagcggcctgcagcctgctgcctggctggtctctcctcccttggggcgcagagggcagggagcactggctagccgagagcaggacaatgtccctattgattcgggtctcctcactcctgcttagaagcctgacagtggccctggcccctgggctgtgggaactgacagcatttacctaggggtggctgtgcctgtgtctcctgtggaccaatctccaccctgctctttgggagactgaggtgggaggattgtttgaggccaggagttcaagacctacctaggcaacacagcaaggcactctgcaaaaaatcaaaacaaactttttttgaaattaaaaaaaaacaaaaccctaagtcagatcccatccctgctcttctcaggagtccttgcctggctgcctggccccctcaccttgcccactctgcttcttgctaaacaggagcagagcaagctcacagccacctcggggcctttgcagccgccagggcctctgcccaaagtatgccgcctcccagtacccacgacttgcttgttccttgccttcaggtcactgctccaatgtgaccgccgcctggagacctgcactgaccgctttgtaaaaacagcacacacacacatgctcatgtggatgtatacatgtgcacacctgtgcacgcccacagccacacgctccagcagtctccacccccaccctgctccatgatttccctagcacagccacgtcctaatggagccgtcagcgttctcactttcacatggaacgactgccccctgcaaggtcggcctcagggccggtccctctgtttggcacagagacagcacctcacacaggaagcacgcactgaacatggagtgagtgagtgaacgaatgaatgaaaatgaatgaatgagttgtggaagcaggccctgcctggaggaggctgtgccctcctgccaactctgggaatcctggcccaccctgaccccacccacttcctgcagtcagccttcgagtcggaggtgtctgaggttgccatcagccagggcgaggtcaccctggccctcaggaacctccgggcctggatgaaggacgagcgtgtgcccaagaacctggtgagccggccgggctgaggcgggcagggggctcaggggatatttgctcccacagggtggcccctctgggtgggagctggctgctgaggggccggggtgctgagcacttaatttcatccccggctcccggcccaggccacgcagctggactccgccttcatccggaaggagccctttggcctggtcctcatcattgcgccctggaactatccgctgaacctgacgctggtgcccctcgtgggagccctcgctgcaggtgagagctgggcctgccccttccggtcacccttctccgctcgaggcctcagggccacccatggatcccaggaggacatgggagaactggcccaggtggcaaagaggactgtctggtccaccgtccccgggctgtgtggccctgggcccgtcatgttacctctctgaaccaggttctgcatctgaaagtgggtgaggctgatgcctgccctgcaggtgtgtggagaccaggagctggctacgcctcctccagctctctccctgcactgccctgcagggaactgtgtggtgctgaagccatcggagattagcaagaacgtcgagaagatcctggccgaggtgctgccccaatacgtggaccaggtgagcagggctgccgggcaggtagagcgggaacaggcagggctcaagggctgggcagcccctggcatggaagggcctgtcagtcagacccgagtccccacctcaatcctgcctcttctgagttgtgtaaacttgaccaagtcaccgcccctgtcagcctcagtttccctctgaggagcagcgagggcagcctgttgcccaggggttccgtgtctgcctccacctggccctggcatcagcccctccagcgccagctggactccaagctgggcctgccaatgccagccaaccttggggagctcccttctccccactttgcctccacccaaccctcctagagccctggctgggtcaggccaggcggggtggaggcagggcagggtccaggcagggcgggctgctcccttgtgttctcggagctggggtcccagaaggagcctcacccatcccgccttgcagagctgctttgctgtggtgctgggcgggccccaggagacggggcagctgctagagcacaggttcgactacatcttcttcacaggtgaggccgggacgagggtcgggacaggctggggtcggggaggacagctgctcaggggtcctgtccctaactctgggagtccacagggagactgaattctcctctctctctctctctggaccaggctgggagcagtcctggacccccaggaccccttaggaagggatggagtcccatgtccagggccagcccactgtgccaaccacagcgtcaggaaccatagcctctgcccccactgtccccagaccctcatacgtgaccctgctgccccccaggctcttagacaccaccctactggtgcccacagccctctctgcaggcagatgagggactgggcctcagtgtcctgcccagggtcaccctgctggccaggatggggacaggctggaatgtgcacacaagcccttggagaaatccacgccagaggtcactttttttttctttttttttgagacagagtcttgctctgtcacccaggcagtggcacaatcttggcacaatcttggctcactgcaacctctgcgcctcctgggttcaagtgatgctcatgcctcagcttcccaagtagctggggtgacaggcatgtaccaccacgcccggctaattttttgtatttttagtaaagacagggtctcactctgttgctcaggctggtctcgaactcttggcctcaaccagtcctcctgccttggtctcctaaagtgcagggatcacaggcatgagccaccacacccggcttcgagtttttgagctagggaggggcagagggagcgagaggaagacagtggtgctggcaggcgagtctgcgccttacaggtcgaggcagtcgtggggaagggcctggcaggattgacctggccgcctcccagcaaaggcaaaggagccctggaaggaaccacagagcccaggaagcactgtgccaggatggggcaggggtgagagtagagaaggcacagtggctcctgccggctttaatccttgaccacaagggggagaaatgccagggccatccccacagacgcagcagcgtggtccccgagtcaggtctggagaggaggccttgaggcccagacagggctagggcagagaaggctgtgtgcatgcggagactgctgggcccctggaggccagcacagaggagaggtgaggccaagccaggcaggacatggggacgcctgcatcagcctgggacagtccacctcaagggtcagaaaaaaagggctgggcaggtggcagaacttccaggtttaggtttagagaagagagacctgaatgccgtagacagagctggactccatccttgggtgataagggatccccgaagtttccaaaggagatgggtggggaggggttccatgcagcattttgcaaagagtcccctgcagggtcagccagggtcacaagcagaggcgggaggagccaaggggtttggctcagcagggggaccctgggggccgatagcagccgtgcaccattccctcctgagactctgtgcttaggggctggtcctgatgaaggatgagcagggccctgggctgcagggtggcagtgaggaacaaggaaaggccaggcgagggctgctgcccgctgactccaccacctctccagggaggagcggggccgtgggctgggccatcccgcctggtccaggtcactgaacggccactctggtttccttccatgcccagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcggtgagtcctgctgcccctaccacagcccacctgggccaagacccctcctcactggagggcccaaggctgggccacaactctggacccgcgcctgaaacctggccccactgccagagcccggccttgagccacagctccagtgccatgattccgtctctgtgcttctaagtctgtggccctatgaggccaaactctggtccctcaccttggattcgctgagctcagatcccagggctccagggctcagcgtgctaagatgaactcccatcccaccactggctatcctgaaaggctgtaacctcagattctccgagcccacaatccccaggttctaaactccgagagtcccgtcctgagcccccagtctcctgggccgtacggctcagcagctcatgggacactgcggcgccaacattctgggacgctgttgcctcatgaactccaagggttctaagatcccatcacccctgactgtgagaccaaggtcgggggattctctgtgtcccacaggccctgagcaggctggggaagctctagagtcccttctggggggctgtggggagactttcttccctaaacactccaaagcctgaagccttgggaagtcagaccttgggatcctggcctagagccctggcctgtggccctgtccccacctctacccccacccctgggggcggtcctgactgtggccccagggctgagctgtctctggtgcctgcagcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtgggggtgcggccgggctgggcagggtcaggagcccgcagtgggcagcacaagtggtggcagcagggggggcaccaaaatccagtggcttcaggactttgggatggtggacctcttggctctgtctctgcccactctcctggaagcagctgagcctcacccaccccaaccctgtccccagtctgggccccactctcctaggccttcagtgggcagcttcctggggtatgggccttctctagggtccagtgtttcctctaggtcagcccctgcctttgtccttcttacacatcggggcctggtggccacatgacccctcaagcctggctctgaaggcacaggcaacgtgtcggggatgacccaaaggtgcaggtccaagaatgagccctgatcccctacccctgcttaagctgcagaggcagcctgggaggcccaaggccagagtcctcagattaaaaaacaccaagaggtaccagcagtccctacccaccccgcccccttccccggccctcagccagttcctcgattccctccacttgaactttttttttttttttttgagacagagtctcactctgtcacccaggctggagtgcagtagcacagtcttggctcactgcaacctctgcctcccgggttcaagcgattctcctgcctcaacctcctgtgtagctgggattacaggcgtgtgccactatgcccggctaattctttgtatttttagtagagatggggttttgccacattggtcaggctagtcttgaactgctgacctcaggtgatccacctgcctcggcctcccaaagtgctgggattacagggatgagccaccgtgcccggccacttgaactttttttaaataaactttgtattgggaaatacttttagatttacagaaaagttgccaaaatggtacagagagttcccatgtaccccacacctaatttcccccatttaatggtgcttagatgggtcaaaactaaaaaagtgatggcagggctgggcgcggtggctcacacctgtaatctcagcactttgggaggccaaggtgggaggattgcttgagctcatgagtttgagaccagcgctggcaatatagcaaaaccccgtctctatgaaacatttttttaagattagttgcgcatagtggcgcacacctgtaatgccagctgctcgggaggctgaggtggaaggatctcctgacccataaaaaaaaaaaaaaagtgacagcagtgctttactattaactacactctagactttatttggattttgctgtttttccactgacatcctctttcggccccaggatccaagccagggtcccaccttgcattaataaccctctcagcttaaggagtgctggacaggtctcctgtagaacatccccagcctcaggtcatctggtgtatttctcatgattaaagaaaggttactggttttaggagagaatcccacagaggtgagcctgcctctcacaccacatctggggcacctgagatgcacacgtggctagtgagtggaaccttcactaccgggtcaggacggtatctgccagggtttccctgggaagctactattgtttgtttctttattatttggaagcaagtctctaagcctaccccaccctcaccaggtggaggtaattaagctgtatgctgctctatcatattgttagttattatctagttattttatacattcttttcttattccatttgtggtttggtggaattttgttgtattgccatttgatacctttctcttcctcctttgtatgattgttttatagggcctgtgagttttgtacttttgtgtgtattatggcaaataccaacttgtttttatgttaagactcctttgagcatttcttgcaggactgatctagtagtgataaattcccccagcctttgcttgtctgggaaaggctttatttcttcatctacgaagcatagtcttagctggataccgtattcttggctaacagcagtatctacatctatttcctggaattctgtaagaaagattcatctcttgaattgtttatttaggtcactacggactcaggtatatttatttgactccaggggctgtaatccaaggtcgtgtggtttgtctgaggctcgggctcagaagcccatgtaagatgtcccagcctcttgggttgtgaccacctccttcccctctggtgctacaagcagctccaggctcatcttgtatctcccctgctccaactccagaagcagccattccttcaaggagccctgcttcatctggatactttcacctttagaaaactctacagaggttttttgacagtggagtcatctggcttcaaacttttctgaccacccagaactgatcccaggacacacagtcacacctaagacacaagtcatgcacaaggtggcttgcccgtactacctgggacgccctctgctgccttctgctccatctcctccatctgctgccactgccattgtgggtaatgctggtctcatgccatgaagtgacgtctgaatccactgggggcagtccgctttccccacatcagacaagccctgacccagctgtgatcagaggttcacggtgattgcaactaaatatactgaagtttttgtgcagcaactatttagtgtctaccaatctttttttcctttcagtcttcaaataagtctacagattgaggaagaaggtccttctcaaggaccttcaagcaagggccaagcttctgtttctaaagtgcaaatctgaccacatcattatgttttcatgtccctgtgctcacaccacacagctcttcagcctccactctgtctgcagtgccctctttgcctgaacaacttctgtccctcccagtccctccactcagcaggcacatgacacccctctcctgggatgcctccctactgtccagtactgccctgctgccactacaccctccatgtccccaagcaacactaggtttcctgcccctacccccagccctaagagtctgtgccatcagcatggaccacacatgagcagatgtccaggaaacatgtcccaagttggaagcttcatgaggagctgctacacaaccccctgccccacctgtaccatcacaggcccttcagctgacatggtggcctcagaccctttctgaggcaagatcagtgtcacagagtccagcatggaacaggctctgggtcctgaggatcctgatggggctcaaggcagcctcacgcacatcctgttctctcccaggtggtcaagcgggtgctgacccagaccagcagcgggggcttctgtgggaacgacggcttcatgcacatgaccctggccagcctgccttttggaggagtgggtaggtgcctgctaccctgcccttctgttaccatttggtcaaattgcaatagtgttacctgcatacatttctgccaaagcaccccagccccacctcaatgtagagggacaggcaaggaggcctcaccccagaacccgcatcctgctccccaccccagagggtctgagtccaatctgggcaacacagtaagaccccatctcaaaaaaaagtctgtggtggaaccttctagaccatctctgcacagacacacaatttagtgaatttttaaaaataccacacaactatgatcacactgcccactgcgatgctatttgctcttctccccaacagcatgacctggtgtctgcccctcagcagcaatgccgccggtgtcctttactccagggcagctgctcctctaaccccatcccccctccagctctcagtacaacacctccccaccctgagaggcccggatgagtgccaatcctccaccccccagagcagccccgatgccactgcagagtcctggcctctgagtcaggaagcctcagagatggtcctagcaacacgctgaaggccctgtggcccaggtgacatctcccctttctgagcccacttcctcctcagagaacagtaggccccgagcaggtgacaggcagtcccgccacctgtccacactcagcaccacagtgaacgatggcagggccaggcaagctgcctcaggtgggtccatgcccttcctggagggcagccaggggcacaacagtgcctgtgctgctgtcctggctcggctcgagtttgggcggctgcccccgaccccacctagctgcctccccagccccagccccagcctcctcaacccgcctccctgccctggaggagagtcggggctgtctgtgggcacatctgaccctgctgctccctcaagaaagcctcccccagctcccaggcccccgagctgacccttcttggtggccgtggccccaccccggcttccccacctgctgctcccacagcctgagctctgcccaggtccctaacacaccgcatggcacccacctctaaggctccccaagcctgggtccctcttgcccccacccactctcttcgtcttattaactgcatatccttggagctcactcactgcaggaagccccccagccaaccccactccacccaggctgtgctctgaacgccctggcctggggcctcgtctgcctcccaacctagacgctgaggagagttcactgcacatagcacctactgggtccaggggtctcaacatcccctcaatccccaccacaaccttaggagggaggtacccttgtcaccccacgacagaggagactgaggcacagtccaaggtgacatggattgtttgcagcagggccagagtttaacccccggcagtctgactctggaatccatgcccttgaccaccacctgcctatcttgccctggcatctggcatccccagggcttactgagctggtgccaagctcggggccaagccctttacacacagtgcctcatgatcagcccactggacagatggggaaactgaggctcagaggggagaagtagcccgcctaggccccactgtctgtgactaggagacccccagcgcctgaccacctgtgttctgtgccactgtacaggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaatacttacatctcagtgatttgctttctgtgcatctagcaacaggactctggaccaaggccctggcgttgggtaacaattctgtaatgctgcaggacttccccaatccacgcaggaatccccgcaggcatccacgcaggaatcacctgatgaagggccagggtcaggtgtgggccaccatcccaagacctcccttctctctagggccagcccctctcctctgagcacctgctgaccagcccaaagccctctccactcctcagcttgaactcccccagggtctccctgtggcccacaggtcctttggaggctcgggcatctgcatgcaaatcccaaaccactgtcccctttgcacacactgagcctgcccttgtcctcgtcctggtctaccatgcgtgtcctccctctgcacgggcatgggacatgccctctgcctccttcctgtcctggcctgcccaactcctacctaccctcagcgcagatcctcccaacacacacatgcaggcagcctcggggcctctgcgggtccctctaccacagcattcccggggaaaggcccggcgtggtggctcacgcctgtaatcccagcactttggcaggccgaggcaggaggatcgcctgagtccaggagttccagaccagcctgggcaacatggcgagaccccgtctctacaaaaaatacaaaaattagccgagcctggtggtggcaggcgactgtggttccagctgctcgggaggctgagaagtgaggatcacccgagcctgggaggtcgaggctgcagtgagccgagatcgcaccactgcattccagcctgagccacagagccagattgtctcaaaaaaaaaaaaaaaaaaaaaaaaaaaaaaaattcgctggtaggaaacataggctggttgagtacgggagtcatacagatcaggtggatcaggcggccgcacaccgcagctctacggcccgggaacgttactaaatactcccatgcctcagcttcccgccttaacgtggtaacacgttactgtagtttctccacgcagagctgctgtgaggattaaaagaggccgcgtgagttgagcatctcgtcgccattaccgtcatcacacgccccccacccaacccggcgggcccaccctctgcacccacggcgaaagcactctttctaaaccacgccccggatgtcccgcctccagcggctcggaggtcttcacttattggcctccccaaaccaacatggcggccccctacaaacttcaagcgccggtctctcctagccaatcaaaagaaagatatttctgaatcccgcctctttcagcagccttgctggccaatcagaccacaccatgaagcatcaatacagaaaagggggaacccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaaggtggggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcataggtgagaagacggaggtcaggtcacatcatctgcccaaggtcacgcggcaggctgggggacagttccaggagggccttgaagctggggaaaggaatgtggtaccgaggactgttcaggccttgaaga

SEQ ID NO: 13072 - DNA, 11917 bp, Human
actgggagacgctggaggtaggggcgggggtccccatgggcagagcaagccaggagagagcttgaggtcggcctgagggtgggcttcggggtctcccagtcccactgcttactttctgcgtgacctcagcaccgcatcaagcctgcccaggcctcagtttccacctctgtcagatgggggtggtaacagcagcttccaggattcagtgagtgaaggtgcacaggtgcccgtggttgggaactgtctgtggtctgcccctgactggcccccatccgtgtccacccacaggaccatgggctccatgttccggagcgaggaggtggccctggtccagctctttctgcccacagcggctgcctacacctgcgtgagtcggctgggcgagctgggcctcgtggagttcagagacgtgagttgggtgggcaggcgtgggaagggggctactgccaaggttagcccggaggccggtccaggatggggactgccccccctccgccatagggccctggccccatttgaaccccagcggcccctgccatgggcactgctcatgggaagcccgcagctgaggcccctgagctggctcctccccataccctcctggggcatggggtctggtctgtgctctgatctgcgtcttgtggctcccagggcactccacacctttctggaggaggcagctaaggcctggggagagtcaggcctgggctctagggtgaggagctccctgacccccttcccgggacactcacccctccgtgtggcacccacagctcaacgcctcggtgagcgccttccagagacgctttgtggttgatgttcggcgctgtgaggagctggagaagaccttcagtgagttggtcccaggcctacattccaggcaggcttcctggaggaggcatgggccaagtttgatctgaaaggaagagtctgggtttgccaggtggaaggcagagaagggaggtatatgcagggccctgcagggccaagacagagcagctgggatctgtgaagtgtgcttgcgaaggtggctgccttgtgtgggctgagcagagggcctagggcagggctggctggggaggcctcgaatacagcataagagcccaggacttcgtcctgtgggcgccaggaagccacaggggtttctaagcagggaagaggcacagacagctttctcctctacagctgggctggggtgggtggggcccaggatctagggtagggtacccctaaggagcaggcaaaagggacccctgccctgggcaacccctctcaggaggagcctgtgggggcaccaaggcaggggcatggggcaggcagggttttgtgtttgctggtgcagtttacagcttttcaatgatcaggcagacacaggactcacgccagctccggtcccaagccctgcagcgcaagggccggcctgtggggagacctcaggccctcttctgagtggtggccaagggactggggagggagagtgagcccagacctgagctcagggaggggagcacagcttctggatgaaagtttggccgggattttctggccacctccacctggtgaatccagcagctggtggccgatggagtttggggcagcaggtggggccctcaactgttgagacaacctcaactgcaccccactcccgttcctctgcgcccagccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcaggtcagctcccacccaggcaggagactggggggctggggaggggctgtccagcctagggctcatggtgcttctgggttcctagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacggtgagcagctggcgctgggctggggggtcctgggcagagcgggaccccagagtcagctgagcctgctctgcagggcgagccagccacgtggatgaccttcctcatctcctactggggtgagcagatcggacagaagatccgcaagatcacggactggtgagtcactgggaacacccgccccaccgccctgctccccaggcccctgctgtcacctcccagcccgccctatcgtgactcctccccatgagctcccttcagactcagagtctcgtagctgtgtccttctggcccctcacgcagcgcatcctccctccagcttccactgccacgtcttcccgtttctgcagcaggaggaggcccgcctcggggccctgcagcagctgcaacagcagagccaggagctgcaggaggtgggtgcccccggccttccggaggcgggtgtaggaggtgggtgcccccggcctcccggaggtgggtgcaggaggtgggtgccctggcctggcctccaggaggtgggtgcaggaggtgggtgccctggcctggcctccaggaggtgggtgcaggaggtgggtgcccccggcccagcccaccccacctgcctgcccagcccccgctgactgcccactctggcgcaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcggtgagcagcctgaggcctcgccccctctccgcccgcccctcctaccaggccggggcgtttctgcctcacttccagcctctggctccctgcacctgggctttgcctaggggctccttctcctcccagcctcctccatggcccaccgcttccagggagtctgccctgatggccctggcccagcaagccctaccctgactttcctaagtccctggaggctgcacaggatagttttaaagtcagaagcctcattccaatccaggcccccctgtgaccttaggcctgctcatggtctgtggaaccggtgtgatgcccctgcctccgggggtcacccgccgcgcacagcaggtgcttgcgggtgaggctgggctccttctcctgggccgtccctaggaggcagcatgcttgcctttcccaagcaattgccaatccatgtggtgtctttgggcccccaccagggcagagcagggctgatcatctcacgtcagagagaggggaaggggctgcccagtgagcccccacagggctctacatctccagctgggcctggctggagatcccagggtccctgaaggcccccgccaccgttctggtctgtctctgccctggcacccagatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccggtgagagccacggcatccttacccgtgtcctgggaggctcagctgccccactgggtgggtgtgagcctgagggggaggtatctccatcctgggcctggcctgccctcctgggatgaggggcacacatcccatcactctcaaggggctgttgggctctgcagccagtgtgaggctttatgtcggcccccagccaactcccccttgttgagtttacaagggagccggcacgggcttgtgcaaagaacagaggctgtgcggtgggcatggcccaggttggaagcccatctcgcctactttgagacatttcttagcttctctgagcctcagctgcctcacctgcaaaatggaaataatagcgcaaacctcagaggaatgttgggaagcttagtgactgttggagactgcaagctggagccaggggcagcctttggtgtggttgctttggttgcacagctttttttttttttttgagatagagtcttgctcagttgcccaggctggagtgcaatggcatgatctcggctcactgaaacctccgcctcccaggttcaagcgattctcctgcctcagcctcccaagtagctgggattacaggcacgcaccaccacgcctggctaatttcatatttttagtagagatggggtttcaccatgttggtcaggctggtcttgaacccccgacctcacgtgatccacccacacaggccgttgggggcccaagcaccctgactcttgcccactggatgaggcagggcccctccctgtcctgtgaccaagtcccctcccgacatgggctccaccacatcacacccatgctatgggccgggcccccactcagtgtcactgggggcactggggggtttgctgcttctgcagggccagtgtcctggggctggatctgggccccaacaggattcccctgcacgtgggcagaggctggtgcagctagagcatcacctggaggcccgtggcagatagaatgctgccagctcaaagcaccagccgtcggggcagcgtgtttgccagggaagctgtaacaaagtgccaccggctactggcttaaggggcagacacggtcccacagtcctggaggctggaagtccaagaccaaggtgtcagcaggggccgggggcactggctgatgcctgtgatctcagcactttgggaggctgtggtgggaggaggatctctggagtccaggagttcgagaccagcctgggcaacatagcaagcccttgtatcttaaaaaaataaaagatgatgaggtgttgtcagcaggagtggctccttctgaggctgtccaggaagatctgttcccggcctctctcctgggcttggagcggccgtcctcatcttcacacgctgttctccttctatgtgggtccaaatgttccttttcataaggacatcgggcacactggattggggcccactgtaatggccttatcttaacccagtgacctctgtaaggaccctgtctccaaagaaggtcacatctggagttcctgggggttgcgactccagtgtatcttttttggggtcacaacacagcccctgacagtgtgtatgttggggtcctcctgcctcccatgaggacttgttcccattttactgatgggaagtcgagacttcagagctgaagtgaccagctcggcctcccggaacttgccatgtgccagctggggctgcctgtggctccctgtcctctctggcttctgtgtggagctctgggaacagcaacagctgaagctgctaacttcctgtggctccagcagctggcccgtgctgcccgtggagaacttatgaagtggtctggtgttacctgcattttacagatggggaaatggaggctcagagaggtgaagtggctgggccaaggtcacacagctcctaagtggtgggttcttttttttttttttttttttcggagacagaatcttcgctctgtcgcgcaggctggagtgcagtggcgcgagctcggctcactgcaacctccgcctcccgggttcaaatgattctcctgcctcagcctcctgagtagctgggattacaggcacctgccaccatgcccagctaatttttctgtttttagtacaggcagggtttcaccgtgtgggccaggctggtctcgaactcctgacctcgggtgatgcccccccccccccgtctcggcctcccagagtgctgggattacaggcatgagccactgtgcctggctgctaagtgatgggttcttgactgcaggccagcagggcctccgtggcgtcttgggccgggaggcagatgctggtgtgttcgggggttcccagctcacccacctctgcccacagctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgaggtgaggggcggggctggggtcctgatgagggtagcagggccaggcagcccctcaccacaccactgcccccccagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttcagccgtcctgcagcgctgtcgctgagcactcctgtgtgccaggccctttcctcagcacaagaggcagacaagcctcctgccctgcggagcctgcatcacagtcccctgagtgtgcggaggcaaagcgagaccagccaggaaccagtctcctgagtgtgcagaggcaaagcgagactggacaggaaccagcctgcagcttgcactgtgccaagcactgttcccaaccctctgtggaagtgattttcttttttcttttttttatttttggatatagagtctcattctgttgcccaggctggagtgcagtggtgtgatcttggctcactgcaacctccatctcccgggttcaagcgattcccctgcttcagcctcctgagtagctgggattacaggcgcccgccaccatgcctggctaatttctgtatttttagtagagacagggtttcaccatgttggctaggctggtctcgaactcctgacctcatgtgatccacctgcttcagcctctcgaagtgctgggattacaggcgtgagtcaccgcgcccagcctgattttctatttgaacctcgtaacaaccccgtgggcctcacattagtagtgtcctcacctaaagaagagactgaggcacagaggtcatgcccaaggtcacccaggctggcaccgtggcagctggcccatctgcgctctgttgcccctcggtgggtgggtgatggatgaggctgcaggctccgagggggaaaacagggtggtgagagagtgactcgggccggggacttcctggcagtgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgtgagggccaaggctgcccgggggacgggaggctggcaggccagagtgggccccagtgagcacacctccctcttgcccgccaggcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggtgggctgcggctggtgggggccgggctcacacggcctcatggggaccccgcggtcacagggccactgggagctgcaagatcctcgtccgagaaacggggatgcaggccccgggccgtgcagacagggccgtcagaggtgatggtgtgcatctttagcaggtggcacaactggcactgggaaccgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgaggtgggtgcagtgccttcctgggggtgggacggctgaggccctgccggccctcactgcacccgccccgcagctcgtcccctccgaggtgctcatgcaccaggccatccacaccatcgagttctgcctgggctgcgtctccaacaccgcctcctacctgcgcctgtgggccctgagcctggcccacgcccgtgagtgacctggccaccgacggctggccccagctcctggcttctcacataccgctgctggctgggcgggttgcttctctctgggcctcagtttcccctctgtaaagtgggactgtccaaggaggtccctcgctggccccccgtgcagggagggcttcaggctgcggcaggtaggtagggggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactggtgagcgaccacccactggcctgggctgctcaaggcgtgagttcccctcaccaacccctctgcttctcacccccagggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgatgtctcgtctctcttccctcctttttagctgaggcaggtggcagggtagaaggcatggtgtaggatctgggacctcaaaagtcaaggcctggacctgagcagatctgcaataatgtcagactcttggggtgaaaaggggcagaaaagggccaaggagagatgtttccagcacattctaacttggagtgagcaaatgtcttcccaggccgggtcaggggagtgagctccccatccttggaggtgtgcacctggctgtgagcgggtgtctgggttactctctgttgggagtggtgccaatatccatgccctggtgccgggcctcaggggtctggaagtacagagcagtgtggggcacctgagccccggccagtgctccatgcagggccatggtgtcacacgcccaaggccacacacctgccaggaagggtagaggctgtccccagcagcagacattacccaggaccccggggttcagaacaggggctgagcctgactccaggcccagcctcccctcacctgagactacagtcttcctgatccctcccaggtggtccttcctgcgttgctggcagaatgggggtggctttctgcagttccctctggcctgggtcccacccccactgggaggcagaggaagtgcttcccagaagccaacaagctgcaaagtggttcttcccacagctgtggctgaggccagctgctgggaggagcctgtccattggctcctggactgctttgctcaggacctctggatgccaggggtcgtatcaggggctctaaggtaattccacatgcccagcagattcagcttagagaaacggtgctcacagtgctggggtaggagcagagaaggctaaatgaaggactccggagagctgcaggtggatctggaccaaatccagaacccaacgccttactccctcctggggagagagctgggcagagacttggggcgggcagtgaggtggggataggtgagcagcactcgtggtgagtggccccagtgtgatttaggaggggtgcagtgtgggatcccagggacatgaccagtcagccccgccctggctttgacatgggggtgcctggcagtggtggctagagaagtccagtttgccaagagaatggcacataaggcactggggtgggcacctctggggcatggacatagggagacatagggatggggtgggtcacctgcgtggaggactgggcactgaacagcacaggcccgagcccatccttgtccacgtgagcttatggcctgatgtagagaccaccaggggctccaggaaagttaagctgcatggagagaaacgatgggccagggccgggcccagggtggtttagggaatggcagtgtcctgggtagaataggaaggcctgagactgtgactgagctgacagtggggcaaagtgaaggagcccagtattggaagatcggctccacatgtatctctgcgaggagactgcaagcgagctcgtgtggaccaggcagaggcgagggctgagtgaggccagcagtggcctgggcacaggaagacggtgagtgagaagccactggagctcctgtgcaggagcgcaacacctttactgcttcattcagtttggcttcacctgcttaaaactgtaactctctagaaggctgaacagcaaaagcctccctcctgcccagccgctcagcatccccaggcaccagcactgctcccagtctccaacgtcctccagggctcttcgcttctgggctagaagcagggaaaccagagtgtgctggggaagaagaggaggaggtggaggagggctgatgatggggccacatgctgctgggatgccagctgagagcagcggagcactgctaagctaaggggctgagtgggtgcagatggagccctccgtgggctccttcaggtaccaggagccctgcctgagattcaggacacatccaagggtgacagcttgaggttgggtttttatttttttatttgtatagtacaatctct

SEQ ID NO: 13073 - DNA, 11917 bp, Human; identical to SEQ ID NO: 13072

SEQ ID NO: 13074 - DNA, 20099 bp, Human
ttaattaggtcatcctgcctttacaatctctgcattttaaatactcaactaagagtacagccattatttgtctttcacccaaagtcccattcaagtgagaacaaaggaatgaataaataaggcataagtaacaaaacaacaaaaaaagaaaattagaatgcggtcaatttcatgcaatcatcaacaccaaatttccagaacgtagtatttccaaatttcccgaacgtaaatatgtatgtggaaattaacaaaatgtggcaaaacaaaaggtcacttaaatttgcacaaatgaaacagtcaacatggaagctgatcggctttctgaaatatgggacaagctcaggacttcaaaatacttcggcgttggaagggctaagttatgatgtattaaaatgaaaataaagtggggcgcggtggctcacgcctgtaatcccagcactttgggggaccgaagtgggtggatcacgaggtcaggagatcgagaccatcctggctaacacggtgaaaccccgtttctactgaaaatacaaaaaaaattagccgggcgtggtggcggatgcctgtagtcccagctactcgggaggctgaggcaggagaatagcatgaacccgggaagtggagcttgcagtgagctgagatcacgccactgcactccagcctgggcgacagagcaagactccgtctcaaaaaaaaaaaaagaataaataaaataaaataaaatagtagaaggtttaattaggaatatttcactctccatacctgaagaattcgtgatagccaggagtctacaatcaaaataacataaataataagataaaaataaaattaatttgaagccataaaaaaagaatgagttcatatgttttgtggaaacatggatggagctggaggccattatccttagcaaactatacaagaacagaacaccaaatacagcaggttctcacttataagtggaagctaaataatagaactcatgaacacaaaaaagggaaaaacagacaatggggtctcctttagggtggagggtgggaggcgggaaaggagcaggcaaagtaactattaggtaccaagcttattacctaggtgatgaaataatctgtacaacaaacccccatgacacaagtttacctgtataacaaaccttcccatgtacccttgaacctaaaataaaagttaaaaaaatactcaatgagcaacaatgtacattatttgaggataattatattaaaagcccagacttcaccactacacaaaatatccacgtaataaaatttcacttgcgctccttaaatttatacaaataaacaaaaaagtataataaaatagtagattctttctttagagatgacaaatagtgccagagaaaatgcctccacactctggcattgagatcatctccaggataagggtatactgcatgcctggtcaagtccaagtaaatatactcagaccatgaatctcagagatgaaacataggttcagaacagacaaagccacagagcttttgactaatggcccagtgaaggcaatgtctgcctgtatggtatccaccaccttatattctgtcccaagcccgtctatttggatgtagcatctggttcaaagatgaatttgaacaccattagacactggcttaatgaaaattcacttctcattcgtttctcatctgaaacataaatagaaatataggtcttaggcaggaggatttcttgatgccagaagttagagactaccctggccaacatagaaagaccccatctctatttaaaaaaatatacatatatatgtcttctcttgggctccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggtgagtttcagagtaaaagtgggttagaggggaagatagagaaatcccaaaataatcagggtgtctcttaacagtgtgactaggagattttagtggctgccaaggagattctgatctccttagtggaaaggccgtctttgtcaatgtatctataactttgtctctacccaagcccaagctagcttgtggggctcaaggtttaatatttgtattaaacctatagtgtgttatctgggattcatgatggtcccaaggttcttatcaaggagagacttagaggctggaatctgaaaggtaaaaataaagaatgaacctcaaaactgtgattgttgtggaaggaaaacatatgatagaaccccatatagaaatatggttactagtattttgttgaagatttttgcatttatgttcaacaaagatattatccagaagttttctgtttttgttgtatctctgccacattttgttatcaggataatgttggcctcatagaatgagttggggaggagtccctcctccaggatttttttcaatagtttcagtaggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcgtggtggcgggcgcctgtagtcccagctactcgtgcggctgaggcaggagaatggcatgaacctgggaggcagagcttgcagtgagccaagatcatgccactgcactccagcttgggcgacacagcgagactctgtctcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgaagaatagcctgaagcaccattcttattttaatccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggatgctgccatagtctaaccctactgaacactctagcattctgtagtactactgcagtactaagcatgaggcagtcttagtgtactactgaatattctgccaccccaactactactgccttagcctcctaatgggtgtgagccccacgtccatccatgtcttctctcttccagctccttctaaagcctgaattatttgtgtgttgaacaatactcattcttcctatccatgagcatggaatgtttttccatttgtttgtgtcatctatgatttctttgaccagtgttttgtagttctccttgcagagatctttcacctccctggttagctgtattcccaggtattttattctttttgcagtaattgtgaatggattctattcttgatttggctctcagcttagatgtttttggtgtataggaatgctactgatttttatatattgattttgtatcctggaactttgctaaagttgtttatcagattaagaagtgtttgggcagagactgtggttttctaggtatagaatcatatcacctgcaaacagggatagtttgacttcctttcttcctatttggatgccttttatttctctcttgcctgattgctctagctaggacctccagtactatgttgaacagaagtagtgagagacggcatccatgtcttttgccagttttcaaggggaatacttccagcttttgcccattcaatatgatgttgactgtgagtttgtcatacatcattcttattattttgaaatatgtttcttcaatgcctagtttgtcgaggttttttagcataaagggatgttgaattttatcaaaagctctattgagaggattatgtgtgtggggagggttgttctatttatgtgatgaatcatatttaagatttgtgtatattggccgggcactgtggctcatgcctgtaatcccagcactttgggaagccaaggcttgtggatcatgaggtcaggagatcgacaccatcctggctaacacggtgaaacctcgtctatactaaaaaacacaaaaaaattagccaggcgtggtggtgggcacctgtagtcccagctgctcgggaggctcaggcaggagaatggcgtgaatccaggaggcggagcttgcagtgagccaagttcacgccactacactccagcctgggcaacagagcgagactcctatatcgaatcaaccttgcatcccagaaataaagcctacctgatggtggtggattagctttctgatgtgctgctggatagtttgctagtattttgttgaggatttttgcatttatgttcaacaaggatattgtcctgaagttttctggttttgttgtgtctctgccatgtttttgcatcaagatgatgctggtctcatagaatgagctggggaggcattcctcctcctgaatatttttggaacgtttcagtaggtatagtaccagctcttctttatatatcagatgggattcagctgtgagtctgtctggtactgggctttttctggtctgtaggatttttattactgattcaattttggagctcattattggtctgttcatgtattcaatttattcttggtttgatctcaggagggtgtatgtgtccaggaatttctccatttattctggattttctagtttgtgtgcatagaggtgttcataatattctctgatgattgtatttctgtggggtgagtggtaatataccctttgttgtttctaattgtgtttatccggatcatctctcttttcttctttattagtctaactagtcatctgtcttactaattttttcaaaaattctactcctcgatttgctgatcttctgaatgctttttcgtgtctcaatctccttcagctcagctctgattttggttatttcttgtttcctatgagctttggggttgatttcctcttggttctcttagttcctcttgttatgatgttaggttgttaatttgaactttttctagctttttgaagtgggagtttagtgctataaacttcccccttaacactgccttagctgtgtcccagagattctgctatatttacccaaaaattccagaacagactgcttaatttccatgcattgtacagttttgagtggttttcttagtatttattcctatttttattccactgtgctctgatttcgcttttctggatttgctaaggattgttttttttttttttgaaatggagtcttgctctgtcgcccaggctggagtgcagtggcgcaatctaggctcactgcaagctccgcctcccgggttcacaccattctcctgcctcagcctcctgagtagctgagactacaggtgcccgccaccccgcccggctaattttttttgtatttttagtaaagacggggtttcactgcgttagccaggatggtctcgatctcctgacctcatgatccgccagccttggcttcccaaagtgctgggattacaggtgtgagccaccgtgcccagcctgctaaggattgctgtatgtctgattgtatgattgactttagagtatgtgccatgaggcaatgaaaacaatgtagattctgttgttttgggggtggagagttctgtagatgtctgtcaggtccatttgatccactgctgagttcaggtcctgaatatctctgtttgcctcaatgatctaatactgtcggcgggatgttaaagtctccccctattattgtgtggttgtctaagtctcttcgttggtctctcagaacacgctttatgaatccgggtgcttccatgttaggtgcatatatatttaggatagttaggtcttcatgctctttttttaattttttttttctttttctttttgattcagcagttgggctattacacactccttagcagattccgacttccgtggccactgtcctgctatggtcttcatgttgaattgaaccctttaccatgatttaatgcccttctttgccttttttgatctttgttggtataaagtctgttttgtctgaaattttaatagcagctcctgcatttttttttttttttggctttccatttgcttggtagatttttctccatttctttactttgagcctatggatgtcattgcatatgagatgggtttcttataggcagcataatgttgagtcttgcttttttttttttttttttttttgagatggagtctcactctgtcacccaggctggagtgcagtggtatgatcttgactcactgcaacttctgcctcccaggttcaaatgattctcctgcctcagcctcccaaatagctgggattacaggtgtgtaccaccacgcccagctattttttttttttattagagatgggatttcatcacattggccaggctaatgtcgaactcctgacctcaaatgatccacccacctcagcctcccaaagtgccagggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctattggctggtgatggtcttttctttccatatttagcgttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacctgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggactacaggtgcccaccaccacgcccagctaattttttatatttttttagtagagatggggtttcaccatgttagccaggatggtctcaatctcctgacctcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatgatcccatatttcttagaggttttgttcattaatttttattctttttcttcatttttgtctgactgaattagttcagagagccagtattcatgctctgagattctttccttattttgctttattttgccattaatacttgtgatcgcattatgaaatctcgtagtgtgtttttcagctccatcagatccgtttggttctttcaaaatgaccatctcatagattagcccctctgtcattttattgtaatctttaggttccttgcattgggtttcaactttctcctgaatcttgatgaccttaatttctatccatattctgaattctatttctgtcatttcagccaggtaaagagcccttgctgggaagcttgtgtggtaatttggaggaaggaagacactgttgctttttgagttgatggagttcttgctcagttctttctcatccatgtgggctaatgttcctttgagtgtgctgcaatttgaatttttttcttttttcttttaaccgtgatgtaatttgagcacagtcagtagacttcttttctggatggtttcagagggctggggcttcgcacagggtctttatttatagctaaattcttgtccttggtttcacagggaggtatattagcgagcatttttggtgttgaagtttgggctgcaatccggtaaatgatgcttcagcacaacggccagtaggtcattcctcatgattgccgctgtgctccctctcacgctctgaaagtgcgggctcctctcccacccaagtgctggctgcagatctgggctcggcactcccaggctgcacatcacagctctggggtgagctcagactttatgttccctccgtggcttgggggcagcaggggaagggaccttagcagcggttgtggcagacggcctttcacttgtcccttggaactccaccccagagagatgtggagccactatcagtgcgatgagccaagagtggggcgactgcactgtgggtccaagctaggggccctgcctagtgatgagcaggggggacaggtgggtcacaggggtgacagactggcctcttctccttagggcagtttgctggaggtgtggttgaagcactcagagtctttgctccttccccagtctgagggcagcaaggccagtaccaccgcagtggcagcggcagagtgaccttccgttgcctctgggagctccgccacagagaaacgcagactcacagctgctgggaacgctccgccagagggtggggctgttgtgccgcggaatcaagctggggcttggtgaagagcagggggttgagggctcacagggagaggagactgagctcctctccgtatggcgactgcggtgtgctggaagcatgaatgaaggccgggcgcggtggactcacgctcggaatcccagcactttgggaggccgaggcgggcggatcacgaggtcgggagatcgagaccatcctggctaatctggtgaaaccccgtctctactaaaaacacaaaaaatgagccgggcgtggtggcgggcgcctgtagtcccagctactcgggaggaggatgaggctgaggcaggagaatggcgtgaacccgggaggcgcagcttgcagtgagccgagatcgggccactgcactgcagcgtgggcgacagagcgagactccgtctcaaataaataaataaataaatagaagcatgaatgaaggccccaggctccttgcttcttccccagatcacgggcagcagaggcagaacccttgccatggcagtggcagaggggctgtcagttgcctctgggagccactccccagggaaacacgagccaccaccagtgagtgtgctgagggcggggcagctgctctgcactcccgagctgggggctctgcctggtaaagtgggggtgggagctcacggggaagagagactggactcctctctgtctgatggctgtggcataatgaccgggcccccacacatgaaaaagaattctgggaactcaaaaagccagtgtgtccccaccatggaccccttggattgtgtttcaaatttctcctcaatttcgaagagcgtcctggccatccagattctgaattctataaccctcgtttcattcatctcaatgtagctaagaaccagatttctggggaactatcgagttgccagagttcttgtgttgattcttttttttttcttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacgttggtcaggctggtctcaaactcttgacctccggtgatctgcccacttcagcctcccaaagtgctgggattacaggtgtgagccaccgcgcccggccttggtgttgattctttctcttgtgtgagggctggtgttcctttaactgtgatgtcggttgagtacagtcgcttggcttcatttctgggtgttttcagatgccaggactctgcacaggatctttatttgtggctgaatttttcccttcattgtatactggcaaaatttttcagtgttgtattttgaagtgtgatccagtaggtggcacttaaaagggttggccagcatacaggatcttagccacaaggctcttttgtagttttgtttcgttttttgtttcgttttttgacacagggtcttgttctgtcgcccaggctggagcacagtggcacaatctcggctcactgcagcctctacctatcaggctaagtgatcctcctgcctcagcctcctgagtagctgggactacaagcacgcagcaccataaagagaaaatttttgtaattttttttttttttttgtagagatggggtttcaccatgtttaccaggctggtctcaaactcctgggctcaagcaatctgcctgccttggccccctaactcttgtattttgacaaagtcggcagtagtgctctgtggttgtggggaggggtgactccctcgcctggtccattcttgggccttggaggagcctcctacagtcactggctctgcacccactgtttcctttgttaggattgttctgcccacggggctccctcaggcagggcatggtgggcagacaggctgtatccttccccggccagccctatggagggaggaccaccccgcacctctgcaggctgatgaaatcaggtgtttcacccctctgaacgttctgagaatgagggctcctcacggcttggtcgccacctaacgtggtgagtccttctcagcaagggtgattggagccacatgatctgccatctcagtgcttcccaggggaacacagagctactgggcatggtggctcacacgtgtaatcccagtactttaggaggccgagatgggcagattgcgaagtcaggagactgagaccatcctggataacatggtgaaaccccgtctctactaaaaatacaaaaaaaaattagccaggcgtggtggcgggcgcctgtagtcccagctactcgggaggctgaggcagaagaatggtgtgaacccgggaggcggagcttgcagtgagccaagatcacaccactgcactccagcctgggcaacagagtgagacttcatctcaacaaaaaaagaaaagaaaagaaaaacacagagctgcacaccccacagagttcaggcagaagggggtctgcagcgctggaagacccagcaagcctggcccgtctggctgcaagtggcaggggtgggtggagtcacccacttcaccatctgggtgctttccagggaagcatgcagccacgaccccgggcagagttcaggcagaagctgggccactatgctggaaactggccttgagccttgtggagtaacggcaggtggagccatctcactgctcccacgcaccatgcccgtggcctctgcgggggctgtggtaacggcacccgactgctctggggtcaatgcctgcggaggtccccctggcttcagtgttgcctctgcaaaaaccccagttgcagccaggtgcggtggctcacgcttgtaatcccagcactttgggaggccgaggcaggtggatcacttgaagtcaggagttcaagaccagcctggccaacatggtgaaaccccgtttctactaaaaatacaaaaattatccaggcatggtggtgggcacctgtaatcccagctactcggaaggctgaggcagcagaattgcttgaacccgggaggcggaggagctgagattgcaccactgcactgcagcctgggcgacaaaacaagactctgtctcgaaaaataataacaataaaaaataaagatggcaaccatagacactggagactactagatgggggggaagaaagggggttgaaaaactgcctattgggtactatgctcagtacctgggtgacaggatcaatcgtactccaaacctcagcatcacaaattatttaaatttttctctttttttaattttttttgttgttgttgttgagacgaagtctcactctgttgcccaggctggagtgcagtggtgtgatctcggctcactgcaagctctgcctcccgggttcacgccattctcctgccccaatctcccgagtagctgggactacacgcgcccgccaccacgtcctgctaattttttgtattttcagtagacacggggtttcaccgtgttagccaggatggtcttgatatcgtcaccttgtgatccacccgcctcggcctcccaaagtgctgggaatacaggcgtgagctaccgcacccggcctaaatttttttttaaataaagaatggtaggttcttcacaccctaatgtatttttacttctcccacagagaaggaaaggaatggcttccccatggcgagccacctcagtctgggctttcttttcttccaggggactttcccatgcctttcatatctgccaaatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacaggttccggtacagtgacaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttccagaatcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgccgggcgcggtggctcacgcctgtaatcccaacactttgggtggctgaggtgggtggatcacctgaggtcaggagttcgagaccagcctggccaacacagtgaaacctcgtctctactaaaaatggaaaaaattggccaggcctggtggcacacgcctgtaatcccagctacttgggaggctgaggcaggagaatcgcttgaacccaggaggcagaggttgcagtgagccaagatcacaccactgcactccaggctgggcgacagggcgagactccatctcacacacacacacacaaaaagatttcacattgcattcaggtgtcatgcatctttttttttttttttttttttttttgagacggagtcccgctgtgttgcccaggctggagtgcagtggcacaatctcggctcactgcaagctccaacctcccgggttcacgccattctcctgcctcagcctcccgagtagctgggactacaggcgtccgccaccacgcctggctaattttttgtatttttagtagagatagggtttcactgtgttagccaggatggtctcaatcttctgacctcgtgatccgcccgcctggcctcccaaagtgctgggattactggcgtgagccaccacgcccggcccccgaaaatgctgggattacaggcatgagccaccgcacctggcctcccaaagtgctgggattccaggcgtgagccaccgtgcccggcaggtgtcatgtatctttaggtttgtcttggctgtcacagcttctcagatgttgctggttttccatgaccttgtcagttttgagggtagtggtccattattttcaagggtactcccactactggaaattgtctgatgttttgctcatgactagactgagttatgggtcattgcaggcaagaccacagaagcaaagtgccatttcatctcctcatagcaaaggtttaaactgtccatgggaacatgactgtggatgttgagctggctgttgttgaaagcctggctgaagtagtaactgtggccagacaccgtggctcgtgcctgtaatcccagcactttgagaggccgagatgggcagatcacttaagcccaggagaccagcctgggcaacatagtaagaccccatctgtacaaaaaatcaaaaaattagctgggcatggtggcatccacctgtagtctcagctacttgagaggctgagatggtaggatcacctgagcctgggaggtcgaggctgcagtgagccgtgattatgccactgccctcagcctgggcgatagagtgagaccctctctaaaataaataaattctaaaaaagaaaaaagaggctgggcactgtggttcacgcctgtaatcccagcactttgggaggctgaggcaggtggatcacctgaggtcagggattcaagaccagcctgaccaacatggggaaacctcatctttactaaaaatacaaaaattagctgggcgtggtggcgggtgtctgtaatcccagctactcgggaggctgaggcaggagactcacttgaacctcggaggtggaggttgcagtgagcggagatcatgccactgcactgcagcctcagtgacagagcgagactccatctcaaaaaacaataataggctgggcgcagttgctcatgcctgtaatcccagcactttgggaggccaaggtgggcaaatcacctgaggtcaggagttcgagaccagcctgaccaacatggagagaccccgtctctactaaaaatacaaaaattagctgggcgtggtggtacgcacctgtaatcccagtttctcgggaggctgaggcaggagaattgcttgaacccgggagacggaggttgcagtgagctgagatcacgccactgcactccagcttgggcaataagagcgaaactccatctcaaaaaaatatataataataacaataagaagaagaagaaaagaataaaggagaaaaggtctttctaatagctcactcttttctctcttaggcttgtatggcaaacccttcctctctgcagatcggggtctggtgttgatgccaggagagaatatttccctcacgtgcagctcagcacacatcccatttgatagattttcactggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccttggagcttgtggtcacaggtaggtaccgcccagtccagccctgtgtctgggttggctgtccagggccttgccaccgggcaggaatatgaagacgtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaacacggttgggcacgatggctcacgcctgtaatctgagcacattgggaggctgaggcaggtggatcacctgaggtcgggagttcgagaccagcctggccaacatagtgaaaccccatctccactaaaaatacaaaaattaaccaggcgtggtggtggtgggcgcctgtaatcccagctacttgggaggctgaggcaggagaatcacttgaccagggaggcggaggttgcagtgagccgagatcacgccactgcactccagcctgggcaacagagtgagactccatctcaaaaaaaaaaaaaaaaaaaacacacacaacctgcccataatcacctccttcccagtttatagcacttccctgggaagcacagttccttgcccgtgaacacagtcttgctgactgatcagtgtggtgctggcgaagcatgagctcattgaggggatgcttgagggagtcccattttggcaagcgaaaaggaaaatgagctcccgtttcagggctctggggttgggatggaatggaacacaaccaccaaccattcatctccttgaattgtgtctccagactccatccaccaagattacacgacgcagaacttgatccgcatggccgtggcaggactggtcctcgtggctctcttggccatactggttgaaaattggcacagccatacggcactgaacaaggaagcctcggcagatgtggctgaaccgagctggagccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttctgattttttatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattacaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagtatttctaactttctttattgactgcttttcacactttatacaagttctggcccatatcttcagtttgttctgatttttttcaccaggtgtggtggcaggtgcctgtagtcccagctactccaggggctgaggcaggagaatggcgtgaacctgggaggcggggcttgcaatgagctgagatcacgccactacactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaactcatataagtcgttttgctgacagaaggaccttgtttggaaaaagcgttttcagaataataaagttcctgagctcttcagaaaagtattttattgtcctgtaaccacagtaacaagtagccaccaaaactgatttttaacccatcatcaatgacaactcatctctgtgaagatgctctttttttttttttttttttttgagacggggtcttgctctgtcacccaggctggggagcagtgacgtgacctcggctccctgcaacctctctttcccgggttcagcaattctcctgcctcagcctccccagtagctgggattataggcacctgccaccacacgcagataatttttgtatttttagtacagacgggtttcgccatgttggccaagctggtcacaaacttctgacctcagggtgatctgcctgcctcagcctctcaaagtgctgggattacaggagtgagccacaaagcccggccactccatacgttttatattgttatgttaccatcagtcaggcagctccttgcttctaaaagtcatccaatcagactcatttcagtaaacacccaagcatgagtgacaaccaatcaaagtaatatcttcccaatgaccacacttttccagatgacgtcaagccacagaaggccctgaaaatccaacaatctctgaagtatacat

SEQ ID NO: 13075 - DNA, 6676 bp, Human
  misc_feature (1)...(6676): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggatagatggatggatggacaggtagatgcatggactgatacatagatggatggatggatgaatggatggatggatggacaggtccatgcatgaattgatggatggatgaatgtacaggtggatggatggtaggtgggtggacagatggatgggcagagcagagggaagctttatctggggcctcaggaaaacctagcagaggaggtaacatttgagctgggtcctttaagagtagcttgctcgatggaaagaaaaagcagctcaggaatagagaaggacagagaagacagaaagtttggcctggttgagtaacagagatgttcagtccctggggcatgaaaataaggtccctgctggttcagtgagcaggtgccggctctgctctgcacaccagggctgccctcccaggctgggacttcaggttccgagaggccatcatgtcccatcattgaaaagcctccgtgaacccagtgttttacagcagacttttgctggctgcatgaagacaccttcctcactgagactgaaagataatttctctttaattgattttttaccactatgaacagtaaaataatataagaaaaatctatgctgctatttttccatttgtgaaatccaaaattacaccttgcagccaattccctcagagtacagacgtgactcctccctccttttatttgtctcattcctttaagtgcaagaaaacagaccactttttttttttttgaatagctgaaagtttatgatttgagaaaggggcaaggtgtgggacaatttcccacacaactcggaacccagggccagggaggcacctctgatgaaaagagatttctgtaaatacatgagaaagtgattctgttgacacctcattcttctgtctgtagaatgtacgagtgacaacaggacatgttgttttaacaccagacaatgaagctccctgctctccactcctcgccagtgatggcactgacagcttcgttcccgcaggttctggcgacgccccccttttgagctcctgggccttccagcaacaagctttcctttcgaatcctgggtccgagccagacagcaatgcgtgctcctcgtgcagtgccagggaaacagcagctatgaatccataaaacacgccctaaatccatcccatccatattgactggtacctttagcgttggccataaagtggctttgtgtgaagtcttgagagaagaaaccaagcctgctgcatggctctcactaaattaacctccctgaggctccggatcacattccaggagggccgcggcagcacgggtctcattaatgcgcagcctcttggctcctgataagatttaacattagccagatgttgttagagtccgacctcggcgggagcaatcacctgcggcataaacctggcacaaaggccactcctccagcttgacctcaccccgcaggaccggacttcggtcaccccttggtacaggctggcaggtgggagggaatgcacgattcactcctggggtcgctgtcgccgcctccctctcactgcccctgtcctgtgctccttgcaggtattcaggctccaggccaggtggggccggacgcccccagccatccaccatggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgatgccaccaccctctacctgcagaacaaccagatcaacaacgccggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaagctctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattaccagcgagatggacgagtgttttgagacggggccgcagggcggcgtggccaatgcggctgccaagaccacggccagcaaccacgcctctgccaccacgccccagggttccctgtttaccctcaaggccaaaaggccagggctgcgcctccccgactccaacattgactaccccatggccacgggtgatggcgccaagaccctggccatccacgtgaaggccctgacggcagactccatccgcatcacgtggaaggccacgctccccgcctcctctttccggctcagttggctgcgcctgggccacagcccagccgtgggctccatcacggagaccttggtgcagggggacaagacagagtacctgctgacagccctggagcccaagtccacctacatcatctgcatggtcaccatggagaccagcaatgcctacgtagctgatgagacacccgtgtgtgccaaggcagagacagccgacagctatggccctaccaccacactcaaccaggagcagaacgctggccccatggcgagcctgcccctggcgggcatcatcggcggggcagtggctctggtcttcctcttcctggtcctgggggccatctgctggtacgtgcaccaggctggcgagctgctgacccgggagagggcctacaaccggggcagcaggaaaaaggatgactatatggagtcagggaccaagaaggataactccatcctggaaatccgcggccctgggctgcagatgctgcccatcaacccgtaccgcgccaaagaggagtacgtggtccacactatcttcccctccaacggcagcagcctctgcaaggccacacacaccattggctacggcaccacgcggggctaccgggacggcggcatccccgacatagactactcctacacatgatgcccgcccacccgggctgccccgcctcagccccagctgccctggcgtggccatgtggctttgcccagcctgctgcaatccaagagagcaaggaagagaaattccatgggtgactttcctccgcagaaagcaaagtttggggagggctgacgattttgtagaacacaacagtgacaattttttttaaaagaatagaaggcaggagggggaattcgacattgttgaagacataatttataccaagttatgccagttggggagggaaggactaaaaataatattgcaggcagggctgggttgggttttttttttttcccccctgaactggaaggatactacctgtacaacatctgtggacacctcatgctctgttcaaggccatcacaaaggaaccgccagggagaagcagccggctctcaaagctcccacgcagctctcccgccactggccactcgctggcgacccgatggaaggttttcaggctcctcacaaaggagagagggaagaaaagatcttttgccctggagatatggtcctgaaatctctcccctggcttattccataccatttcccttgcagatttgcagaaacatggcatctttcactgcattctttgaacaatcatgtagtcgattaaaaaaaaaaaacaaacttttttttcctaggctgaagccctcttcagttccatgcaccacgctccgtagaagccccggcggaagccgtagctttccctgccacctggaggtgcatctgtctgcctgtctatccctgtcgcggtgtctctaagtacagatgggtagatagagccacatgcacggtccttaccgttcttcttgggtcagttcttaccatttcctgaacaatagaattgtgaaagtgttgctttctcctagaaatccttgagtaagtagaccgtgtgttggggatgggagtgaggtgggggaggagacttggtctccaggggctgctgctgttcctaaaggctgaggtgtgtatgtctcagacgggtggcttagggaggcgtcgcagctggggctgccagtcccatcctggctcagcttggccagcactgggctgctctcctttctgatacagataaaagctttatttgattccagtgtcctcgtctccctcccccaccacgtgcaatcaccttaacagctactttctgagcatttaccatgtgctgaatgttccctcctaggacgggtaattagcgcagggattttttttttaaatatcagctgattagacctattggtttccatggctgctcaaacaaagcccagaaaaagacacaaaaattctcgaaaaagccctgggtgatggcagtccctccctgaatgtagaaaactcagctgggcccacccctgggactctgtttcttgagagggagagaccagatctctttctaaaaatgccagcctccgaaagggccctgactgggaccctcagaagagttaagattttatttcctccctctggaatccatgtcgctatcatgcatttatcaactgacagtgcagtgtggtgagccatgagattaaaacgatgatgaaataatgacagcgaattggagagggaggaagagcggagcctggggttccgacgtgcctgcgtcccagtactcagggagcccgggtcaccatctgtcactgtgccgcttgttctgcgccaaggaaaaggaacgtcaaagaggagatgctggtccgagggcaggaggatgagagggctgggagcgcctggtggtgctattttcaaacggcctccaccaccgtgcgaaaagcaaaggcagaagcagcagcggggcaggggttacgttaaaaggcccgaccgccaccttcagtgaggagatggggctgaaaggagcggacacaacagccacgtggaaagtggaaaaatgggcacaggctcccagcacggcctgggggggctagcccacgaaataggtccactccccagccctggggaacagccgagcagcgtggtcacgtttcactcgaaactagacgtgtttttccttttcctgcctgaatcattttctcacacaataaggtcaagagagaaatttccccaggccttaatgtcaggtctgtataaaaggcagccccaggccgggtgcagtggctcacgcctgtaatcccagcactttgggagactgaggcaggcagattttctgaggtcaggagtttgagaccagcctggccaacatggtgaaagtccgtctctctaaaaatgcaaaaattagccaggcatggtggcaggcgcctgttacctggctactcgggaggctgaggcaggagaatcgcttgaaccagggaggcagaggctgcagtgaaccgagattgcgccactgcattccagcctgggcaaagagtgagactccatctcaaaaaaaaaaaagtaggccctcccagtggaccatggccccccagccccgagatgagcagaagggcccacctgggatgtctgggaggagagcgtgcccgaggtgtgccacgttggcataggggacagaagtcccaggtctctgctgattctaaaatgagaccacccctccctgaagggcaccactctgatcactgccttcccccaagtcccgcccatctgcaacacggtgctgccagcacactgtccccacctcacctagg

SEQ ID NO: 13076 - DNA, 28257 bp, Human
ctccattttctttccccatgttaaggtcatgtagaggcttttaagtgcctggagacccccatgccagggaggaccctgagaacgggaagtgggggctgcatggagagaaggagctaggggaactgtaggacctcctatcagactggggaaggcctggcttggacgcctgggttcccgtcctctgtgcgaggtactacaacccctgagttcccatttatgatctaatggggagcttggatgtaagggttcccgtccctgcggcgggggatggagataagacgccaggatcctggtctctggagctccttagagagctggatcctggtccctgacgagggaggtgtatgtcccccttttaaggcgggttgggtttggatgcgaagtcccagccctgtggggggagagtgtgctgacactcaggagttctctcccggaaagggagggtctcgaattctggatttgtgtccctggaggaagcactgacgtgagtcttcactcgtacatggggctcggctgcagggtacctgtcttgtcccgaggggctgctggggcactaactgcctcctgaaggggtgtagacagtgcccggactccgctgttccccttttggagtggggtagctccgatccgaggtgctacattctgacccccgacgttaccgtggggcaagggaactcggaccccagggtagcttggccccctaccagggaaaggcgagcagggcgggtccgggggcggagacgcggcgggcggggctccggcagaccccgcccccgcccgcagcgctggtcgcgcgtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggtaggggaagcttgcgggctggcaggagggggacttctgggtcccagaggaatggggggctggaactccagtgtcctgggggcatagggggtgggacgagggtatcccgagcctgggggaaggggcgcacggatgtttgagtcctggagaaatctggggttgggagacctggacacgggggtctggggcatctggacacctggctgggaggtttgggggcggcctggttcctggggttagggggtgttctgaacgcctggtcctggaggaatgaagacctaactgaaaacgttaggggatcaggagaccaggacacctgggccccgagtgtcgggtcaatcctgggggcgtcctggggcagaggctgcggcggctgcgtccggggctggggctcgcgcgccggggtcttcagggaggaagttgtggtcgtggggatgtggcggtccgaacacgtggcgccatcccgagaggctggggggatccctgggcaggacacaggatgggggtccctgccctctgccccctgcctccttagcccagccgggaaaacagggtgcagatccggggagtcagacaccggggatgggcttggggggcgggtcctcggggcagagggctccgggggctggggcgtgcgtgcctggcccgggaggcgcccgccccccgcccggcttgggcatgcttggcacgcagcgcgcgggccggttcgatccgtatgcgcgccgcgtgcgcccattggtatgcgggagccggcccggcgcgggcgtgaggcgggcgcgctggcgggcggcgcgggggaggcggcggcggggcacgtcctcacccggagcgccagccccgggccggctagggtgggagctgaggcctccaggtaggggaaactgaggcatcatccaggcccccccccccccagctccttgctgggaccctgagccctgcacggatctcagtttccctagaaggtctcccgagggcactaagcgttgcccctggccccctcccgctgcaggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtggtgagcaaagccccgcccccctggccgcgggcccccccccgggtccaattcacacccgatgttctgtccccgtgccaaggggcagttcacacccagctccctgacccgccccttagggctagaaggtcttaccttgagttaactaccgtcctgagcccggtcccctgcgttctgcttctagtcccggtcctcagaattcacgcccaacatctttaatctctcgcccttcctcctccttcccaccagaattgacactcgaggttctgtccctgggtcggagtgtaaaatccacactccggtctgctcccacctccagagatgtggaatccactcccaacgtcccgtcccgttcccaaggccccgggaggcggggctcgcccccagttcccaagcccctgagccccggggccccgccgacacctcctccgcgccgcccgcccagcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcggtgagtgctcatgcgcggggcgagggtcccggggccctccaggcggagtcactgcagcccagatccgggctgcgggcctgccctcgcccagatgcttgtctctggagtcagccaggacctttgcgtgtccctatcaggtggcttctgctctccaagcctcagtttattaaactgtcaaatgggcgcaagaggttgggaagatttcgtgaattctgccctaaacaaggccctggcagttctagtggtcactggtaaatgctattcctatatttttattagaggagaggaatcattattacaaccaaagaaactcccagctgcatgagcgggacagaggggactcaccctggcttgggacgcccattcgctaatgggcgagataccctggatccagacctgaggggccccggcgggaacgcaaggactgtacagtctgagcccccagttggaggagcaagagggagacagtatgatgtggcggatgagatggggaacttcaggaagatgccccagggttcctgtcgccgcgcagccacctcccagctttgcaaccccgggcaggtcgcctcacttctctgtgccttaatgtgaagtgggaaaaaacggtccaacctcccccagggggctgagcagagaatcaaccaggtcatatttgcaaagtccctggaagtgcctagctcagagcaagccaccgctatgcggccaatgctgttatcagcagtaaccttgcagggctgctggaggggttcggggcatggaggagggggcgggggggctgtcgcttttggagcatctcctgcctgtctggcacttttctgagcgctgggattgagcaggagaaacaatctagacaaaagtccctgccccggagcggctggcatcctagtggccaagacgcaataaagaaataggcaaagcaatataatctagaatatgtaaaaatataaactctgtaagatacagataaatatctaagtttattattattactcagactttattattgagacatagaagtgctgttatgttattattacttctattttatgtgtttgttacagctttgcggtgatgaggataaggcagtgtgagtggtgtttatctgaagtctcagggcaccccaggctacccctgtccccacccctccaggagaagagggtgtccttagggtggggttggaggggctccaattcccctcctgccccgtcccaggggaagaggggggagagaaaatagcattgattaagctcgcaataaatcaccatttaaatttaaataatccggcttcccaggcggtaattaggcgaattgactggcgcggagagaatgcggcattagcgccgctgattactgtcattaccgcgaacaacatgtgcgccggcgggggataaacatcttgtctattgtccccgagctgaagggggggaaagggggggctaagagagccccggcggcgtccagccccccattacctggatgagcattccggggctcagaggcatcaggggctggctgaggtcacagcactgacgtggcagagcatggacttaatcgatcccacctcgaccacggtgccaagtggaagtagggtcaggacagtgtgggggggcttggtactgcgtggactcctatagtcccaaaactgggaaatcgggggacagaggcatttctagctctacagggtccctaacaagaggcgaagcacctgcttccatagttcagaggaggagctgaggacagcattttagctgaagccacagagcagagcactgtcagtcacactctctgaaggggaggggactcccatgccctcctcagtaataagccgggcaccatggctcacatccgtaatcccagcactttggggcgccaaggtgggaggaaagctttgggccaggagttcgagaccagccagggcaacatagcaaaaccctgggcaatataacaaaaccatgtccctacaaaaataaaaatattggctgggcacggtggctcacacctgtaatcccagcactttgggaggccaaggcgggcagatcacgaggtcaggagttcgagaccatcctggccaacatggtaaaatcccatctctactaaaatacaaaaaattagccgggcgtggtggtgtgtgcctgtagtcccagctactccggaggctacggcaggggaatcacttgaacccaggaggcggagattgcagtgagccgagatcacaccactgcactccagactagtgacagagcaagactccatctcaaaaaatatataaaaataaaaataaataaataaattagccaggtttggtggcacccgcctgtagtccctgatactgaacaggatgaggtgggaggactgcttgagctgaggaggtcgaggctgcagtgagccatgatcatgccactacactccagcctgggcaacagagcaagactcagtatctaaaataataacaataatagtaatcatatagaatgcatgcatcagaccctgggataagccctgtatacaaaatgactttcttggccgggtgcggtggctcacgcctgtaatctcagctctcagggaggcaagaggcgggaggatagcttgagcccaggagttcgagacctgcctcggcaatatagcgagaccccgttctccagaaaaaggaaaaacaacaacaacaacaaaagataaaatgactttctttttcagagggaggcactattatgattcccaagttacagaagtgtgtgcccaaggtcgcacagctgggattcaaacacagatgaccttgccccaaaggccgcctctcaaccatcatacgtggtctgtaggtctacagggatgggttctaggtctctgcctctctgggcctcagtcctccatctgtgaaatgggacaacagatgttcaagtctagccctgagcctctgagtctggagaggagaccgcccaaatctcatgtcagcattccctattgctttttttttttttttttgaaatgcagttttgctcttgttgcccaggctggagtgcagtgttgcaatctctgctcactgcaatctccgcctcctgggttcaagcaattctcctgactcagcctcccgagtagctgggattacaggcgcctgccaccgcgcctggctaattttttgtatttttagtagagatggggtttcaccatgttggtcaggctggtctcaaactcctgacctcaggtgatccgcctgccgcagcctcccaaagtgctgggattacaggtgtgagccaccgcgcccagccctttttaaatttttttgaaacagggtcttgctctgtcgcccaggctggaatgcagtggtgcgatcttggctcactgcagcctccacctactaggctcaagagttcctctcacttcagccttccaagtagccaggactacaggcacacgccaccacgcctagctactttttgcattttttaagagacgaggtctcaccatgttgcccaggctgctctcacattcctgggatcaagtgatttgccaaccttggcctcccaaagtgttgggattacaggtatgagccactgtgcccagccaaggggtgacttcttagctcataggtcaggcacatcctcgctgaggaagtaacgtttttttgtttttgttttttgttttttttgagacagagtcttgctctgtcacccaggctggagtgcagtggtgcgatctcagctcactgcaacctccacttcccaggttcaagcgattctcctgcctcagcctcccaagtagctgggttacaagcacacgccaccatgcccagctaatttttgtatttttagtagagacagggtttcgccacgttggccaggctggtcttgaactcctgacctcaggtgatccatccacctcagcctcccaaagtgctggggttacaggtgtaagccactgggcccagccaaggaagtgatctttgagctgaggctccaaggaggtgtgggagcagctgtgagaaaagctggaagagagtgactcagcagagggaacagcaggtgcaaaggccctgaggcaggtggggatcagcttgctgggtgcagagcctcatgcactgtggtaggggtttggctgttacccacagtgagaggggagccacagaggtggtgagggcggaagtaggagcccagtgaggatgaggacgtggtggtccagccagggcagctagactgggctggggccatgggtggtggaacacaggtgacatggtcaggtccaacccctgggacttgcttaaaatgcatgtgggtgtgagagacacagagggcggcctccaagaaaccgcccgaaaaggcagtggtgccctgatgttatctgtagtcatactgaaaagaaaagtgcggccggggcggtggctcacacctgtaatcccagcactttgtgaggccgaggcaggtggatcacctgaggtcaggagttcaagacaagcctgaccaatatggtgaaaccccgtctcaactaaaaatacaaaaattagccgggcatggtggtggtgcctgtaatcccagctacttgggaggatgaggcaggaaaatcacgtgaaccaggaggcagaggttgcggtgagctgagatcctgccactgcactctagcctgggtgtcagtgctagatgccgtctcaaaaaaaaaaaaaagagagagagagaatggtggcatgactcccagtattaggcacctactgtatgcactagcccattcaactctatcactgtagacccattttacagatgaggctgaggaaagtaaaggcaaaggtgacccggcactgccccaccccatggtgcttgcccccatgcagccctcaggcctgcggcgctttgacgatggggcatgtgagggacccctctccccgacttccctgggtgatgaagccccagcctcttctctccaggacccagggtcagcacattccttcagggcagttgagaagggcaggtgacgggggagatctgggaacttggaagaggccttggcttctgccttctgcccctggatccccctctctctgccccaggtcccccctctctctgccccaggtccccccacactctgcacccggtttccccctctctctgccccctgggtccccctctctctgcgcctggtctcccttctctctgccactggtctcccgtctctctgcccctggtctcccgtctctctgccactggtctccaatctctctgcccctgttctcccttctctctgcccctggtctcctgtctgtctgcccctggtctcccttctctctgcccctggtctcccgtctctctgcccctggtctcccgtctctctgcccctggtctcccgtctgtctgcccctggtctcccttctctctgcccctggtctcctgtctgtctgcccctggtccccttctctctgcccctggtctcccgtctctctgctcctcgtgctccctctctgcgcaagagatgaggacactgagcaggctgtgataagaaccacagcaagtgtttgttaaatggatgagtgatgtttgggttctggacatgggagggcggatgtggaagtggtgaaaagtctcctgctgaatgtgggggacagaggagtggggacattttgaggggagagggagaggaggaaacagcgggaggcatcggggagttggtgggatcgggaggtggaggctgggggtaaaaagacacatcagtcagtgatcaggagactctgggggtccctttcacaggggaccggacccgtgtatggggaagagcaggtccccaagcccccccaccaccacaccccctaatcccgacgtgcccattaatgttgttaattgcagcggttcagtctgacccaggctgatcctgggagagggaaaatgaaggaattagcaaaaatgacaggggaaaattgcgacaattagcaggcagcattgttcctgcctgtcacccggctggttccgagctgtatcttgagggagggggtccccgtcaaccccccagccccccagtaattgttcctggagctccaggcggaggtggaggcagggaggaacagccaggagggtgtggggtactcctgggaggaggaagctcagcccagacactagggggctggggaggcgggggctgcgcgcccatgggggaggggcggggtttcgccgcctggtgttttgatggtcgggtaataacaatagtaatcacactattaataccagtcccggctctgtgctgcagcatctgcttctgccaggccccagccaggcccttctgtctgttaagtggactgaatgcgtaaccagcctggggagtcaccgctcctggcaaacccgcttgacagaggaggaaactgaggcacagagcggcagagaggctggtcccagggcacacagccagggaggggaagcgctggggcctgacaggagacctggccccttagccccataggaaaaaggcacttggggaccctcaaggtcaccaagtctctcccctggctccccactctcagcactgggttggagctccctcgggggttgtcctctgcagggtcagggtcacccaggggtcctgggtggggacaggctccgggacccccaggtctctgcctacccccagcacaaggtccagggtcctagctcctgactgtagggaggatggggcagggggcacaggtctcactttgtcttggtctcagttgccatctctgtctctctctgcatctcttttcctctgtctctccatgtctatttttttttttagtttttgtttgtttgtttgtttttgtttttatttttgtttttttgagatggagtcttgctcttgctgcccaggctggagtgcaatggcacaatctcggctcactgcaacctctgcctcccgggttcaagtgattctcctgcctcagcctccagagtagctgggactacaggtgcacaccaccacgcccggctagtttttctgtatttttagtagagacagggtttcactatgttggccaggaaggtctcgaactcctgacctcaggtgatctgcccacctcagcctctcaaagtgctgagattataggcgtgagccactgcacccggccttagtatttttatttattattattattattattattgagatgcagtttcactcttgttgcccaggctggagtgcagtggtgggatctcagctcactgcaacctccacgtcccgggttcaagcaattctccctcctcagcctcccgaatagctgggaccacaggcacatgctaccacacccagctaattttttgtatttttggtagagacaaagtttcaccatgttggccaggctggtcttgaactcctggcctcaggtgatccacccacctccgcctcccaaagcactgagattacaggtgtgagccacagtgcccggcctccccattttatttactcattcatgagttggacatttgtgtgctttccaccttttgaatgatgtgaagtatgctgctatgaacacgcatgtacatgctacaacgcctgttttcaattcttttgattacatagattacatacacagaagtggatttgctaactcgtatgataattccatgttaacttattgagaaaccgtcaaattgttttccacagtggctgtacaattttacattcccaccagcaatgtacgagggttccaatttcaccacatccttaccaacacttactttctgtgttttttgttttgttttgtttttgtttttgtttgtttgttttttgagatggagtctcgctctgtcacccaggatggagtgcagtggtgtgatctcagctcactgcaagctccacctcctgggttcaagggattctcctgcctcagccgcctaagtagctgggattataggtgcacgccaccacgcccagctaatttttatatttttagtagagataagatttcaccatgttggccaggctggtctcaaactcctgaccttgtgatccacccgcctcggcctcccaaagtgctgggattacaggcatgagccaccgcgcctggccactttctacttttttgatgctagccatcctagcgggtgtggagtggtgtctcatagtggttttgattttcattttcctaatgactaatgatgttgggcatcttttcatgtgcttattggccatttgtgtatcttctttggagaagtatctattcaagtcctttgcccatttttaaaaatatattttttgtagagatgggggtctcactgcattgcccaggctggtcttgatctcttgggttcaagcaatcctcccacctcagcctcccaaagtgctgagatcacaggtatgagccaccgtgcctggccctttgcctttttttttttttttttttgtctgagacggagtctcactctgtcgcccaggctgcaatgcaatggccctaactcagctcactgcaacctctgcctctgggttcaagcgatttatcctgcctcagcctcccgagtagctggaattataggcacccgccatcatgcccagctaatttttgtagagatggggtttcataatgttggctggtctcgaactcctgacctcaggtgatccacccaccttggcctcccagagtgttgggattacaggcgtgagccaccacactgggcccctttgcccatttttgaattgtctttttgttgttgagttgtagaatctctatctctttctattcctttatatccctctgtctctgtctttcagtctcctctctgcctccttctcatccttcaggtctgctcaaatgtcccctccttcaacagccctaactccattactctccattttgcaccacctatttcattctccatagcactggccacaaagggtaattccatatttgttagtttctttgtgtgtgtgtgtgtgtttttttttttttttttaaacagacggagtctcactttgttgcccaggctgcagtgcagtggcgcgatcttgactcactgcaacctccgcttcccaggttcaagcgatcctcctacctagcctcctaaatagctggaattacaggcccacgccaccatgcccagctaatttttttgtgtttttagtagggacggtttcaccatgttgcccaggctggtctcaaactcctgacctcaagtgatctaccctcctcggcctcccaaagtgcttggattataggcatgagccacctcgcccagcctgttggtttcttttctttctctctttctttctttcttttttttttttgagatggagtctcgcactgtcatccaggctggagtgcagtggcatgatctcggctcactgcaacctctgcctcccggtttcaagcgattctcctgcctcaacctcccgagtagccaggactacaggcgcccacctccacacccggctaatttttgtattttcagtagagatggggatccaacatattggccaggctggtctcgaacccctgaccttgtgatctgcctgcctcagcctcccaaagtgctgggattacaggtgtgagccacctcgcccagcctgttggtttcttatttatttatttttatgggatccctaagcagagatgttagtttcttgcttgctgttcaactgcccctggtctgagagcccagcaggaggcaggggttgctgggctgtcctggtcaccgttgcactcccagcaatgcctagtgcaggacatagggagggtaggtattcagggagcttttgtgagtgaatgggtggatgaatgaatgagtccctctatgcaccccctggcccgtctgtctctgtgagtcagtctgtcactcactgtcccacccacctgtgtgtcccacgccccaggtctctcccccatgggtgcccagataccccaagatgtctacaagccttaggggaagagagggaggtttgtagactggctcccgggggacctgccctgggcagggtcagccagactaacaggcttcatccttccatctgccccagccccaggccgccgcggccccgcagcgctggtctccgaagtcttcgagcagcacctgggaggtcacatcttgcaggtgagtgaggccccttccctgcctgccgctccttgctaccacctagcggccgcctctggagaacagcagcctcttcagcatccatctattgtggggggtacctggactgggaaggcgaatgctcaagatccctccactccctgccccttccgaggaccactgaagccccctccccaccaaaacagtccacctcaggtggagacccaggtttcagaacctcttaccacttggcggctggacagagggacaccgggtcctctccttccccctccctgtctctcccggctctagtccctggatggctttgtgttcgccttgaaccaggaaggaaaattcctctacatctcagagacagtctccatctatctgggtctctcacaggtaagggacccccagtggacctggattggctcagccaccatctcccttgccaggcctatgcatatccttcctctctcctggtctcaccatagcagcaagaaaaatggactggatctctgtggtccccaaagtgtgttccttggcaccccacatggcacccagcatggttcatccttgaaggcagaggagggctattgttttttgtttgtttgtttgtttgtttttgagacggagtctcgctctatcacccaggctggagtgcagtggtgcgatcttcgctcagtgcaacctccacctcccgggttcaaacaattctcctgcctcagcctcctgagtagctgggactacaggcgcccaccacacccggctaactttttgtatttttagtaaagatggggtttcaccatgttagccaggatggttgagatctcctgacctcgtgatccacctgcctcggcctcccaaagtgctaggattacagtgtgagccactgtcctggctgatgagggctatttttttttttttgagttggagtttccctcttgttgcccaggctggagtgcaatggtacgatctcagctcactgcaacctctgcctcctgggttcaagcgattctcctgcctcagcctcccgagtagctgggattacagacatgcaccaccacgcctagctaactttgtattttttaaatagagacagggtttcttcatgttggtcaggcttgtcttgaactctcaatctcaggcaatccgcctgcctcagcctcccaaagtgctgggattacagcgtgagccaccgcgcccagcctgagggggctattaaagtaacaagtagatctgaggaaagcaggttcactgaaagatcagtttgccaatgactggcgggccagatgcaccatatttgccaacactgtttcttcttaacaattttaaaggtttagaggccacccacgctggctcatgcctgtaatcccaacactttgggaggctgagcccaggaggatcacctgaggccaggaattcaaaaccagcctggcaacatagtgagacaccccacaccccaccccaccatctctacaaaaaacttaaaaattagccaggcatggtggcacactgttgtcccagctactcaggaggttgagatgggaggatcgcttgagcccatagggtcaaggtggcagtgagccatgatgaagccactgcactccaacatggacaacaaagtgaggctatgccttaaaaaaaaaaaaaaaaaaaaaaaaaaaaaaaaaaaaaaaaaaaaaaaagggccgggcgcggtggctcacgcctgtaatcccagcactttgggaggccgaggcaggcaaatcacctgaggttgggaattcaagaccagcctgaccaacatggagaaaccccgtctctctactaaaaaacaaaaaatacaaaattagccaggcgtggtggcagacacctgtaatcccagctactcgggaggctgaggcaagataatcacttgaacccaggaagtggagggtacagtgagccgagatcgtggcattgcactccagcctgggcaacaagagcaaaactccgtctcaaaaaaaaaaaaaaaaaaagggcaggaagacctactgaaagccccatccttggagccctggcatctcacagcaccttaagctttgccagtccctccaatacaaattgctatcaactttgatcatttttacaaatatttttcacaaataggaaatttaggaaattcagtgcattggcaacttgtgagtaccttttcagtgagattcctggaggaggaagacaccaaaaggaggggaatttggacaagaggacgggagggaggaagagtggaggaaaagcttggccaggtgtggtggctcacgcctgtaatcccagcactttgggaggcaaaagcaggcagatcacctgaggtcaggagttcgagaccaacctgggcaacatggcgaaacccagtctctactaaaaatacaaaattagccgggtgtgctggcagatgcctatagtcccagctactccagaggctgaggcagaagaatcacttgaacccaggaggcagaggttgcagtgagccaagattgcaccattgcactccagcctgggcaacgagagcaaaaccccatctcaaaaacaaaacaaaacaaaaaaagtccaggcgcggtggctcatgcccgtaaacccagcactttgggaggctgaggcgggcagatcacctgaggtcgggagtttgagaccagcctgaccaacatggagaaaccccgtctgtactaaaaatacaaaattagccaggtgtgttggcacatgcctgtaatcccagcttcttgggaggccgaggcgggagaattgcttgaacctgggaggcagaggtcacggtgagccgagatcgcgccattgcactccagcctgggcaacaagagcaaaactccgtctaaaaaaataaaaagaagaagaagaagaagaagaagaagaagaaggaaaggcttgaagctgttgaagctggcgtgggggaggatttaatgagggggcggagcccagagggataacggactgagggaagcatgtgacctccaagctgaggggcaatgggagtcatggcagccatggtggtcaggtaagtaacttgcagaggcatctttgaactgtaggtcagaagaccagtgaggacgcgggggcagaaacacagtggggagaagatgggggcctgcattgagggaggcagggagagaaggggactgctaggagagagatttacgggtagaattgaatgtaaaagtgtctgattgaaaagctctaactctttaagagcttaaaaaccactcccctgtttgtatcttgaatctcattcctgctgggacacccagtgattcatgccagggcacagttgtttgctgtatgggggtggtagtgagtaagcaggagttgggtaaacggaggttctgacacctcccacccacgccccactcccacacacagccccttaatagagtgggcggggaaaaatccttactaatcactgggtatgaagcgagaagagtctaagtttgtatcttccgtttgaaaggtaattgttttttgtttttttcttttcttaaaaaaacacactggcatgaagcgcacctgcgtgcaggcaaatgaggcaaggctgagcccagagggcgagcgagttactgcgcgcgcacctcacccgccccctgcattcccctccttcgccggcaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcggtaattctaagggctcctaaagaatgaagtctgagggtagatcgggggacgcccgctgtactgtatccagccatgccgcgtttatacaaatagcagtgaagttagaactgtgtagaacgaatctttgcaaaaggaatcggagtataaattgaggcggtgagacttggttccttaagcttgccaaactcccaaagattcgagctacagaaagacccccctggctgctgaaaggagttgggagaggcttaggtaaataacaaggcaggcttattgggaatatacaccggctgtgtctgtaagtgcacaatcacattacataattacgttagggccgggcgcggcggctcgcgcctgtaaccccggcacttcgggaggcccaggggggcggatcacttgagctcggttggagaccagcctgggcaacatagtgaaacctcatctctacaaaaattacaaaaaaggccaggagtggtggcacaaagctgtagccccagcactttgggaggccgaggcgggtgggtcacctaaagtcaggagtttgagaccagcctggcttgcatagtgaaaccccatctctactaaaaatacaaaaaaaaaaaaaaaattagctgggtatggtggggggtgcctgagtcccagctactcgggaggctgaggcagaaggatcacttgaacccaggagatggatgttgcagtgagcagagattgtgccactgcactccagcctgggcgagtccaagactgtctccaaaaaaaacaacaacaacaaaagaaagaaaaaaacattagctgggcatgatgacacatgccagtggtcccagctacttgggaggtgggaggatggcttgagccttggggacagaggttgcagtgaggagatcacgttgctgcactccagcccgggtgacaaagccagtgtctggaaaaaaaaaaaaaaaaaggctgggtgcggtggctcacgcctgtaatcccagcactttgggaggccgaagtgggcggatcacctgaggtcgggagttcgagaccagcctggccagcatggtgaaaccccatctctactaaaaatacaaaaattagccgggcgtggtgcaggtgcctgtgatcccagatactcaggatgctgaggcaggagaatcgcttgaacctgggaggtggaggttgcactgagccgagatcaggccattgcactctgagtgagactccgtctccaaaaaaaaaaaaaaaaaaaaaaaaaaaaaattgcattagatcctaagcgcaggcccacaatgcaagaagtgttatctccattttacatcagaaaactgaggcacggcgcggagaggttaagttaattgcccccaggtcacacagctataagtgattgagttggattctagcccaggtctgtctgttccggggtcagcacgcctaacccttctctccagtggaaatttccactcccactgtgtatgggagggagggtgctgcagattaccctgccggctctttttagctctgagatgttgggggcctatgaggctaactatcctgtaaataggattttccaatcttgggtttgcttaacaccaaaaacatctgagacatcagctgtgcttgcaagcgtggggcgaagtctgcaacacgtgcaggctgttggggagtgggactgtgtttgtacctgagttttaggcacagggtcatctgtgtgtgagcatatttttaagaccgttttgtaggggttacagaaggatctggatttgtgagtcttatttattgctattccccaatcccctgttctgggccagcccctgtcctggtgacataggagtgaccatgacagctccagccccacccacctggggctcccagtccagtgaggggagaccaacctgtcctcagacagtggcaacccagatggggcagggctgggataggggaacccagaggggatggctgacccagcctgagggtcagggagggcttcttggaggaggagaagtctgtgctgagacctggaggatgggtcctgagaggtgggctttcctctcaaggcctcaggaagctatggcaggttcagagcaggggagggtggaggcacgtttgagcattagaaagacgtagatggggccaggcgcagtggctcacgcctgtaatcccagcactttgggaggccgaggcggccagatcacgaggtcaagagattgagaccatcctggccaacatggcgataccccgtctctactaaaaatacaaaaactagctgggcatgatggcgcgtgcctgtaattccagctactcaggaagctgaggcaggagaatcacttgaactggggagacggaggtcgcagtaggccgagatcgtgccactgcactctagcctggtgacagagcgagactccagctcaaaaaaaaaaaaaaaaaagacatggatgggaccagacatggtggctcacacatgtaattgtagcaccttgggaggccaaggagggcagatcccttgaagtcaggagttcaaaaccagcctggccaacatggcaaaaccccgtctctactaaaaatacaaaaattagtcgggcatggtagcatgtgcctgtaatcccagctacttgggaggctgaggcagaagaatcacttgaacccaggaggcggaggttgcagtgagccaagattgcgccattcactccagcctggacaacagagtgatattcagtctcaaaaaaaaaaagaaaggatgcggatggctgccacataggggagcccacatactgtccccatgagctttcaaaatcatcaggcatgcctctgagtgcggccgtggcccagcggacatcttgtgtctatgtccggctggctctgcaagggtcagggtggcctgtgtgtttcctcttcaggaccccataaccttccttcactctctgtcccagaggccagcctcaccaaggtgcccccctcctccctggtccaggagcgctccttctttgtccgcatgaaatccacgctcaccaagagggggctgcacgtcaaggcctcagggtacaaggtgggtgtgagcagtcaggctcctgtattccaggcagccatgtccccagattgagggtgaccgagggaaccaggctggtggcttcactggctgcaggtggcttagggaactgggtctgggaatgggactgggggggtcacacagtgtccagtcctccagcacctgtgggggacagagggaacccagcccagtgatggtcctcttgcccccactggcccgccttgtccctcctccaaccatgcccaccaccagcaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcaggtaccggggttgggggctgtggcgggtggattgggggcacaatggagatctgggggtacatggggagtcagagggagtgctgggtctgcaggatagggcactggggagccatgggaggcggaacagcaatggatgggacagggtgatggggagaagggagggaaggcaggggaccagggcggaggcctagcccaggggtgccttcggggatggaagaggggctgtgtcttgggtccgggccctccttctggggctgcagatcttggcccgtctctggtctttcatttctcatttctctggtctttcatctctcatccatttcctctcctgcatcccgcagtggaggcaaattaagtgctgaaatagtcccatgctctgaggtgtccagggtgcctagggccttgccactagcatccacgcgaatactcgcagctgccccgggagagacactgttttgtggtttgtttgtttgtttgttttgagatggagtctcactctgtcaggctggagtgcagtggcgcaatctcagctcactgcaacctccacctcccgggttcaagtgattctcttgcctcagcctctcaagtagctgggattataggcgtgcaccaccacaaccagctaatttttgtatttttagtagagacggggtttcaccatcttaggcaggctggtctcgaactcctgacctcaagtgatccacacgcctcagcctcccaaagtgctgggattacaggtgtgagccaccgcgcctgccaacactgttattgcacccattttacagcaagggtgtgaaccccaggggactctggagccaactctgcctctcccccaaccccgtggtcttggactcctcccctcttctctgtcaccccccagagtcagcgaccacatggacctggggccctcagagctggtgggccgcagctgctaccagtttgtccacggacaggacgccacgaggatccgccagagccacgtggactgtgagacccacctccacccaccaagcctgcctaccaccccccagacccgagcatcccactccctggtccctggaagtccttcttcagggctgcccacagtccctcctgctgcacctacagctccagggactccgtttagcattggaagagcagcaaggagactgagtgatgcctcaggatgtgtgtgtggggggggggtctggggggctgtggggtctccaaaacacccaagaggcctcgctgctgggctacctctcagtctctctgactctgcctctctgtgctttcacctttttctcttctccccaccgtctccctgcccactcccctgctctcactcctcctgtctcctcctgtctacctggctctctgtcttgcccctgtccccaccccacccccttcccatctctccctgggctgggcccagtgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcaggtgagggctgtgcccacccctcctgcagggcactcagggccctgctgtctctccccacctccagtgggggtgctttggggagggcttctagaatgggacaagcccagggggtctgcagacacgaaggggaaggaggggaggatggtgagagcagaggcccagagtggaacggtcttgctggcaggagacagagaggagtcgccagggggagggggacagtatctttgaggaaggcaggggcaggctcacagcctcctcaggctcaggtggagggtctggactcttgactctggggcactggcgagccacggcaggctcttaccaggggaggcccacagagcacagcaactaatggaaagaagcagggaggggtgttccaagcagaggaagggctccaagcaacagcctgaccctaaaggtaatgccttgggctggagtagaaagcagtgagaaaccagcctgaagatgacggcctggccttttggctcaggggcactggggagtcatagaaagctttagagctggagaggatcatagtcagatctgctttttagaaagactgctctagaccggacatggtggctcatgcctgtaatcccaacaatttgggaggccaaggcaggtggtttgcctgagcccaggagctgaagaccagcctgggcaaccaagtgaggtcccatctctattaaaaaaaaatttttttaattggcccgttacagtggcacgcacctgtggtcccagctacagcagaggctgaggtgggaggatcacctgagcccaggaggtcgaggctgcagtgagccgtgatcgtgccactgctctccagcctgggcgacagagtgagaccctgtctcaaaaaaaaaaaaaaaaaaaaaaaaaaaaggaaaaaacacccttctaggccaggcacagtggctcacgcctggaatcccagcactttgggaggccgaggtgggtggatcacgaggtcaggagttgaagaccagcctggccaagacagtgaaacctcatctctactaaaaatttaaaaaaaattagctgggcatagtggtgcacgcctgtaatcccagctactcgggaggctgaagcaggagaattacttgaacccgggaggtggaggttgcagtgagccaagatcatgccactgcactccagcctgggcaacacagtgagactccatctcaaaaacaagcaagcaaacaaaaaaacccttctagctgccatgaaggaggcactgagggacaagatgggcgctggaggaccagggcagaggctggggccagtcctgggaagtgccagactctatgggggaggaggggaggagaccatcttctgcccaggtctctggctttgctgagcccggatttgggctcctgagaggaacagcaggtttgaaaggaagatgtagacatcagatgggcatgaggtgccagaggacacccaggtggtgacatccaggtggccaccggctatccaggtctggccttaggagcgagggccacgctgggctagaagtcaacccggagtttagggatctggtgttgagccttgtaagtgcctcagggtggggactccacatttccccgtgggagtgtccacacattgccacaagttgggtaaagcaggagggagtcctgagaggccaaggacccctggctcctaaccgcatccatcttctccccagccaagccgagggtggccaaactcctttggatgccttccagcttccagccagcgtggcctgtgaggaggcatccagcccggggccagagcccacaggtgagccccacctcccaccttggcccctgggaagctccaaggaacctttgggtcctggctgtccattccagaagccactagccacatgcagccatttatatacaattaaaattaaaatccaggccggtgcggtggctcacgcctgtaatcccagcactttgggaggccgaggcaggtggatcacgaggtcaagagatcaagaccaacatggtgaaaccttgtctctactaaaaatacaaaaattagctgggcgtggtggcatgcgcctgtaatcccagctacttgaaaggctgaggcaggagaatcgcttgaacccgggaggcggagattgcaccactgcactccagcctagcgacagagcgagactctgtctcaaaaaaaaaaaaaaaaaaatttaaatccaggccaggagtggtgactcaagcctgtaatcccagtactttgggaggccgaggcaggcagatcaccaggtcaggagatggagaccatcctggctaataaggtgaaaccccatctctactaaaaatacaaaaaaattagctggacatggtgccatgctcctgtaatcccaactactcgggaggctaaggcaggagaatcgcttgaacccggagggcagaggttgcagtgagccgagatcatgccactgcactccagtctaggtgacagagcaagatttaaaacaaaacaaacaaacaaaaaattagctgggcatggtggcacgtgcctgtagtcccagctactcaggaggctgaggcaggagagtcgcttctacccaggagtcagaggttgcagtgagctgagatctcaccgctgcactccagcctgggtgacagagtgagactccatctcaaaaaaataaaataaaataaaatccaggcccggtgtggtggcttatgcctgtaaacccagaactttgggaggctgaggtaagagaattgctttagcctaagagttcaagacaagcctgggcaacatagtgagaccccatctcaacaaaaaattttaaaacttagccaggtgtgatggttcacacccatagtcccagctactcgggaggctgaggtggtaggatttcttgagcccgggagttagaggctgcagtgcgctgtgacagctgtactgcactccagcctgggtgacggggtaagacctcgtctcaaacaaatttatttatttttttagggggatggagtttcactcttcttgcccaggttggagtgcaatagcacaatctcggctcactgcaacctccgcctcccgggttcaagtgattctcctgcctcagcctcccaagtagctgggattacaggcacctaccaccatgcctggctaatttagtatttttagtagagacagtgttttgccacgttggccaggctggtctcgaactcctgacctcaagtgattctcctgcctgggcctcccaaagtgctgggattacaggcatgagccaccatgccctgcaaaacaaaacaaaacaaaaaacactttaaatccatgtcctcactcacacctgccacatattgcatgcacagtggccacatgtggccagtggctgcttcgtgggacagtgtggatgtagaacatttccattaccacagaaagctctatcctggaaacttccactgaagagcacaggtctagaccagggtatcttgatctctgctctactgacattttagggccaggtgattctgtgttggaggggacactgtgggatgtttattttacagcatccctggcctctaccctctagatgccaatggtgacctccccagggctgtgacaccccaaaatatctccagatattgccaggtgtctcctggtgacagaaccagctggccgggcacagtggctcacgcctgtaatcccagcactttgggaggctgaggcaggcagatcacctgaggtcaggagtttgagaccagtctggccaacatggcgacaccccatctctacttaaaatagaaaaattagctgggtgtggtggcacacacctgtaatcccagctactggggaggctgaggcaggagaatagcttgaaccccagaggcggaggttgcagtgagctgagatggtgctggtgcactccagcctgggggacagagcaagactccgtctcaaaaaaaaacaaaaaacaaaaacaaaacaaacaaacaaacaaaaaaaccccactcccagctgagaactacaggtctggcccactaagcacagctccattccacagatgggaagactgagggctggggacacacacaggccctcagcatcttcctcttccagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttgggctccgggctgtgagctcctctgtccatttctgtctcccccgggtcctcacccccctctccctccacccgccctcctgcctctccagttagtccgctcctcgccgcccttcccaaggaacacgaaccaatactctgcatctggaggaggggaggtcaggtttaatgtcccagtcctcgggcgctgtccagcgcctgccaggccccacggccgtgtcgctcactcgggtggcggccgacccgcctcatcagggccttccgcggaggccgtcccgtcgtcctcgggcaccagctccacgtccagctccagctgccccatgtagaggcccacggcgcacgcccagagcaggctggcggccagcacggcgcccgcgcccacggccgcgccccccagcgtcagctgcatgggtcctcgcagcgccgccaggcccacggcgtacgaggcgctgccccacaccacgcacaggccgcccagcaggaagaagcctgcgggagaggcagggtagcaacagggccaaggtcgggggatggtctgggagcaaagccagggttgaggagacaggaacagaggcagggccgtgccaggggctagcctgcatctttgagaatcagatcggaggggaggggaccataaccatgtcctgggccacccattcagatggacctagtgcctatgggaggggtgtcttctggtgggggaagaatgggggttctatacttactactgggagtgggatggggtaggagagtctactctcaccagggcaggtgataggggctctgcattccctggttccgtggggcgagagggggggtctgcactcaccatatgctgcttcccgacccatgtcactctgcatgaaggagatgaccccgatgcccgatgccaggaggccattgcggaaccaggagaggaaggctggagggagggggacatggggggattaacatcacccccaaccctacctcctcaatcccccttacccagtcaaactgaggggcctcccttcagctcaccccatcccatccagccgcaaggcaagcccatcccaaatcctcacctcttccaggaagccgctcacctaaccatatccccccacatcctctctggcctccacctcagtgcccctctcccccaaactctgtaacactaaggattcaagggccgggtgtggtggctcacccctgtaatcccagcactttgggaggccaaggcaggcggatcatgaggtcaggagtttgagaccagcctggccaacatagtcaaaccctgtctctactaaaaatgttaaaattagcagggtgtggtagcacgtgcttgtagtcccagctactcaggaagctgagggaggagaatcacttgaatccaggaggtagaggttgcagcgagccaagatcatgccactgcactccagcctgggcgacagagtgagactccgtctcaaaaaaaataaaggattcaagatagtccctgcagaatgtggaggacaatctaggggcaaagttgcagaacctccatctgaggagtcatcttggccaaacccctccctctacgtgtacccccacggcctgcccactcacttctttctcagaactctgggacaaactgtttcctaatccaggccgctcttcagcctcgcccttcttttccttcaaatgccgccatctcctaccgagtatggcctgggccaatcccatccatgtcctaccgagtatggcctgggccaatcccacccacgtccgtccccattcacgtcctttacaaacagcccaccacaccctatatctagatgcccggtcctggcctagtgaggtgactcacacctataatcccagcactttgggaagccaaggcaggaggattctctgagcccaagagttcagaccagcctgggcaacaaagcaagaccccgtctctacataaattaaaatagttgggtgcggtggtgtatgcctgtagctccagctaagcaggaggctgaggcaagaggat

SEQ ID NO: 13077 - DNA, 57559 bp, Human
ccagcctgggtgacaaagtgagattctgtcgaaagaaagaggaaagaaagaaggaaggaaggaaggaaggaaagaaagagaaagaaagaaagaaaaagaaagaaagaaagaaaattagctggtgtggtggcttatgcctatagtcccagctacttgagaggctaggttggaaggatcacttgagcccaggagtttcagactgcaatcccgcctgggcgacagagtaagacccctatctaaaaaaaaaaaaaaaacaaaaaacaaaacaaacaaaaaaaaaacgaatgaacaaataaaaagaaaaaagataggtaaacataaagaaaaattaactcatcattcaatcattcattcattgttgccaccgacattagtagaaattaattaaatgcctactatgtggctgttctggggcagaggagaagcaccaaacatttaagagtatctctgaaggggtggaattaccacgcattcaaacagcccttccaccaatgtttactgagcatctacatgccaacagtgctggggcactgggaatgcagcagtgaacaaagacagaaatccatgttgtcatggggctgacattccagcagaggagacaaccaacaagcaataactacaattaggagtgagaaataagaacaaagcagacagagtttggtagtatgtgagagggatgtttgctgctttccttagggtgagcgagggaattagttcacagagaaagtgacatctgtgtaaagccctgaaaaaagggagggagagataaggatacctgggggaagagtatgttccaggcagaggaacaaccagtgcaaagactgtgaggtgagagcgcacctgacaagagttcaggaacagcatgaaggctggagtccagtgaataagatccaggaggagagatgtctggccgggcgcagtggctcacgcctgcaatcccagcactttgggaggccgaggcaggagtatagtttgagcccaggagttcgagaccagcctggccaacacaacaaaactctctctttaaaaataaaagaaaaaggccagcttggtggctcacacgtgtaatcccagcactctgggaggccgaggcggatagatcacctgaggtcaggagttcgacctggccaacatggtgaaacgctgtctctactaaaaatacaaaaaattagctgggtgtggtggtggacgcctgtaattccagctactcaggaggctgaggcaggagaatctcttgaacccgggaggcggaggttgcagtgagctgagatcgcgccattgcactccagcctgggcaacaagagcgaaactctatctcaagacaaataaataagtaaaaataaaattaaaaaaaatttttaaagatgtctgctgtttgttttcaatattttgaccaattacttcgtaaaaacttatttaaaaattgaagagcaaacagtctcaggttcccgggctcagacagaccagcgttcaaaactcattaccttctttctatgatgctaagccagctatttcaccctctgaacctctgtttctttatctgtaaaatgggtattaatgatattataccacagggttgtatatgcagcgagaaaatgcaagtaaaacacttatcccggtgcctgcctcctagtaagtgcttaagaactgtttctgcccattaactcattactttctcccagcccctaactccttctgggggggaagttagaaaatcggtatcacacgaaaacagtcatttcccctttaaggacctcagtgggccgggagccagccttcccgcaccttttccaaaatttccaatccccgcttggcattttctgcccgaaggtctccgattggacgctctgtaccaatcggaggctggagcgggccctgagaggcgcccgactccgcccccgcactggccctgcccactgcccggtcagcctcgttgctatggggactggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggtaggataaggggtccggccaggggcttgcggtgggccgggcgctggcggcgggacggcgtttccgcgaggaggggggcggggccgccggggtcaaaggtcactggtggagggaagggtcgcgtccgaggggtcgggggttaacgcagactggagggagttgtagtggaggtcggagatcaaaccagcgaagggggcgtggcgaaggggagtgcaaagtttgaaattcgaagtgggggcgcgttcgaggggttctgggcgagtctcaaaaaaggcagggtcaaagttaataatttgagggaaggctgcccccacgagggtcagaggtcacagccccaggggcgccaggttggaggtttaaagctgcccctagcggagcagatgaatgagttttaggttcgggggcgtcttttaggggttcaaagctggggcgtgcctagaaggtacaaaggtgagaatctgacagcggggcagctgtttcccagagtcaaaaattaaaacccaaggagggcgtattgcgggggacggggagggggggggcggcgggtcagagatgcttcctggtgacaggagaagggggaaccctcccacaaataataatggcaaacactcatgaaacactatgggctagaccctctttttaacgctttacttgtatgagcttattcagtcctcactatagtcttagggggtcttaacctggtattaagaggttaagtgatttgcacaaggtcacccgatgcataagttgtgcgctgggattctaactccggagttctggcccagagccctgctctggccgaccgcctctcaaatcatcataatgtcggttaatgtttaatgagggctcacactgtgctccacgccctgtgtgcccggtcgtatttcactcctgctgcaatcttgtgaagtgagtgctcaagatgaacctactttacagacgggaaaaatgaggctcagaagcttctgctgaaggcagagttagaatcgaagctgggcctgggtgattccagggctcctgcccctggtcgccacattgtccgctgccagccattaggtctctcctggaagcagggggctgggcagggctgggccactccctgggcggatcggattgtctgcttggtttccttggaagggtgtgatctggcagggaagattcctgtgagcctatgggagtagggtgtttgtaggtggtctggagtccgagcaagggagtccgacgggcttctgactggggagagtgtccctgggtggtaccctgggcagagcggggtgttcactgttcttaaaaccctaagctctcactgtggtccttagtcactcccacctcacttcttatggctctgcccatttctccccagcccctttactgttctccaactccaggcccatgcctcccgcccggtctttgaccttcctgttccttctgctgggaatcctttccccaccctgccctctctcactgacgggtcgctcactctcagctggcccgggaccaccctggctcgccttgctgcaggctctttttctctcatctgaccagcccttacctccctccttaccttaattattagggtgcatggtggaattgctctgtggggttccttgcctcggtccccactgaagccctgcctggcctgcagaggatgtgacattgctgggggttgactgttgggcactgtgccgggtgctgggagtgtggcaggggacgagatccacagagcccctagcctcagagggcactcagttccctggtgggagcagagtggaaccagcccccaagccagtgacacaagactgcgtctctgcaaacggtgatgtggcttgcgagggcatcttcagagagccgggagagtgcccctaccctgggctgaagcctgagtccctttcccctgggaaggctctgaaggatggggaggagggctgggaatgggcttaccaggcaggaggagcagtgtgtgcagaggccctggcatgactggaggtcaggactcgggtgcacagttggggatctgggcaacacgtagcctgtgcaggttcagggcaagaccctgaggggactcagctttggagggacggtgggagcaggggagggctgaggagtacctgtatgtgtggagctgcctgaggccttgatggagcgtgattcagaaagcagtgctgggccagagatgcctggtacacacccctctccatcactcacagagcatgtgaggacctccgtttccacttctgcaagatgggcatagtgttagcgctgcctcatagaattgctgtgaggatgcaggctagagagccttggcccaaggcctggcatacagtagttgctgtgtaagcattagtcttgctgctgctgctgctgccaccccaccactgcctggggagggcctcagagacagtggaggccctcgctccacctgcctcctggctttctctggcagccaccccatccctacctggctctggcagggtcagggagccggcacactgccaggcagccctctgaggctggcccagcctcccagccttgcagtgccagctcactcagcatctcagggtttggcacagataaagaaggatagggtttgggcattggagacccatattcaggtccctcccttgtcacttaccagccatgggacaaatgatttatttgccacttttattccttcaacacgtttggctaggggaaaaagggctttcagtataatgaaacactcatgcatccggccatcgtctggcctgggacagaacacaccgtgatacagttagaggccaagggtctcctcctcaccccccctcctccctcccttccaggggcagcctctgtcctgggtgtggcagtcaccattcctctgcagcctttcatactttgactgcccttgaatgtattcaccaacagtagagcaacagctcttgcccctggctgcacattgcaactccctggagagctttgaaaagatgccttggcccaggcccgccatggaaattctgcttccaacttacttggtctgggctggggctggcctcaggcttttggaagctccctgggcagttcttatggccagcaggggctgacgactgttgtttcacagttcagataaatggtgtcaccataaacatgcctttctgcaagttgctgtttttgttcaacattataggtatatttgagatgggatcttgctatgttgcctagactggactcttaactcctgggctcaagctatcctcccacctcagcctctggagtagctgggattacaggcgcgcacacctgctccccgctttgagctgagcattggagtctggatgtctcttggtggggatgtgtgtaggcctgggacaggccatttgtttttcctgatggtgtttctttttgtgatcgtgtcacacaggagttgcctgttcacctgttgatggccactgaggtggtccgttggagctataaccgtgcagcaatgggccttctggaacgcgtgttcctgtagaccatggccagagtctctctggcatatgcctagtagtggaaaagccggagctccccgctttcctagcggttgccaagtcatgcccccagtggctggaccactgtgctccccagcaggctccggggctccctttatttcaagtcctgctttgggcagctttgtggccctcactgaaacgatttcctcggccgtgacatgggaggtttatgggcccacccacccacccaccaggctgtttggaaacagatggggagatggttcacacaactggcttagctgggacctcgtccccactgactccctacaaccacaggagaagaaaggatggaagggctttcacctttacccccttgggcatccaggacggtgactgcagctttgccccaactgcccttgggggcaggtgccaggggtgacagctgggaaagagaactatactgattcgaacctctcaggagggaggcagggaggacggaggtgaaagttggaggatgggtgaggccttgtaacattctttctgtgtatctgactgttggtcccagtggtaaccaacacagcccagctctacccttgtagattatagtacagtgaaggagacagacctgctgtccccagacggtgacagcccagagaggccagggctgtgaaggagaggcctaggcgagggtcagggcgggatgtgggggggacccaggcagaagggtcagggcgggatgtgggggggacccaggcagaggggtcagggtggggtggtgggacccaggcagatgggtcatggcgggatgggagcggggacccaggcagagggatcagggtgggactgggggggacccaggcagagtggtcagagaaggatggggaaacccaggcagaggggtcagggcgggatggggaaacccaggcagaggggttggggctggatggtggggaggggcacagagagggattgggactgggatggaggcgcagggaccgtaggaagcccgaggaggcatgtggcccagcgtggggagttgaggagggctttctggataagatgacatctgactgatgagaacatatgagcgaggctggaaggaggtggaaagaatgtaacaggtcatgggtacggaagtgccaaggccctgagggtcggaatgacctcggaatggtcgaggatcatcagataggccggtgtaggctatgctgtgcaccctgactgtgtggtagccttgctctgcaaagagcagttaaagaaatacataaaatataaaataaataaataaataaaaaagcaaaaaaaagaagccagtgtggctgagcagggggtggggtcagaggcttggaggcggtgttggatacagcagggcctagcagagccaggtggggtgtgtggattccattctgtgcataatgggaagtcatcagaggctttagtgacatctggttttccccttataaagattgctcaggctgctgtgtgggggacggatcgcggggggtggcgacagggaggctgtggggaggctgctgtgacagtccaagcagaagagggtggagaagacgaggggacagtgatggaggagcgtcctcgtgccagctgaggtcatcagcgctttacccctgttacctcacttcatcttcacagcaacctgtgaagtaggtgctagtatcatcctcactctagagatgagaaaggaggcccagagaggtacgggacttgcttaaggtcacacagcaggcagtggcagaggtaggattgaaccccaggccttggggcttcagtgtcactgattactggggctgccctcccgtggtttggaactggctcggacaagacaggcctgattcctgttcagctggttcttacccaggctcctttgttgacagaagttccgtggagacctgttccccctgggtagtttctgggcgctgggtccctacctccctcagggcctccctttcctttctcatctactcctcgtcccactggctcgtggtgagccagacttcctggccagacaccggtcaggggtgtccccagcagctgtttctcccatcaccgagcccagccccgcacatgctgccagcaggaagcaacctccttccaagtcatggccagggaagtgggacccttcccgcctagtcacccatccggggccaaggcttcttgtctgccagacgccttggcccacaggaaggttggaggggccgaggagggtgagaaggggaacactctcccatcccaggggagccagcgctggcggatgcgacagaagccaccgctcactgaagcctctctcctgggaccctccggtcctgccccgacccttcccaggctgggaggccatctgctgccttcccgaggggcagtggaacttccctgccagggctgctcagtccacacacatcccttagcctttttcactagctgggagcccctggggaagagacaaagaacttccctgggcctctgattcctcacctgttacagggagtattggtggccacctctcagggctgtgggagggcggaagatcatgtgtgtgcgtcgtgcttagcccgatgctcagcactcagtaagtgcttggtaaatgttgaacttggtgcgttcgatggtttccgtcccttgcaccctgtccccctctgggttctcatcccgtagtgagctgtaataaccccagccccccgcccggggtcccagctccacgtgccaggcacgcgtgtgctgtgagtctatgagcatggtcatgtggctgtacccagagaccctgaggaggaggtgtttttaacctcgtttctcttttcccgtgttttaattttcagaaagcacgtttttcctccatgtgcatgcattacctattcccctaaataatcactgaaaaactgcacacagcacaaaaggatgtacagggacgagcaaatctctttcccacccgcctgccaggcccttcccagagatagcatcatcacccccggtttcttttctttctttcttgaaatatttgttcccccaagtgcccgcccctcccttttgtttttactcaaatggagcggacttcccatgtttatattctgtcctgtgctttgcgtttcccactccgaagctcgctgtcaggacacagagtgccgcctcgtgtcccacgcacacgcgtgcccccacggacagcacagccattctgtgctgatggccatcaggccattcccatctttccgtgctgtgaacagggctgcgcccgcctgagtgtggctgtgcatatgtctctaggtgtgagtctgagcttgtggcctcgtggtctgagacaggtgccccgttaactttgccggtagtgttagtgtttcaccctgctggggaggttgtctggctcacactcccaccccccagtgtctgatgacaccggggtttcctcactcccttgctggaatagacgggtgtcacctgacattctcacctttgccagtcagataggtgacaaacagtctcatcatggttctgattttaatcagagcaaagtgggacagctttgtgttgttgaaagccatcttgagcttccttttcttggagctgtctattcctgataattttactttctctgagaaggggaaactgaggcacaggccagcagtcccacagcaaatacgtggcagatgtggcactcaaaccttggctccgttctggagctcctaacccatctgacacagaagaggtcaagggcttggcctccggagccagctttgtctcttactagcagtgtgaccccagacaagtcacatcacctctctgtgcccgggtgtcctcatctgtaaaatgagggtgctaatgatatctactcttagagttgttttgaggatctaaatgtatattcggcaggcaaaatgtatagtaagtgctcaaagactgttagctgcgttactaatagccgtattattaatattatagctatgtcaccaatagccatgttattaatatgagcaggcactgtttgagtgctttctgtgaactaacctactggaccctcccatcaactccaagacacacgtgttcttaggatctcccttttctagggaggagactgagagcctgggggacctggccccgtcacagagcaagaggaactgggatttggatgctggaggcctggctggtaatcgctgtggccgcttcccctgctacccggggctaagcctgagggttacaaagctctccctcctgcttcccccacccaccttctgctgtctgcattccaggcaggctgcccaggagctttcgagcagacaccttgagggttgggagcaccgggtgggcagggtcctcacctagagagctccccgtcccagaccctccctgctcctgccacctgtcctgggaactcctgataaagcagcattgtgcagcggttttgagttcacttcccagcccggttttgccactcccacacttcactcccagaggcggaaggcggccggtcttcctgggctgcgtggggtgccagcccccctccccttcccttccctccctcactgcgcccacagtcaccggtcagcactggccatggggagaaagtaggaccctgcgggccactggcccctccacagacccgtccccaggtgaagacccctccctgccctccccacaggaggcccctgtccttctctcccgaggaaccctccttccctgccgcccacaggggcctccatagttctgtcgtcccttccccgcaaatcttccactgcagcctgggcccacgttatttgactctcaaatgctatatatatacacagcgcttctaactccactgcttttaaaaaacctttaataattgtcaattataatatgcccatagaaaagtgcataaaatgcacaggtaagtttagcaaagaattacaaagtgaacaacgcttccccaccacctcggtaaagacagaacacaacctcccaaaagccgcctgcccataacccctgtccatcacgaccacagtcgtgagtgctctcctgaccttggtggtcactgtgtccttgcttttcctgatagtttttaccatgaggtatgcatccttgaattacagaatgtcatcttgcctgcttttgaacttgacataaatggaatcttccagtatgtccttgtctgtgctttctttcgcccttaggcctgtgagatccatctgtgtgctgagtgtttctgtagtcattcatctttgttgctgtataatattctttttttttctttgacacagagtctcgctctgtcacccaggctggagtgcagtggtgcaatcttggctcactgcagcctctgcctcctgggttcaagcgattcacctgcctcagcctcccgagtaactgggattacaggcatacaccgctatgcctggctaatttttttttttaatttttagtagagagggggtttcaccacgttggccaggcgagtcttgaactcttgacctcaggtgatccacccacctcagcttcccaaagtgccggcattacaggcgtgagccactgtgcccagccccatataatattctgttcctccatctcctgctgcgctgatgcgagccatctctttgtagcatctcctggggtgccggtgcctgcgtttcttcagggaatatacccaggagtgcgtagcccagggcagagggtggggtagcttcagatttagtgggcgctgccacacagcctcccaaggtggtcaaatctgtgtatcctcctagcggtggtgactgaggatcttagttgctccacctcctcaccaacatttggtaccgtcagactttttggttgaccttggaacatttttattcttttttcctgcaaaagtaacaccactggttatcatcgggctgagcccctcatgttattttgtcctccccttgctcctgtccattccgactctcacccattctgtggacaggagtcaagtgcttattctttttttttttttttttttttttttttttgagatggagccttgctctgtcaccagggctggagtgcagcagcgcgatctcagctcactgcaacctccgcttcccagatccaagccattctcctccctcaccccctcaagtagctgggattacaggcatgtgccaccacgcacggctaattttgtatttttagtagagacagggttttaccatgttggccaggcaggtctcaaactcctgacttcaagggatccacctgcctcagcctcccaaggtgctgggattacagacgtgagccactgcgccctgcccaagcgtgtattctttgaccagctttgcgctggggcccagcgactgaagggtgaacccaaacaacaggcagccctccccgagctcagtccggtgggaacacagacctcgactgcagagcaacagaaagataagccgggctggaggctcccggcccccatcttcccacagtgaccccattttgggaacaggaacccccatccctcgtcttgtttcgggattaggcttctccaaatctggcaccctatcaccttgactcctctcttgcccccccgccacatccaaagtgtctggaaagcctgtcactctacatgacaatgtaacctggtgctgcgggctcctcttccttgtcactccccttcctcgtcatcccccttcttcgtcaccccccttcctcgccacccccttcctggtcacacctcttcctcgtcacccttcttccttgtcacccctcttcctcgtcaccccccttcctcatcatcccccttcctcgttaccccccttccttgttacccttcttcctcgtggccccctagttcaagccaccctcatctccctcctggaccattgaggcgtgctccctgctcccttctcccccactgtccccacagttgtccgcacacagccagaggtagccgtgcacacctggtcagggcaggaaccctcccctggctccacctctcccagcagagaagcttgcaaggtcccaggcaacctggccactttcctgcctgccctgcttccctcttctcctgccaccattcctggaacattccaggcaggtcctaccccggggcctttgttcttgctgccccctgggcaggcagcaccctccttccttctgttcagtcagcctctgctgacagtggcccccttggggagatgtttcttcccgaccatgggtccccaggagcagcccctgtcaccctccctctagcaccttcccccggtaaccctcatgatggttacttccattatgacatgtgggtctgttggtttattttgtctcccggcataacgtagcctcagggcatgggggtaggggtagaaccacagggccttgccctgccccttgctatgttctcagggattggagtgtggtagtctctcagtaaatgctggttgactgactgactgactgactgactgaactgtagtaagctgggctgccagagcgtctaatggggacccgccctgggtggggcacaccgggaaggttttcctgaggaggaaatgccacttgaaggatgaacttggcctcgactaagggaggaggctgaggcagctgccattgcagaggtctcccggcgggggagtgcagggggcctttgaggaattgaaggaagacaggtaggtcggttcttgggttggtctggattccagtcttgacagctgcttgggcctctctctgcctcagtgtcttcctctctagaaggtggctgcttcaggtgttcctggacattcctgaagttctgctcctaacacacttatcctggtgcctgatacataaatataaatgtgattgtttatttttttccaacaaatttggtggagtgctgacccgtgtggcctccagggatgcggtggtggataaacagacccggttgccgcccatttggagcctggcctctggagccatctggggcacccctgcttggaggcaggagaaggcctggtgtgaccttgggcccggggagtccttattctagatccgggaagctcttcagggtgatgaataggaaagacgaatggagggtttgtgcgtgccggccctgtgccccggccagtgctcccaagctgctgcctgggcctccctgaaatcccaggaggtagctgcacccgtgtgacccatttcacagattgggaggtgaggggggcaccaatgctaagtccttcgcccattttgcaaactagagtagatctggtggtgtttcctctgtggtctgatgtgtttttctggtagccagtcaggtggggcagctttcaatttgttcttccagactcctgtgaaggaagggccagttcaggtcactttcctttttttttttttttgagacagagtctcactctgtcacccaggctggagtgcagtggcacgatcttggctcactacaacctccgcctgccgggttcaagcgattctcctgcctcagcctccggagtagctgggactacagtcgtgcgccaccatgcctggctaattttttgtgtttttaatagagatgaggctttgccgtgttagccaggatggtctcgatctcctgaccttgtgatccgcccaccttggcctcccaaagtgctgggattacaggcgtgagccactgtgcctagtgtcttagccattcctgaggttttttttttttttttgagacagggtcttgctctgtcacccaagctggagtgcagtggttcaagattggctcactgcagcctccacctcctgggttcaagcaattctctttcctcagcctcagtagctgggactgcaggtacacgccaccaccctgggctaatgggctaattttttttatttttagtagaggtggggtttcactatgttggccatcctgttctcaaacttttttttgttgttgtatttttatagagatgggatttcaccatgttgcccaggctagtctcaaactcctgagctcaagccagctgcccgcctcagccttccaaagtgctgggattacaggcatgagccactgtaatgggcatccagcccattcttgactttttgtaattccctttaaatattagacaagcatgttgtcagtgtatgtacgtgtgctcgtgcgcacacacctgacactgagtctcccaatccatgaacgtggtatgtctctccatttgtttatgtcttctcgttcatacttttccagccgacgccttgcccacctcttgtggggtttttcccagggtagttcatgatgtggcagggagtctgtgccctccactcccacaagatgccgtgcaccctgggtttagccttgctggctgaggacctcatggcggtggcaggaggccacttctcccattctctgcttcttccctggtaccgcccctggaccctggcggagggcgggcagggtgcccagaaaggaggctgtaattttcctgaatgatttcaagggctaattaaaggtttgccttgactaatcagcttacggtttaattattagggaacaggctctgggatgcgggaagcagctcagctggggtctccccacagcgtggcaggaaggagccaggacccagccctactctggggggctggcaggatatggggataccccagcaccctccagtgggtcagtggggggttctccatcccccactgagctgtgacaggtggagggcagcaggtgtgatggagattacagccgattcctcccctgattcacatcatcccccacagcccatggctggctggggaggggctggccctgtccctccagcagctttggcagggcccgtccctccccactttcctgcagcaccccagcctcgctggcctttgtggagtgctcggacttcatttattctgtgggtcttggcttaaaggtcagcacctctgggaagcctcctcgggcctccctcctgtcagagctggtgatcagccgcacggccccttgccagttcttgggatcatggttgttcatctgctgcaactcctgcagacactgagaagtacactgagggggatgcctgagctgggccagtgtcggggtacccagcgggataaagggttcgggacctgggctccaaggagggggctgggaaggggtgttcagggaggactgagtgatggcttggaggcggctggaccaggaacacctcatgggagtttgcgaatggggaggggactctggagatggctgtgccaggcctgacttcattccttgcattcctcagcaggccccagactcctgatggtcctaagtgggggaaggtgagccagagagggccttctgggtactgccctccccccactccatcagtctgtctcagtctctctttacaccctcccccatccaggtctcagggctggatccatcctcctgcccactccccaatctccttatcctttggctgcgccttagggtcacccggggtgggaggcactgcaggggcccaagctggaccatttgaagctgactgtacagctgtggggtctgggccttggggttttttaatgctcccctggcgactctgacatgcttctgagctggagtgagggctgctggcctgcaggaatggcaacaaatgtgttttagcttttggcatgttctgggtgcttttctaggcttctgacatggaggggttaagtcacggcacgctacggggacatgtgactgtgattcctgtgttccagataaggcaactgaggcccagagaaggcctcgagcttggcgatggcagtctctgtcactgtcttatcttcccatttctggtctgtccagatgtctgtctgggccttctctgtttcacctctgtctctctccctgtttttctgcctcttatctcccttccccaccccaccctcctgcatttcagcttccctcctcccctggcagaaacttcccagatttctgtgttttgaggcaggatctggctgaagccacagaggggagatgggttctgcaggcccaggacatccttctgaggggaaggatgctgatgtcaccacgctggcctccctaacagctcctgacacgtggagtctggggctgggggcaacacaccatctgactgacagtccaagggtggctagggctggctctgcaagtttgcagggaggactgtccccacgggttgactctgacatgccctgtgacaccagccacctctacggtcccgggagtcctctactgccagttaatgtttcagcttttgtgggtaggactgcctgtcggtcagtagtttaattgcaacaaaggtttgtgctagaaaggcgaatattacattgcaagagcctttattatttgatgggactaggggggactgatagctgatggtcccgtatgtccccactcactgagggatgagggctccccttgcctcctctccccctacccctctccagcgaagggctcaggagtccagctccacctgcagcctctccctgctccggcacagcatcctctgaccttgggcgaggccctgagcctcagatgtttttgagttcccacatctggagcaggaggataatgattcctgctgcctcccagggttgctgggaggatgaagtgagtctgctgtgtgatgctcagaacagggccactgtcattatgccattctggttactagtactcttattaccattacacttattagagaggcaggatccgtgcttggatttagtagttaggattcacagggtgagtgatccataattctttgccattacgatgaggtcacatttcctttggtaaaatgttgaacacctttgtattatggaaatgttcacacatacccagaagaatagtctcgcgccctcctggggtccctgtcagcagctcagcaggtagcagctgtggccaggccttgtcgcctgtgcctgctcctcacctccctgcttatttcagagcaaatcccaaacgtcgtacagccagaaatattccacacttttccagaacaagcctgcctcagtctcctcatgcttccccagttgtcttataatcctttttttttttttgagacagagtctcactctgtcacccaggctggagtgcagtggtgcgatcttggctcactgcaacctccgcctcctgggttcaagtgattctcctgcctcagcctcccgagtagctgggactacaggcgtgtgccatgatgcccggctaatttttgtatttttagtagagatggagtctcaccatattgaccaggctggtcttgaagtcctgacctcaagtgatataaccatctcagcctcccaaagtgctggaattataggcgtgagccaccgtaccctgccataatcctttttcatttgttttttgttgttgttgtttgagacagagtctcactctgtctcccaggctggagtgcggtggcacgatctcggctcactgcaacctccgcctcccaggttcaagcacttctccctgcctcagcctcccgagtagctgggattacaggcgcccgccaccacgcctggctaagttttgtattttttagtagagacagagtttcctaggctggtctcgaactcctgacctcaagtgatccacccgcctcggcctcccaaaatgttgggattataggcgtgagccacggcgcccggcccatttgtttgatttgggtctagacaaggtctacactttgcatccggttgataggcctcttttttttgttttgttttgttccctttgttacccaggctgaagtgcagtggagcgatcagagctcacgtgcagccttgacctcccctgctcaagcaatcctcccgcctcagtctcctgaatagctgggaccacaggtgtgcgccgtcatgctcagatactggcatcagctctttggcgtgcatgttgtggtagtttttctacaggcgacctaggccatttgtcctggagttttgcagtctggggccagctgatacatccttgtggtgtcattgcacgtgttctctgtctctgtgcttcctgtaagttaggacttaggtctagaagctcgatctgatgcaggttcagtttcttctggcaagcacgctttcttaggtggttgcttggatgagcatcagaattacttacatgtctgtatgactgtcaagttcagttttcaagtaaaaattaagttttttttaaaaaagcgagtgggttgagaagaacactctgaagtcactcctagtaaggctggtacccagatccagcagaagtagggtgggagggaccaaaggactgaggctcgggtccccccttccccaccccccggggcctgggagcaataggctgggtgccccggcttcaagtaaaccagtggcattaacatgtgggcctctggttcctgctttgctagggccacaggcttccagctgagagctgctgccacccaccctggcaaccccttccgcatcgcgtggtggtgacaccttcagaacagagtggtctcccaccccagctctacccttggctgcctgtgtcaccctgggtggctttcccagcctctctacctgcttccttcttgacagcctgatggtggccatacgtcccttgggctgtggtgactgggcctctgggagctgcccttccacttctgcattttaacataaacctccttgacctcagctgctccattctctgctcccttccagccactcggattccagtcctgggggcctcctcactgaccatgccctccaccctcagtgctgttccctggtactctgcatggcttcctcacctgtatcccgtctttgctcagacgccacccctttagagacctccctgactgtgccctctgaaagagcaccttgtcactctctgtcccttctcccacttgtttacttgtatattgtgttcccactagaatgtcaactccaggagagcagagactcttgtcttattcactgctgtgtccctggtgcctagaacagtgcctggcacctgctaagtgcatattaaggagtcgttgctcactgggtagaagcattaaaaaaaaaaaaaaaaaaggctgggtgtggtggctcacgcctgtaatcccagcactttgggaggcaaaggtgggtggatcacctgaggtcaggagttcgagacgagcctggccaacacagtgaaaccccgtctctactaaaaatacaaaaaaattagcttggcgaggtggcaggtgcctgtaatcccagctacttgggaggctgaggcaggagaatcgctggaacccaggaggcggaggttgcagtgagccaagatcacaccaatgcactccagcctgggtgacagagcaagactctgtctcaaaaaaaaaaaaaaaaaaaaaaaaaaaaaagaattgttgagtgcatgaatgaataaaagaaagaaaatgactgggcacagtggctcacatcccagcactctgggaggctgaggtgggcagatcacttgagcccaggagtttgagaccagcctgggctatagtgagacctctgctctacaaaacatttttaaaattattgttttaaaataatttaaaaattatttaaaatgtaaaagggcgtggtggcatgtgcctgtggtcctagctactcaggaggctgaggtgggaggattgcttgagcccaggagttggaggctgcagtgagctatgatggggtcctagctactcaggaggctgaggtgggaggattgcttgagcccaggagttggaggctgcagtgagctctgattgcaccactacactccagcctgggtgacagagcaaaacctatgatgatagatagatagatagataagatagagcgagcaagaccctatctcaggtagatagatagatagatagatagatagatagacagacagacagacagacagatagatagatagattagattagatagatagatagatagatatggttaagtgagtggactttggtcctggtcagacttgccacggaatcccagttctgatacactcgccgtgtgactgagggctgacatgtcttctctctgagcttcactctcctgcttcacacaccgtgtgaacggcaccctcctcgctgccttcttttgcaccaggatggagcctgcacgtaacactttgtagtggtctcactgctgtcctgtctccagcacggggcaccgatgagccagccagaagccgtccctgccggggggatgcttgacccaaatcttcagtaataactccttccactctgggtgaccagctgtggtgccccagggcagggacttgttgatctgggtttgttctggaggccagaagggtttcctggggactgggattggagcaggattgagagtgcctggtatgtggagagacctggctgttgtggcatgagtccgagggctcaggggccggctgcttcccggcctttgtcttccttgcaggaaacaggccaggagttacaaggggccagaggatgctgctgtggttatggtggaagttaacagctttgggaagtgtgcatgtgtgtgagtgtgtgtgtgtgtgcacttgtgctcattgtaaagagagacggtaaagaaatgaggagagactgcaggcacatgcaaatacagagaaagctttcagttgtcaggatcgctctcccggtttttcctgcatggtggtgtaaaatctgacatgtgtacagaaaagtgtgtaaaacctccatgttcagtttaatgaataattataaagcaaacagccatgaaactaccacccagatcaagaagacaggcatcaccagctccctgaaagccctctccttcacctgcccttcccagtgctaacaaaaacattctcctccctttcttttcattgttcctcttttttggtgaattgtgaaagatttcagacacccccaagagaagagagaatcacctgctgaccaccctcaggcccgctgcccagctaaaagacgaaatgcttgctgtgggtgcagcccccaggtgcctcccccagggccccaggcgtcgctggccctgcgtctgcttccctaaacagtgtcccgcattgttctgcaggattttaaactgcgtgtaaatggtacgaggccagcggcacttggctgcaactctctcaatattttgttcttgagatttctctgggtggagtaatgaagctctgtgccagaaggaatggttcccagcgggggtcagggcacccctacccctggccagaggaaagcagctctgtcctgggggggccccaggaggacgctctgggctcctctcacccaggcccgcagccccctgctccacgtgggtttgaggcggccacctccagtggaagtggtagagcgccgttggcttcctagggcaccacataggacccagttacagccgtgatgtgaaggggccctccctgagcttatgtaaggtgtaatggggcgctggtgccgcctggggcctgtgtgcaccacggaggggccttctctggaggagggcatagatcagcagctggggcaggagggcctcttctcttcccatactgccctccccctgcgcccgcccactgcccaccctcacccgccctgtttgccaggctcacacagcctttcttggagaggccctctggcggggagtttactctcaaaggctctatatctagctgacctgggattgccacccagctccgccaccttctagctggacggccctgggcatgtgttgacccctgccccacctctgttggcctcagtttccccatttgtaaaatggaattgtgtgagggttatttcatccatgcaaagccttcgtagaagctagtgtgtggaagcctcttaatgagccttagctgttagtatctttgtcatgcttgccattcattcactcatttttgttgatagtaactttttgcctcctctgagtccagccctgtcaggctgaggtcctgccttcatggagcttataatacagtgagggagacagacatggagacagacatggtactaggcagtgacaaaccagagtgaccttggaaagcacaggccagagtgtgacagctgtgatgggagaagacccagaggactgtgggaggccctggctccagcctaggaaatcaaggaaggcctcctggaggaggagacttcagagctgaggcctgaaagaggagcagggttagtttgcggaacattgtcccaaggagagcaaatagcatgttcaaaggctaaaagttgggaaagggtctggcattttaaataaaccattactatttttaagaaaactttaaattctgagatcattgtagattctcctacagttgtaagaagtaactcagaatggccaggcgcagtggctcacgcctgtaattccaccccatttggggaggccaaggcaggaggatcgtttgtgcctaggagttcgagatcagcctgggcaacctggggagacaccatctcttcacaaaatagaaaagcttatctggctgtgatgctgtgcacctggagtcccagctacttgggaggccgaggtggatcacttgagcctgggaggttgaagctgctgtgagctgttaatggcaccactgcactccagcctgggcaacagaattaaggctctgttgcaaaagaaagagagaaagagagagagggagaaagggagagagggagggagggagaggggggaaggaaggaaggagagaaggagagagggagaaaagaaaagaaaagaaagaaataatacagagaggaggtctggcgcacctttacccagttttccccaatggtaacacctgcgagactgtagtaccagataccagagtgtcaactgacattgatacagttaaggtatagagcatccattcagtcacaaggatccctcctaataccttctcatagctacacccttcccctgcccatccctaacctctggcaaccactcatctgtctattcccccattgttaggattttgtcaattcaagaatgttatgtaaatggagccacccagtatgcaccctttttgcattgactttatcccctcagcatgattctctggaggtgcatccgcattgtggtgctgatagtgactactgagtagtattccgtggtctggatgccccaccgtttgtttaaccatttcccgttggaggacatctgggtttttctaattttttggctattacagacaaagccactataaacctcgacaaacagggtttcgtgtgaatgtcagtttttgtttctctggggccaatacccagaggtacaattgctgggcagcgtgctggttgcatgttttaagaaaaccatcaaaaccattttctagagtggctgtaccatgttatattatcaccagcagcaggttccccacatcctcaccagcatttggtgttgtcactattttttattttagctcttctaataagtgtgcagtgataactcattgtggctttaatttgcatttctctaatggtaatgatgttgattagcttttcacgtgcttatctgccatctgtgtatcctcttcagtcaaaggtctcttcatgtcttctgctcattttcttattggattgtttgttttcgggttttttttttttttttttttttttttgctgttgagttttgagttttcactgttgttctttttttttttcttagccccaccaggttctcatatgagatctttatctattctctctctcttttttttttttagatggagtctcactctgtcgcccaggctggagtacagtggtgtgatctcggttcactgtggcctccgcctcccgggttcgagcgatttttctgcctcagcctcccgagtagctgggattacaggcatgtgccaccacgtccagctaatttttgtatgtttagtagagacggggtttcaccatgttggccaggctggtctcgaactcctgacctcaggtgatccgcctgcctcggcctcccaaagtgctgggattacaggcgtgagccaccgtgcctggcgagatctttattctacatactagtcttttgtcagatacgtggtttgcaaatattctctcccagtttgtagcatgtcttttaatacttttcatacggacttttgcagagcaaaagtttttaattttgtattaatttttttcttttatggattgtgcatttgctgtcaagtctcagaaccctgtgccctgtcttaggtaccaaataagtttcttctgcttttttttttttttttttttttttttttttgagagagagtctcgctctgttgcccaggctggagtgggctcactgcagcctctgcctcctgggttcaagtgatgcttctgcttcagcctcccaagtagctgggactagggaggcgcccaccaccatgcctggctaatttttgtgtttttagtaggcacaggatttcaccatattggccaagctggtcttgaactcctgacctcgtgatccgcctgcctcggcctcccaaagtgctgggattacaggcgtgagccaccacaccctgcctgctttttttttttccataaaagtttgatagttttacatttaagtctgtgatccattatgagttaatttttgtacaaagtataagttttggattaaacttctttttttcccccgtttggcatgtggatgtccagttgttccagccagcatttgttgaaaatgctgtctttcctctgttgaattgcttaggcttctttcacaagaatcagttaccacgatgagatactacatcacacctactaggatggctgctgtcaaaaaaacaaaaataacaagtgttgggaggatgtggggaaattggagccccgtgcattgcttgtgagaatgtaaaatggtgctgtcgctgttcggcatagaattaccttgtgacccagcaattccgctcccaactgttcgtccaaaagaattgaaagcagggactcgaacagatatttgtacacccaggctcatcacagcattattcacaagagctaaaaggtggaaacagctccgtgtccatcagtggatgaatggaggaacaaaagatggtatacatgatggaatattattcagccataaaaaggaatggaattttgggtagaaagctatcatgtggatggtcttgaaaacattatgcttagtgaaatcagccagacacagaaggagaaatcctctatgattccacttgtacgaaggacctagagtaggcaaatacaaagagacagaaagcatgcatggagtcccagctattcgggggcaggaggatcacctgagcctaagaggttgagttcagcctggacaacatagtgagacccggtctcttttaaaatatatgtatataggccaggcgcggtggctcacgcctgtaatcccagcactttgggaggccgaggctggcagatcaagaggtcaggagatcgagaccatcctggctaacacgatgaaaccctgtctctactaaaaatataaaaaattagctgggcgtggtggtgggcgcctgtagtcccagctacatggaaggctgaggcatgagaatggctagaacccgggaggcggaggttgcagtgagctgagattgcaccattgcactccagcccaggcaacagagagagactctgtctctaaataaataaataataaaatatatgtttatgtatatatagagagaaagaaagtagaacagaggttatcagggtttgaggggaacaaggagctgttgtttattgggtacatagtttttgttggaatgataaacatgtttgaatatagatggtggtgatggttatacaacattgtggatatatttaatgccactgaattgtatacttacagatggttaacaatgataaatatgctgtatattttaccataataaaaataaatttttgaaaccagctaggtatgttggtgtagatctgtttctgagttctctgtcctgttccgctgctctgttgctgtgactgtcccaccccatctgggttacttgctgcagcgctgggagagggattcctctggcttcctctctcttttctctttttcaagattgagctcttgaaaaaagagctctgggagctggcattttggagctcctctagggttccgcgtgtagaagatggcactgtgttgggcctaggttcagagtcgtccttgacaccacctcatcctcagcccgtgtctgactcatcagcgagcattgccttttcttggtagacatagcccaggtctgtccccctctctccactgccactgtcctggctgcctcacagttgcccgaacagcgctgcctccttgtcactcatcctcacgcccactcaggccccttgattccgtccttcacagggcaaccaaagttacatctgtaaaacccaggcctggaccaggtggagtggctcccacctgtaatcccagcacttggggaggccgaggtgggcagatggcttgagctcaggagttcgagaccagcctggacaacgtagtgagaccttgtctctaaaaaaaataaattaataaaaattaaaaaaatgtaaaaacccaggcctgtccttggcacccacgttgtctccccttgctctctcatgatctgcctccaccacaccgtccccgttcaggcctgctgcccacccatccctccagccagtgtgtgtccgctggactttcacattttttgcgtgtggtgcttgactataagcctgatggggtagggcccacactgcacttctgcccccgcacaggcggcacgtgacagacgtgcattagatttctgtcggtggacgccatgaacgtgggaaggaggctgcctgtggccggagcaggtggttgggggcggagagtgtgcaaaaatgaggacagagaggtgggcgcgacctcggtgaggagacggctttagctctgtgggcctgagtaggtttttagcaggagaggatacaatcagattagatttacaaaggtctccctgacctagcagaaaaaggcaaaggctttgaatagacacttagcggaagaggacattctgatggcttttataaatatgaaaaatgctcaaccctactaaatagaaaaatacaaatgaaaactaggctgaggggggccacacctcacatatcagcagagatcagagagactggccacgccccgtgctgcaaggccgaggggagataggccctggcaccgccgaggggctgtgagtggggacaggcctcacgcagggccacttggcagtggtgaacttcactggacatttacccacagacaaacttgcacacctgtgaaatgacagctgcacacagtgagtgttgccgcaccatttataagagcaaaagacaggaaaccaccactctggcccgatggggactggctccagacatcacggtccttccacacagctgccaaagcagcaaggcagtgctctgccaagatcaaggcagggaaagatcaccaagacccacatatatatgcagcatgtctgtggtttcagttacctgtgaccaaccatggcccaaaagtacatggaaaattccagaaataaccaattcatatgttttatttatttatttttttgagatggactctctgtcacccaggctggagtgcagtggcaccatctcagttcactgcaacctccgcttcctggtttcaagcgattctcccacctcagcctcccaagtagctgggattacaggcatgcgccaccacgcgcagctaatttttgtatttttagtagagacaaggtttcaccatgttggccaggctggtctcaaactcctgacctcaaggaatccacccaaagtgctgggattacaggcatgagccactgcgccggcccaacagctcatacattttaaattgtgcaccattctgagttatcgtgattttttttttttttgtagagacgaggtctccctatattgctcagctggtctcgaactcctgggctcaaatgatcctcctgcttcagcctcccaaagtgctgagattacaggcaggagccactgcacagcctcgtgatgaaatcttgagccatcccactctgtcccgcccgggacgtgaatcacctttcttaccccacatatccatggtgtatgtgctacccatctgtggctactcagtagctttctcggttctcacatccactgttgccgtatcacagtgcttatgttcaggtagcctttatttcacttaacattgtccccaaagtgcaagagtagcgatgctggcaatttggatatgccaaagagaagctgtaaagtgcttcctttaagtgaaaaaggggaaagtattgaacctaataaggaaaagaaaaaaaattgtatgctaaggttactaagctttacagtaagaacgaaccttctatccatgaaattgcgaagaagggaaagaatttgtgctgggtttactgtcacacctcaaactgcgaaagtcaacagccacagggcataagggcttggttaagatgaaaaaggcattacgtttgggggggtggaagacaggaacagaaacgtgttccaactgatggcaatcgggttcaatgttatccacagtttcaggcatccattgggggtcttggaacatacgccttgcagataaggggaactgctgtatatatagttggccctgggtatcatgggccctcaggatcacgggttctgcacccacccattcaaccaacgaaggactgaaaatttactatggagggccagcttttccatccgcggttatggagggctgactgagggacgtgagcatccctggatgtggtacctcctgcgggggttctggagccaatctccctcagctaccgagggagaattgtatagatatatcaatttttttctttcaaatcataattataaattgttaggatacacagtgaaaattgcataaaacataaatgtatagcaaaaccaattactataaagggaaaaatctatgtagccacccctccaggtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatcacaggcatgtgccaccacacccggctaatttttgtgttttgttgttgttgttttatttttttgaaacagagtctcactctgtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcctctcaaagtgcagggattacaggtgtgaaccaccccacctggccttaattttaattctctaaaaatgtagagatggggtttcacaatgttggccaggctggtctcgaactcctggcctcaagtaatcctcccgcctcggcatcccaaagtgctgggattacaggcatgagccaccgtgcccagtccaactctcctgacttttgaggccatcatatgcttgcttttctctctgtttgccacctctgtatgcagcctgaagcagtttccttttgcctggctttgaaccttaaagtccgaggatggagtattgttcgatgtttttgcctcttctgtgtggcgtcttctttgatgctcatccacatgtagctgtagtcattcattcattcattctccctatcatgtgcggtgccatggagccttcattcaccacctcctggggacgagcatttgtcttgtttctagtctcttctcgcgtgtgctccctgccccatgggcctgcgttatgctggagtgtgtacccaggagagctcttgctaggtcaagcgtgtgtccccacttccactcgatgctgctaagctcctgccaaatgccagcagcgtgggagagccacggaatgttttcgagaagagcaaagtacagaatattgtgtgtcatgtggctgccatttctcttgtttttttaaaaagcaggtaatcatgtgtgtacccatacacacacgtaggatctctcagaaaggaaaagaaaaaacctgaaagtctagtagcggttgcctccagggctgagctgggccagggtggaaggaggacatcctgtcacagtttaccctttggtgccttttgtcttttgaaccgtgtgcctgtattacaaagacagagagaaggaaaagaaggaaaaggggtagatgagtgtaaatgtggtaaagtgagaatcactgagaatcgcccagtgcagctccctctccgtccattggggacctcgtttcctgtggctgtccagagctgtccaatccccatccactccccgccagagcccaaacctgcccgtctggtttgcagagctgccccacgtggctcctctgcgggtggttactcgacaaatgccccaccccccaccccatggggaggcagtggcctgagatctgggacttctggatctaggcccctagacctgccctgctgtggtccagagcctggcccagcccctccttggacttcctcctcactgtgacagggggtggacagaggtggagatgggagttccaggccctgagagcaagcgctggcctcccagcccacgttctgtgtgtggagataacatctgcccttgaggagttggctgcaggggcaggggtgtgccagagcagggtagtgggaaggacccaggtgcgtctgtctgctgtgtgccggggcgcttgctcactgttgtccctggattcaccatggcctgggtgcccatcctgggtccgggcacccagcagccttggtccctaccgcctaccagactggagtccctggtagagcccctctagggtgtcaactcccgtgggcaggaagttttgtggagtttgttcagtgctgaactatcagggcctcccacaggtgtgcctggtatgtgcctggagctcagtgaatgaatgagaggcgggcaagctgcagacagtgacagcctgggtgctcagggctggcatggggaggtgcagggtggagtgcacagggctggagcccagaggatacctgacccagcctggggtggcagggagggcttcgtggaggagcaggtgcctcaagtggggccggagggtgagaagggatgaaccaagcagccctccggaggcctcgaggggaacagacagtgttcacaggagaaacagttacacctgcgagctctgcctcgggccagcctttgcactggaggtgggatttgaaggggagggaggggtgctgtggagcatctttttcttctgttcctgaacgggggttctgatcacatcagcctcatgcttggagcagctggttaagggcacagacaccgggacagacatccagcctgggagtcccagcgcctgacctcccctcgggcatcaagtcactccgcctctccgcgcctcagtttcctccatgatgaaaggggcctgctgaaggacctgtctcatttagggcagcagtgaggcaaagccccggagcccatgcctgtgccaagagcagggcctggcccagaatatggccttgtcacgttgagctgccttttttcagcagggttagtttcatcctggtgaggcggcgccagcatggcgttccaccttcttggcctcctctccctcctccctttcctgccatccacacctcccggccctattctcacacctcaggatggcgatatgggggcttcaccgtggtctcccctgacctcgcccctcccccggtcaggctaagtctcagattcctcctcatgggtgaggggggcagagtggcccctttcctccagcccatgctgggcacttgctagaatcccagccttggtcggggtggaggagaagcaagttccagctctccagttctgcctccatatcagagagcccacccacccctctccccagggctctatcctgcacctagtggcccctgtcactccccagccacccccacgtacataccctggtcccttgtttcaaacctggctgccccttagccgcctggccagccgcttgcaggtactcagccttgctgtgtagtcaccccctccagcccctggcacctagcctggcataggggggtgaggcggggtgtgcctgttggtgggaggctgaccctgctgaagcaaaggctgtggttggggtccccgcccagccctgccctctgtccaggcagctatgagccacgtggcccaggcccacccaccccagctccaggcccagccccgcctccctcccgccctccgtgggtggaagccacagccgaggctcaactcctggccgcgtcaccaccgctgccctgcaggctggagcatagagcccaggcacccctcctcggtgggtgcccatgttgagggcctggggagccctggatctactctgctttcccagctggaagcctgtctgtccacaggcccgccccattgagggtggcccaggaagtgggaaagagcgtggtggaggtgagctggccaggcctcgggaggggagggggagggctagactggctgccagggaaggagggtctgcccctggccactggagccagtgtgagcatgtgcgaaggccacacctttcttggggttggagcggggtcactgtgtttccatgtgtgcgagatggcaggtgcctgtctgctggggacttgcaggcatctgagcataggtccctgagcctctctgtgggagcacgctcctggggtctggcttgcacgagggcagaagtttccgtgagactgtgcctcactcagtcactctgggtgaccctggagttgactgggtgtgcctaggtccatggaggtctccttgcctactgtgtgtggttttggggtcgggggggtgcctcctagtgtagctttgtatcttgggggttattcctaggtgcgtgtgtgtcctggggtgcagtgcggctttccctcgaagtcatggagtgtctgcggcattgtgtgtatacacacgtgtccctgtgtatctatgtgtggatctctttgggagtctctgcatctctgggtgcacgagtctttgcagtgtgtatgaaagggtcgcagtccacggtccatccatggctcttctggggcccatgtgcaggctggctgagccgcggccttcccatttgctgcgcatgtactctgagccaggctggctttaagagccgctcccccaccttctcccactgaagtctcagaagctccctctggggcacgctctgctggtgccccatattctagagacatgaacggaggctcttggtaaatgtccttttcccctgccccacggcaagcaaggcactgacccctggccaccagcctcctgagcccatggtcctgtacgggccgccgcgaggtgctcaggatgttgtagggttgagggtggattgctgctgttgccggctagccgggaagttttctttttttggcctaagataaatattggagaagaatggcccgggagctttccatgtgaccagttcatgtgcctggaggcctgtggtttgtgtggctgggtatgtatctgcatgtctgtgtgatggtcttaggactcggctctatgtggtgtcagctgcggacatcttgcatgctctggcatgtcctcacatgcatctgtgtctagggatcatgcatgtgtgtatgcatgtgtgtgagtgtgcatgtatgtgagcatgtatttgtgagcgtgtgtgtgagcatgcatgtgtgtgtgtgcatgtgtgtgcatgcatgtgagcattgtgtgagtgcgtgcgtgcatgtgtgagcgtgcgtgtgtgcacatgtgtgcatgtttgtgagtgtgcatgtgtgtgagcgtgcatgtatgtgcatgtgtgggtgtgcgtgtgtgtgcatgtgtgtgcgcgcatgtgtgagcatgcatgtgttgcgggatggcttcgctcgctgctgtgtgttgggtctgtgaggagaggccgtggttgctgcctggtgtatgtcctggcgtctgtgcacggccttgtgtgttgcatggcaggggaggtagacagtgagagggcttgggtgctggagcctgagaggggcagggcctctttcctgccacatcacccccttccccctgcccagcctcaggcgaggaataaatgacgtctgctctgatttcccaggccgtatgggctcccacacactctctgttgtggtgtccatccccaccctgagtacctctggggggtgaagggcaccagcagtgccctttgtgtctgtgcccttttgtgctgggccagattcggggcaggagggcttggccctggcatcactgggggctctgagcgccagcctgggcctagctgggtaaaggaagcatcatctcttcgttgagccacactctctgcgctgggcaagcctggggacacagagatggccccaggccctgccctcctgggtctcccagtccagtgggagaggcagacctgttatcagacaataacagcccatcaggctcctccctcccaaccctggagaaggtaagactagcatatttgctcggcagaagggaccatgcccggcatcctctgtagtgtgtttgttcattcattcattcatcattcagcagcaagaatggcagtaatgataacagcagcgagcctgcagtgaggccccactcggcaccagtcactgttgtaaatgttttacatgtgtcgtcttattcgctcgtccaacatgctcaggaggtagggactatcactacccccagtttgcagatgaggacactgaggcccagagaggttgagtcacttgtccaggggcacacagcttggagtagtagagccagtacctgggactgggcagtcggctcttaaccaccagtacaggcctgctgagcccctgtactgcgccaggcctctgctgaggacaaagcagtggctaggagagacaggccctgtcctcgtggggctgcccgttcattgcaggagacatactaattaaggactataaggacaaaggtaaaattacagctgtgacagatgctgtcaaggggaaggcacgggacatgcagggtttttttcagacagagtctcactctgtcgcccaggctggagtgcagtggcgtgatcttgactcactgcaacctccgccccctgggttcaagtgattctcgtgcctcagcctcccaagtagctgggactagaggcacatgccaccacgcccagctaatttttgtatttttttagtagggatggggttttgccatgttggccaggctggtctcgaactcctgacatcaggtgatccacctgcctcggcctcccaaagtgctgggattacaggcatgagccactgtgcccggccatggacctgcagtttgaaggaagaggaagggataacaaggtgaaggttgagggggcagggggctcttcaggacccaggctaagggcacagtccatgcagaggcctggtggcggggacggcgctatacctggaggaacgaaggagagcagggctgccccctccaccctccacagacgctgctgaatccaggccccacttccaaaggcgtcccccccactggatctgtgtctttatgggcttttacccattgtgggggctcatggatttccagaggcaccccccatgtgatttggcttttgccaggatacgctgccacttcctgagattcccagcgtaggccatgtggctgggtgggcccccctgcagtggggagggcctgggcgttcacagtgggggtaccttttgtggtgctgggacacacaccagcttacttgctgaacagccagattcagtctctgaagacccattttctccccaggcgtcaaggtcagacttccagggagtgagtgtacgaggcccagggacttgtgtctgtctcggccccatccccgtgccctgcgcctcctcagggaccaggctcattactttggtaatggcatcacccatttgttccacagatatgtctcgagcacctactgtgttccagccactgctctagatgccggcaagaaccagacagacagacaggtccctgccctcagggcactgacattctgctgggggcactgccagtcagtaggtgtaggatgccagggggtggtaagtgccacagagacataaaaagcgaggtgcacattttgttcaggggtcaggcagcctctcggaggaggttttatttgcactaagacctgaatatcaagaaaggctgagcagtgcagttctggctgagggaagataggtgcagaggcccggaggctggaacagctgtgatgagtccaagacatacacggaggcagccagcgcggctggagagaagcgaggggaggagatgaggtttgcgaggttggcagggccctcccagtcagggccgtgttgaatcagtgtttgagccaaagtgggaagccctgtagaactgtgtgtgtacatttgtgtaatgtcttcagattcccttctaaccacggtggcttttctggtcttggtctggtcattgtcagggacattgtcccttcctgtttttgtcccataaacctccaaggtcctttctttagagtggaggccttggctggagccgggaccactggggaacaggaggctgggggatgttgacttgccttctctgtgggacagagtggctgcttttgtgacctggcactggatagccctgggcagtgagttcccctctcggcctcagtttcctggtttggggaacaggaaggaagaggactccccacccagcacccagcactgtttagagggctccgcgtggcctggtctgtgtgcctggcacagcctgggcaagtccacagccacgaaggggagcccttgtgagtccacgccctgctgtaggcactgaaatgcagccatcatgaaccaaaacgcggtccctgtccatatgagtcactgacttagcgaggaagatggccacagacaggcaaacaactgtaatgtgtgaggcaacgctgagggccctggagggaacggacctaggctgactgcgccaggctccgcgccaggtgctgggggtgccacatggagcaagaccaggccaagcccctgcctatgagctcacgctgcagccctcggccagtcctgccacctccacctttacagtgtgcccagaacctgctcatgccgccccctctgcagcccccacaaggtcctgcccccttgatttccactgggccatcacagcctcctcctccctggtccccctttccgttctgcccccacagactgttcccagccagtgggagcctgtgaactcctgagtcaggcggtggccctcctgggctcagagacccctgcaactccgtctcactcgggaaaggaccaggccctcccggtggcccccaaagccccacacgatctgccccattacctccttggcctgtccttccacttgccccctcgcccaccctgctccagccacgtggcctcctcgctgtcccttgaccatatcaagcaaattcctaccgccctggctgttccttcctcctgggctgcccttcctccagagccctacatggctccctctcccctcctcacgcaggtccctgctcacgtgtccccttctcagcaaggcctgcctgaccactttattttataataatagttattattattattttgagatggagtctcacactctgtcgcccaggctggagtgcaatggtgcgatcttggctcgctgcaacttccacctcccaggttcaagcgattctcctgcctcagcctcccaagtagctgggactacaggcgcctgccaccacgccaggctaattttttgtatttttagtggagatgggatttcaccatgttggccaggctggtctccaacttctgacctcaagtgatctgcctgccttggcctccaaaagttctgggattacaggcataagccactgcacccagcctgttattcttatttttgagacaaggtctcaccctgtcacctaggctggagtgcagtggcacgatcactcactgcagcctcgacctcccaggctcgggtgattctcccgcctcagcctcctcagtagctgggaccacaggcgcacaccaccacacctggctaaatttttatttattttttatttttggggtagagacagggtctcactaggttgcccaagctgatcttgaactcctgggctcaagcgatcctccctccttggcctcccaaagtgctgggattacaggcgtgaaccaccgtgcccggccttgaccactttattgagaattccagcctcccctcccctcagctcctttctgattgctgcgttattttctatgtcagcatttctcacccgacttagtagatgtttttctgatttatctcatacattgactgcctccttccttctagaatgtgagtgctgcgaggacagggatgtttctgactgttgggtgcactgctatgggccccaggcccagcagagtcagcccttggtagacatggacgggtgcgtgggtcgatgcgtgggtgggtgtgatcgggtcacttgtgggtggagtaggtgtttgctaaggcagactctggggatgtgtcggtcccaaacctgaggactccttggaggaacgaggctcagtgtgggaggcctgaagagagatgtggttagaggagggttgggggccgtgcaggatgggggcaagagctaagccaaggtttggaggcaggaatggcttgggggactcaggacagcgaggagcctgctgtgccgggacgggaagccaaactcccagcgcctccaccatcaaagcacatgccagaaggtaggaggtaaactgaggcagggaggggccctcccagagctggtaggtgaagattgtggcagggtggtgagtgggacccaatggtggaaggctgagtgcaggctggaggcagtgagcggtctgggtccccttcctgattcgagtttcattttggtaatgatgaaaggatgcctgtggtcctggccacctcccctgctctgcccctgggcccctgtgttctgggtgggccagccccctcccttccaggggcagcagctttgatcagagcctggagggggcggggcaggaggtaagggtttttgcacgctcacgtctgctgacactgacagctttgtcgcacggtggatcttgcttttccatttgggccagttaaccttgtgggggagaatgggggtggtgggacccttttcctcccagaaaaggtcagaggatgcagggggtgactggaaaatctgaagtgtctgctaggccaggtcaacgctgcctgtcccgcatgttaaagaattcaaaagattttttaaaatttgaaataaacattttagagtaggatacaaaatgcgcttgcatttctgggatcaaatactggacttcagaggcatctgtgccccggctggggcagaaggctgcaccttcctgctgctctgggactactgcccccaggtcccagctgcttatctgaaagatttcccgggtgctgctgggccttgtccaaggcctctgagcaggggaataatgcagcggacagggacgatcattccacggagtccctactgtgtgctgccctgggctacgagggggtaagacagaggacagtccctgccctgtgaagctgacacattctaagggagaggcagatgctaaagaattacacatatggctgggcccggtggctcacgcctgtaatcccaacactttgggaggctgaggcaggtggatcacctgaggtgaggagttcaagaccagcctggccaacatggtaaaaccccatctctactaagaatacataaattagccgggtatggtggcggacgcctgtaatcccagcttcttgggaggctgaggcaggagaagcacatgaacccactaggcggaggttgcagtgagccaagatcatgccattgcactccagcctgggcaacaagagtgaaactctgtctcaaaaaaaaaaaaaaaaaaaaagaattatacacacacacacaagcacgccatatatgtggtaagagccctgaggaaagataaagcagagacaggtgtagagggcgacaggacaggagcagggcttgtgagcacaggcgggcctgggaagtcagggaaggtgggagatcagtgagaggagagttccaggtggggcactcgcccatgcaaaggccctgaggtggaaccatgtctaggatttgaggaacagcagggggacctgtgtggccagggcacagtgagtacaggggtgcttgggagaagaggagggcagcatggtgatgggcgcatcctgtggggactctcaggccacgaggaggcattttgggggccagcaaagggtttaaggctgtgaactctggagtgggcaggactctggaatgggcaggactctggcttccaggcccagctctgctcggtgagcttagtgagagattttacctttgtgagtctctgtttccacagctgcaaaatggggctcagaatggccactccaccgtggttgagggcgcctgcgagctcagcgtcagcgtctgctctgggccatgggtcccttgtggtggtggcgatggtggtgggagtaccgagctgagcctcaggccacatttggtgggaggggttggttttaagcatctttcctgctgcacaggcccatgggaaaggctggtgtacagccattggggaggtgggggccccggggcccactttgtgcttcctcccactacccgtggggtccaggacaggtcacacaggagggagggaccctcactcagcagagactaggcaggagaggaaaggcaaggtctgggtgtagacagaaagaatgggaacggagggagaggggaggccaggaccagccttgagaggatgatgatgatgataataataataataataataataataataaggccgggcgcggtggctcacgcctgtaatcccagcattttggaaggccgaggcaggtggatcatgaggtcaggagatcgagaccatcctgcctaacacagtgaaaccccatctctactaaaaatacaaaaaaaaaaaaaaaaaaaattagccgggcatggtggtgggcacctatagtcccagctactggggaggctgaggcaggagaatggcgcaaacccgggaggcggaggttgcagtgagctgagattgcaccactgcactccagcctgggcgacagagcaagactccctctcaaaataaataaataaataaataaataaataaataaataaaataataatagacaaaaccaacagtgtcacctcagccctccagggcagcaggacaggcaggtaagagcccagccttcagtgccttccatacacaaccgcccaggttcaaatcctggctgcttctcatgtctgcctctcactggctgcttctcctgtccatgccctggacaagggccttcccttctctgggcctcagttttcccattcgtgaattgggatgaggatgcttgtgaggatggaacgggattagacgcacagcagggccggaacccgcgaatctctgcagacaggcctggagtctggtgtccactctgccaccctagctgggccacctgggttaatgaggtccccctctgtgccttgttttccctgtctgtaatccggggcttattaatggcccctccctccaggatcatatgtgggactccgggtaaagtgcctggaagagggctggtatacagtaggtactcagtaagtgctggctgctattggaatggtgaccggcacttactgagcacttactgtgtgtgtgatttgccttggttctgatcccaaccactgtctctgggccaggccctccgtgccctctgttctgcgtaattccttataaaaactccaggaaggccaggcgcagggctcacgcctgtaatcctaacactttgggaagccaaggcagatcactagaggtcagaccagcctggccaacatggtgaaaccccatctctactaaaaatacaaaaattagctgggcgtggtggcaggcgcctgtaatcccagctacttgggaggctgaggcaggagaattgcttgaagccgggaggcggaggttgcagtgagccaagatcgcaccactgcactccagcctgggcgacagagcaagactccgtttaaaataaataaataaatactccacgaagcagctactattatcgccgtctttgaacagaggaggaaactgaggcacagcgtggctgagttgctcacccagggccacatattgaggtccccaggttgggttagagctccagttcacagacacagaaagtgaggtcatatagggccagtcgtggcagccctgctggggtttggagccctaggcagcctgactgccaagcttggagctggcctgggagcccagcccccacccttccctccctgcacctgggcaagcccagcctttctgcctagctcttctccctcttcccaggcctggcacggcctctgtggcccccatgaggtcaggagcatctgttgggaagggagcgcctgctggggaagccggcagggcttggagctgcacaggacggcccagggtggggtccctgcctggtcattataaacatgttcagttcctctgtttgtcctgccctctgtgcagtgcccagagggaaggggtggccccaggcaaatatccggaggcgtgccccttgcccccttcccttgggggtttatgggtgggagggcaggaggccaggcgtcggaggacatcccccagaccccatgctgccagctgggccagccgcccgccctccaggctgctcttgccccgtccccaggtgtcccccacctcagggtctgccccgctgtccgccctccgggcttagtgaggggtcacatggctgatcctcttcccgtggctctgggaactgcctagtgccccgcagtggggagggagcgggatggggcggggcgacaggttcacgatgaagaggcctgggctgggcatggggccaaagggggtggagggacatctgggaggacggagaggccggaggacatgggacgcagatctggaatgacagcaggcagagtgggcaaatggggactgttggggtatgtggatgaccctgggagctgggcctagaaagccatgagagagtaggtcagggccaccaggggtgggctgggctggaaggccacgagggaggggtgggcagcactcagggcgccagcattgggctcagagaaggggctgggcagagacaaaggaggccccccgtccgccctccatcctgggccccagggcaagcagggaaactgggccaaccctgggagccttggccaggcccggctctgaccacccgctggcctcttgggaccagctgagacaggttggctgccgggcccccacccccctcccacggggctcccgctgccaaaccggttcccctggctggctcccatggatggtcctagctctgggcagggcctcacctttcccagctgctcccaggaaggcagcctgagccgggaggagaagtaggtgtggaggggctacgtgcatctgcgcgtcctctgtcctctcactagggctacaggacttgctgtgccacgcgctgtgccaggcgcgggggagccagctgggacaagacagaacagaaactccacctgcatgtcccctcgtcccctggtctcaactcttcccctcttcctggaagccttcctgctgcccaccccgcgtccctccagactgggtcccgtgctcccgtcccccagccctgaccaccctgggcagctgctgcatggggacaggtctgtctgccccacacgaatttcccatgaggtcaaaggctgtctgggtcactgcagtggccacagaggaggcccattgctgagttattcccaaatgaatgaatgaatgagtgagtgaatggatgcattcctctcattttacagatgagtaacccgaagcccctagaggagtggtcacctgcctgagggcacttctgtcccaccagcatcagaccaggtgtgtgcaggtgtgtgcgactccagggcccaggcccggggcagctggggtggggccttaggggggagcaggacctgggcccctcctcccacaggcactgtgggagccgccccagccatcacagtggtccccaccgataggccccccatatttgcccagccctgcaccaagctctttgctcccagtcacccattacccctcgcagcagccctgtgggggttcatccacagcacagagaggttgtcacctgcccaaggtcacggcagcatgtgatggagagtcgaactctggcctcttggctccccctcccatctttctccaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggtgtgggcgtccccagcccagactcatggctggaccagtggcagtggccaggccatcagtgaccgtccatccagtacacaccatgtaccaggcatagcaggggatgtggggaagcggggcagacgagacccagccagaatgtggcactgacactctagcggtgcggtgtggatgctgcactcatgaacctaagaaggaacaacaaacaggatttccatgagttccgggctgtgactgtgatgtagagcggggggacggcgggacacggggctctttgccttggggtggtcaggaaaggagtcactgctgctctgagaactgaaggaggggacggggagccctgtgcagacactgggaagtgagctcctggcagaggggccagcccgtgcaaaggctctgaggtctccagggggggtgagaacagagaggtgatggggccttgtgggcccgcaggagacagagcggcaggaaagttctgagcagagggacgtgaccgctcgggtgctcacgggtaccctctggctgtgtgtgccacacagatgggcgcagggggtgggcagggagacccagaaggaggctactgcctcctgttggtcccggtgtaagatgaggatgggagggacagagcaggggcagaggaggaagagacatgggcaggctctcactcacccaccgtgattccctcccgcaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaaggtatgtggcacccaccaccacctcccccagcccaccccaacccccgagtggccctggccctcaaccccacactcgaccctgtgaccgacacctcctcactgacatggaaatggagacaaaccccagccttccacccctatcctgggtccagtgctggcctttcaccctccacccactggctccaagtcctaagaacccatgccaccccaacctgagcccccccacggcccatctgacagcccccacaccagcctccaagctctgctgtctcccgcagactcatgtcccgggggccatgctgctgtaccccggaccacactcctgtctcacccaaccttgagcctttccagagctcctggcagtggaagacagacccattcccagagggtgacagccccaagtggtcagggcttgggtgggggagcccggaggaggcacctgacacagaccaggggtccaggcaagcttctgggaggaggggacaccgaggcagagcccagggctgaggaggaggaggagaaattccagcagatgctggggaagccgggctttagtggagaaaatcactcctgtgaaacgctgggggctttttggttttgggtttttttttttcttcctgccatctagagcaaaatggcaaggttgggatttgaaccaatgtctgtttccaaggcccgtgctcttaacccctctgctgcctccatgtgaaatcataagagttgtggagccggtgtctgggtgtggcctggcatgaggctggcctggcctgagcccgtgctgggcctctgaagccagccttggagcctggactctctcccatggtcagtggggaccaggaggggccgcaggccaaggggaactcggccaggtttgcatccagcgggtggagatgggtgtgcctggggactcaccctcccggtgcccagcccagcctggcggggagaagccccaaggcccacaagttggccatagacacaagtgcagcctcagtgtggtagcccactgaggggtccgtgtggtccttgcagggtgcttttgaatgctttgacttctttgcctccactgagaaagtgacagacttcacttccaaagccgtttctggcatctggtgacagaccagctggaggcgagtggcagctgcctccacgggcagggcactggctcttctgggccacaggccgcacccgacccacctcagctccacgccctgcctggctctgtggccacttgcatgtaggctttgcccccaccaaggtgtctccaaaaacccagcccctgcctggcttgccagatgtgaggcctgcctgtgactgtcccagcaggaggcagggcacttgaattcacacatggggccttgtggccagcactgtcctggggccccataggcacttgtgtttgctgcccttgaccgggcctcaggcctcccaggaccttctcgactccctgttggttttttttttttttttttgagagacattcctgctctgtctccctggctggagtgcagtggcgccacctcggctcatgcaaccttcgcctcctgggttcaagcgattttcctgcctcagcctcccgcgtagctgggattacaggcgcccaccactatgcccatctaatttttgtatttttagtagagacgggttttcgccattttggccaggctggtctcaaactcctgacctcaggtgatcctcagcctcccgaggtgctgggattataggcgtgagccactgcttcttgcctcaacgccctgttctaacagcaaagtctggccttgtgtccaccttgacttcctggggcccctgggcaaggcccggcttcaggcagacagccacggccaggagagacagggcagcggcagaccacggattttgtgggatcagtgttttctacacgttacaggcaggcctctggctggaggatgcctggcagccccaggcagggtccgggtttcgtgggatcagtgttttccacacattagaggcaggcctccggctggaggacatctggcagccccgggcagggtccttgtcagcagggcccacgttctcagctcactgtggcctttgcacagacacctcactcactacgtggtttagcaaaagttcactgagcccctgctgtgcgccagatgctggtctaggtgctgagatggagcaggacccgaagcagacaggaaaaaacaatccctgcccagagcatgcactaggcagagccgggagcagacagatgcctgtgtgctctgtatcagctgctgttaggtgctctaggtagaatgcaggcagggcaggggccggggagggcaggggctggcattttagatgatgggaggccagcagaagcctcactgagaagctgagttttgagcaaagacctgaaggagtggagggagggagccacagggaccctgagagctgatgttccaggcagagggagccgccagcggagaggccctgggcgcaggggggcgggggtgggggagacacccgtgtgtctggaaatggaacaggggcagagggggcctgcaggacacgactcagaccacagagggtggggaccgggtgactcgggatgcactggatgctctgcctggtccccatctgcatttgtatttgccacccggctcctgggacccccttgccctctactttgggaccaggcctttctgactctccctgtcccccactccttgttgttcatgggagcagagagtgtggttttggggctaaggaacactggcgcccacatgggaggaagtgccaggccaggccctggccccagcgccctgtcatttgcagccctcggggctgattatggggtgggtcaatttctgcccttcctcccccaaacccctcagggcaggactattccaccagtgtgaggaacaggagaaaaacaaggggggcctctccagggtcccaccgagcccagggggcagcagcctggccatggcgatcactcctctggcccctgcagctgtgtccccagggaggggaggggctgcactgcccatgccattgtcactccatggcatctcttcattgcgtctctgtcttgtctctgtgtgtgtcgtgctgtcctgtccctgcgtgtcggatgcacgtcctgtgtgccccactccttgctgggcccccacccaccattgcctgggaccccagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccaggtaacccatcccccgccccagggcccccactgtcccctgcccgttgctcctctgtccccaccttccagccccgccccaccaccgtgcatctcatcctgaccacccatgtgtctgtcccatcgctgggtctctctcctgcttagggagcagagctgctccctggcacccatcactgacagctacctctcttctgtttcagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtgcgggcgctgctgccctgccgccctgctggtcctcccacccctccctcccaccctccctcccctcctccctcctctccctgcactcctccgtgctgggccaggctcccctcctcccctcactcttctccctccccaggccgtctcgtccgccccagctgggtccctgcctctgtcctcacagcaccctcacccacatctctgtccctgagccccagacccagggttcctcgggccactgacccccgacccagtgtcttccaggcccctcgcacccactgaggcccgcctgggctccagggtacagtgtcctccagacctgcccctcctgggttccctgtgccccgccctggcctccactcctgggtgtccctcggcacagcccacacaaccaccaagagtatgtttctgacgttcaggcccaccccctccccgtccctccttagagaccctggcagtgccccgtagcaccctgacgataggaagcccaggtccctttgccgggtgtgtgaggcccctctcgaccccgttgcccatcacagtgccgggctgcaccatggagctcctcgcctgggttcctcatcctcccgccgacacacgcctcttctctcatccttgcccttgtccgggtctcagccctgtgattgaacgctctcttcccacctgccccccagcactagcccaggactgacctgagatgggcgtgtgcccaggggggcgcgcccccagaagggaggcgtgggcttcaagctggctctgaggcccacgtggctgtggcagtaggggagggcagtccaggtggccccagtgagcacaagcttaatgtggaactgcagggggagccaggggggtggcggtggctgggtctggcactggcagccctcccgcctccctccaccactgacccagcccctgcacaggtggtaatcatgagggactaccagcacgagaatgtggtggagatgtacaacagctacctggtgggggacgagctctgggtggtcatggagttcctggaaggaggcgccctcaccgacatcgtcacccacaccaggtatttctggggcctcagacccctcctgtgacacgaccaagtcccctccagaccactaggggtggggccacatctccaaaccagctgtgctccgggcccctgggatggggtcgtgtcttccattcctcccactccagagtggggtcgagtggtctcagattcctcccactgcaaggcagggctgcgtccccctcggcaccccggggtgctgtccagctggctgctcaccccccaccccaccccgcaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaggggacgggcggcggggtacgggggcggcaggtttccggctgcggggcttccctgcctcttcccatcccctgtgagggtaggtgagctctgacccccaggtctgtgtcttgaggagctgggaacttcgtccctccctggtggagcagcccagagtcaggttccagctcagtggggactctgtgcagtgggagggcacaggctggcgggggctctgccatcagcacaggacactgggcccaggggcagggatctgggcagacagcgcagcccccgccacaggcttcttcctccactgaaaagctgctccctgcccagcacccagggcggtccatggaccccagtcctgtcttccatgctttggactgaggttccaaatctgaggctgtgacaattataacgtcgggtggacatgattttctgtgagagagggcccttgacttgaatgaaatgcttgcagaagtggatgactccatcccctcccccaaggaagattaagccacaccattagtccaggcagaggcagagagagctctgtgtcactgacagtctgaaaatctccagatgtctatagatgtgttttgggggcgatgtctatgggccacctgagattgtccacacacggttgtggggatgtttgctggaggcaggaagacccatagaaatcctcaaaaatcggaaagggacccacagttcctaagaaggtgtgagaggcctggttgtcgcaaaggcaggctgtgtcccctcacggccctagtgcagggctactttctgctccaaccgaactaaagacttgttccagggcagcagggccccagggcacaggcttttggggccacccctgttcccagctccggccctgcctttgctatctgcagtactcaggccagtgtccccaaaagccccagaggctgtcagggagggaaatggggggatcgtgggggaggtgacttgcccgagggcccccaccaggaggtggtggagctccccattggtctggctctagaccccagctctgaccctagaccccagctctgacctctgggccgcacattgtgtctgaagccaaggaatgacgcaggcagacgcccctgctcgccctcctgctgtgccagctcctctgaccccactgcctctgccctgtcccaggtgaagctgtcagactttgggttctgcgcccaggtgagcaaggaagtgccccgaaggaagtcgctggtcggcacgccctactggatggccccagagctcatctcccgccttccctacgggccagaggtgagccccggggtggcttggttgtcccgccgtggacagcgtacgctgccattttccagctgcagcgctggcgggagatggggcccagtctggggagtcattgccaggaatggtgctctggacaaggaggtactgcaggcatgcatgtattcattcttcttttttttttttgagatggagtctcgctctgttgcccaggctggagtgcagtggtgcaatctcagctcactgcaacctccacctcccgggttcaagcgattctcctgcctcagcctcccgagaagctggttttacaggcacccgccaccatgcctggctaatttttgtattagtagagatgggggtttcaccatgttggccaggttggtcttgaactcctgacctcaggtgatctatccgccttggcctcctaaagtgctgggattacagatgtgagccaccgcgcccagccttggctctgccttctgagcattgttttcacaggccggctttccccttgtgggagcagagctggtcccggcagctctgggaagtgtctcccacctatgggctcctctctttccctgggtgttttgggtaaagtccccaggttggctctgattggctcagcctgggtcctgtgcctgtttctgaaccaatcactgtgtctccactgtggtgatgaggccgcatgggtcctgaacccaccagtggatgctacctgggctgagggagggaggacacctgggggcagttgacagaaagaagaggggtgggtgctgggggggcagctctcttgaggggctccctggaggactagtgctctgtggactgctggctgggtgcccaagagggagttctgggccaaggactccaggagccagaggcagagacagcgctggagcggtccctgcctgaggcctccccaggacccaccatcccccaacagctcagccctgctgtcccttctcccgccccaggtagacatctggtcgctggggataatggtgattgagatggtggacggagagcccccctacttcaacgagccacccctcaaagccatgaagatgattcgggacaacctgccaccccgactgaagaacctgcacaaggtaggcccctccctggctgggaaactgtgcgccagctggcgggtggcagggctccaggtggagcatggggtgtggatgggatggggacaatgatggcgcctgggatggcgcttactgtgtgctgggccccccacccccgggcctcatgtgtctgtgcagaccccctctgtggggcctgggcgacagaggcagcagagccacaggccctctgcaccctcaccattgccctgggccccacccagccctagagagatttgcacgtttagaagtggaggacagggccgggaccttcctagtggaggacttgccaggagggaaaggggcacctctgggccccagttgctttcagcttcttgctaaaccatggaaatagggagtacatgagcccccagggtttgtcacttcctctggggccacatagtaagcgccatcacaggtgccatcactgtccctgtcccgtctacaccccaagatctagacacccatgacctccgccccctgccctcctgcacagtacatgccgccagccgacttggcagaggcggacactgcagccctacagcaaatgaacagtggggagcctcgccccctgaccctcccctccttctcgacaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgtgcaaaggtccagccaccccgtcctccagcccgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcagtggcacgatcttggctcactgcaacttctgcctcctgggttcaagcgattctcctgcctcagcctcccaagtagctgggattacaggcgcttgccaccacgccaggctaattttttgtattttgagtagagactggatttcgccatcttggccagactggtcttgaactcctgacctcgtgatccacccacctcagcctcccaaagtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacaagatgttgctatgttgcctaggctggtttcgaactcctggcctcaagggatcctccctccttggccccgcaaagtgctgggattacaggcgtgagccaccgtgcccagcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggtt

SEQ ID NO: 13078 - DNA, 21614 bp, Human
tcccaggttcaaatgattctcctgcctcagcctcccaagtagctgggattacaggcacatgtcaccacacccagctaatttttgtatttttagtacagacggggtttcaccatgttggccagactggtcttgaactcctgacctcaggtgatccgcccaccatggcctcccaaagttctgggattacaggcgtaagctaccacgcccggcccaggttcctgtttttgcagtgggtttataattcattaccatacttaattattttggcgctcaaattgtcccagagttggccagtgggagccccttcaggctggcttctgtgtccttgtgagatgctccatcgttttttttcttgcataaaaagatgttccaggctcattttgtccctatcctgccctaaccctggaatcagccctttttccagggagccctcacacccttgttttagcacttagcacactgtttacttatgttttcctccactggactagattgtacctctctggggacacatagatgtgagtcttacttgctcttgtatcttcacccagcacaaggcctgacacatgagatgtttactaaatatttgttgaataaaaaattaatttttactgtagttaattgattaaaatttggttctaaaattatgatgctgatgggttttctttttttttcccccatctaggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaaggtaagacaccagtctaggattagtcatagtgttttgtacagcgtctcggtgagggttgattgatgatgatttttcaaggacaacctattctggtaaaaaaaaaactgccctgtgtgtgtatttgacttaacataaaaaagcagtgcctcaattagctaccattattggcagctctcaagtagttaggactttggatagatagtctgagttgttgttgcctaaaacaatagttaattaattagcaaaatgaggagataatgcagaacttgtcagtgtcttgacaagtggccaagcgcagtgacaatacacttgctctcccttcactgaaacaccagaactcaaaactgcttgccgcagtctctcactgctaaacataacatttcatccatacatctcttaaatgatccttcctcccttgctgatctgtaaaggttgctgcatttgagattggtgaaggattggatgatgatttgcacacacaaatcagtgacgagtctttgagtacataaatgaaaaaagagaatcttgccactgagagttataaacctgtcccgtatttgttaaattggaataccatccagtctattattttatcttcaagggagttgctgctgctatcagtcagaaactcggattttatttagggatcacaaatggtgcagggagagaaaagaaaaagttaactgtatacattataaacattgggcctactcgtcatatgtagagacaggagcaaatgaagtctcttttttttttttttttttttgagacggagtctcgctcagtcacccacgctagagtgcagtggcgcgatctccgctcactgcaagctccgcctcctgggttcacgccattctcctgcctcagcctgctgagtagctgggactacaggcgcccgccaccgtgcccagctaatttttttattttattttattttttagtagagacggggtttcaccgtgttagccaggatggtctccatctcctgacatcgtgatccgcccgccttggtctcccaaagttttgggactataggcgtgagccaccgcgcccggctgcagatgaagtctcttatcctgcgtagaattgtagtttgtagtctgcagggcagagagctgtaagcagtactctgtccccttgggtttaggctttgagaaagaaaaagcgtttctcaactttttctttttcttttttttttccatttggagtagggagaaatactcttcccccccacccccaattgccaaggctgatttagaaatactgaaatactctttacaggccaggcgccgtggctcacgcctgtaatcccagcacttttggaggccgaggcgggtggatctcttgaggtcaggagtttgagaccagcctggccaacatggtgaaaccctatctctactaaaaaagtacaaaaattagctgggcgtggtggcaggcgcctatagtcccagctactcaggaggctgaggcaggagaatcacgtgaacctgggaggcagaggttgcagtgagccaagttcacgacactgtattccagcttgggcaacagagggagactctgtctcaaaaaaaaaaaaggaaaaaggaaaaaaaatgtgtatatatataaatactctttattttttcagaaaaagacattttggtgacatgccacaacagaactgtgttatataataatccttcaccagcagattatgatatatagaaggattttttcacgttaaagcttttgctactctccctcccatgaaagaacagagaacagagttacttgtctgaaagtactgcagggacctctggaaagaaagattgccagaaacttttattattacaaatcctaccaaatcagaaggttctagaatccaggctgtcttgagagctgacaatcctgacaactctgttgtaaaatgtaatacagaggccagtttggcagccctgcgggccccgagagatggaggaacagggtgccatcaccctcccacagaaattgcatccactttgtgctacatcccatagtagagagtgttcctgcattaccgctgaccaggagcttccagagttttctcatctgtgcagtgtgagaaagggcagagtggttctgtatccctccccacctgtgctgactattaataaatgccataggcatcctcctgtctgattttcctttgcctggcttttctacatggagtcctttgtctgcctccagtgttttctcctccaaaggttggtaggaggccaccctgtggaaagcattgcttatttaggaagccagaaaacggcctgacttgcctccggtattttcccagagctcacctatttaatgatactggaatccaaacattttgaacatttcttctcttcctcctcctctcccaatgaagactgttgccagaacagcttaaaaatgctgacagtcttctaatttgtgggggtgtttgcacacctggaaattaggaaggtggcataatagcatactgaattataactatattctgacttctagctacatttttaatacttactgaaaatgatgctttaaaaacacattcccatgcaagccaggctttaaagagcacacactgtagtggaggctcagcagaaaacagctgatcacagtgtgcctctaagatagctgtgttcatgctggtaatgagcacttcctaacctgagacttccttccccgggttgctgggtcagcgtgcaagaagtggtcggcttccggtctatctttagctatgtgggccacacctcttcaagtcaaataaaaatgatacttctggcccaagagcaatagcgtgccagaagtcagttatggagtatcctctggaaagagtgactagaaggtgaaattttcttttcctgccttggaaaatggtgctttgaaatgagggtagttgctttgtcatcccagtgcagagatgagcaaatcctttgccgctagagcaaacctcctattaaaattgctgcagttcggaacacagactggcacttgttttactggaaaagcaagatgccatcaggggagagaagggccaagccaacccctgtgtgggagatttggcctttggtttttattggcatgacaaagcaatacaatatttatttggagggagggggcagctaggcactaggatttcagttggtaagggaaaatacactgagtacctcctgcgtgccaggcaccatagggaaatgacacagacccttcttgcccagaccttagtacccagttgaggcagcaaggcctacacagccactgaaaataggtggcctgcccagggaaggctatgtgtgggcatgtcgggttagttatgttagagtaggttgtagtgattaggagctcaggctctgggaatctgggctacagtcaactccagctcctccgcttccttagttggactttgggcatgtgagtcacttctccacattctttctgcaaaagagggagcaccttcctgatcaggttgtgagaaatgaacaccgggcgtagtgcatgctggataagtgtcagctgtcatcatttaactagaccccagagaatgagtggaactaaagcagtggcatgaggtaaggaaggacttgaaggtggaaatatgcatattgtattccgagaaaggagaaaacttgtctggtctagctgagggcttgagggaccaacattatccgtcccgtcttttggaagttttaacctcatgcattactgagctgctttcttggtacttaccctagcaaccaccctaacaaaaaaatagctatgctctgggtaccaatgtgatacagaaaaaaatcactcagtgcccttggctgatttgctagattaggtctttactataaaactggagtcggagtgagggaatcgctttcatttctcctcatgaaagtgcagactgtaaagctgactctcattctgggtgcttttcccagctgaaccatttagcaacccaccctcatagtgggagccttccgcactcagctgaatgaaattgaaaatctacgattgcacttcagtagggtccatgaatagtggctttgtctgtaaagagttgttgttgcacatggtctctgtctcccagtgccatgcgtttgcaaagacgagatcaggatcggcagggtcttattttaaagccaaaaaacaggctggggagccttgttccacaaagtatgccttttggtcatgctgaaatggctgcgtttggtgtgtttgactgtggatttaaaaagaagacattattggctatttacccttctatctgatgtgttcttattttggtgctaaaaaaaaaaagacaaaacagaatgataaagaaaatctttcactcactgcagcaaccacatgacaagacaacctattgaaaagctaaccaattcaatcatgcattgtttggtctataaggcaccaagtaaccagtttgacagtttgtgtccccccctagtgaattggcttatttcattggattcagtgaattggctggttgttgtggctttgtgtggacacagctctcattttgtgaggcctagaatggagttaaagtttctagtgtgaataaaaaccagctggggaattggactgcttgctcccctgggagggatgttgagttttgacagacaagctgaatgcgatgaaatatgagctctttgtaacctgcctaggaaagactctcagtgtgtgcttcagaaatagtcctactcaatgagctttgagaccaaatacataacttggttttaaaaatggggtgggcacactgacttgaccttggattttctgtttcctggaaaaattgtgtcttttaaacgaggtacttttgtttccaagccgaagttcagtcattcttttaggaaggagacatgcatttcggtgcgtgggcattcagtgagcacttgttttatgcccagcattgtgttgggtgccctaggtgtggtagtgacgttaatccagcttacagtcttggggatgttaggttttaaacatgtacttgcatgcattttgaatattaccagagggaaggtacaggatactaaggaattgtgtaacaaggaagtttaacctaaactgcggtatcaggaaagctccccaaggaaatgatatttaaggctgagactttggaagctgaggcagacaaagtcagtgaggatggaagcttcatggagctgaaagaacttcatgtgttcaaagagttgaaagaagcttagcgtggctgctctggagaggtgagggggacccacgccaaataatagagggctgtggctaccacgtgaagggttttgtgtttttgtgcatttattgaatacttactgtgtgccaggtacgtgtcaggcattttcacatcaattttttatttattcctcctcccagtcttaatgaggtgatgtttttcatccttgattttgagttgaggtaactaaggctcagagagattaaaccttgcccaagtgagtgtagccactgagtggaagagctgagattctgaaccctggtgttctgacttccacttcctgtggattttcatcatccagtctgcagaaaagttgctaatattcaacagtcaggtgcctatatttagaccactcaatcagtccagtcgatttgttcattcaaacaaaagatctttgattatctgaaaaaatccatttctcctcactgccccccagaacagcacggtgctgtttgtttctagcttcagagcctagttgagtagaggacaaaaaaggcatggagacattgaaatagcaactggaactttgagaaattgtttctcactggtgtcactcgattctcagtttattttaagcctgaagaacttctgtagtgtgtttttggtgataaaaatagactatctttaactatctgccttagcttacagcatacctgttcttaaaaaaaaattacgataggcaacccaaatctgtttttaaaagaactgggaattgtgctgatgcctcactgagccaacttggtctcctccaccacctggtgatactgaaatacctttgtagggactcaaattattccagctctagtcaggaatcacctttgcttataaggcaaaggccttccaaatggattttctacagcatttgagagaagcaagcaataagaactgacccatagcgttggaaagtccaaattcagtgtgtgttgaacttcaggcaagtgttcatgaaaatgtacctggaactagtgggccctcctcgctgtttggctccagatcacactggccacgagttgtcttctcgggggggtggatccgcggtcaccagacttcatgccttaatagaacaaaaagctatggtctgcgctgggcgcggtgggtcacacctgtaatcccagcactttgggaggccgaggcaggcacatcacttgaggtcaggagttcgagaccagcctggccaacatggcgaaaccccgtctctacaaaaaatacaaaaattagccaggtgtggtggtggacgcctataatcccagctactcgggaggctgaggcaagagaatctcttgaacccgggaggcagatattgcagtgagccaggatcatgccactgcactccagcctgggcaacagagggagacggtctcaaaaaaaaaaagctatggtctggatttagttaggtcctgcaataggatgacatgtctccgtttctttctccattatttaagaagattagggatgacaggaaggccaggactttgtggtccttcctgttcatccgtaaataaagatgctccaagatggtgagtgactgagtcatggtattaactgccagcttgaaggagaccatatctaagcatttgtgctttaataatagattttgtcagcaagaatacatctgccttcaggttttcttttaaacttgggcgtggaatttttcagagcccagaagggggagcaccggttaaccaagaatacatttggagcataagcaaataacttaattaaaaaggtccttttggaactcttttggaaatagaagagaataattgccaatcagaaaggcacgatgttgaatactgaatgcaagaaagtggtttagggaacagctgtagtaatgccacttatggaatctttccgattttctaagactctaccagttacagttagtccatagtatgctaccacacaacttggcaagccatgggtgtgaccctctggggctctgtgtattgatttcactctcatcctcattcagatggcactgtccatgttccagactacattccgtatatggtgttacctgttactctttttttttttttttttttttttttacataaaacattaacgccgggcacagtggctcacacctgtaatcccagcactttgggaggccgaggtgggcagatcacttgaggtcgggagttcaagaccagcctgacaaacatggagaaaccccctctttactaaaagtacaaaattagccgggcttggtggcacatatatgttaatcccagctactcaggaggctgaggcagaagaatcacttgaacccaggaggtggagtttgcagtgaaccaagatcgcaccattgcactccagcctgggcaacaagagcgaaactccatctcaaaaaaaaaaaaaaattaaaaaaattttttaaaagttggggtctcactatgtttctaggctggtctcaaaactcttggccttaagcagtcctcccatctgggcttcccaaagtgttgggattacaggcatgagtcactgcacctggctggtgttaactgttttttaaaaaggccagacatggtggctcacacttgtaatcccaatgctttgggaggccgagtttggcagattgcttgagcccaggagtttgaaactagcttgggcaacatggcaaaactccgtctctacaaaatattatctgggcgcggtggcacacacctgtagtcccagctagttgggaggctgagatgggagaatcacctgagcccagggaggtcgaggctgcagtgagccatgattacaccattgcactccagcctgggcaacacagtgagacgctgtctcaaaaaaccaactagaaaaccgagttccgatgcctggttccccaccaccccacctgcttccagtccagttaaatcaaaatcactagggctggtgtccaggcactttgaaaaaaaaaaaaaaagacaaaaaaaggcagtgaatccaacaggctgggttctgttttttatttcctttattagatgtgttaccaagcatttaaaaggtttaaacggctatactagatggtacaactctagtgaacatattttctgactctaaaatctagataagtaactttacatttataaggttgtttatggagaccaaaagagaatatttgaagttgacagcgtagggtcagtaagtagccctccctgctgttcccacagaagatagaatattcttacctttttccattgttgcatagctggtacttgctcatgtggtacctagatgagctttgtttattgtggatatgtcttctgttaccaaatagattggaagttcattgagggcgggagacgactttggtcctagtattagctctgctgccagtttgttatgtggccttggggtgattcataaattcattaaaaaaaaacaaaccaagactcttgccttctaggaacttagcctagtagaatatttgttgtatgtgtacgtaaataactgtacctcattcagtacctacagagggaattaggacttcatctggcggtttttaaaaggcttatgatatagtactgccaaagtatgaacaaggccttctgagcctcacctcctcacacactagtgtgagcagcacagtgtaaggagaaatgagaatctctaccacagagatagtctgcgtctcagctcaatttgagaaaatagaaaggaacattggcccagtacattattggaaactgtttttgttcagcaaatacattgagtgcccactgcacgtcaggccctggaacccaaccatcttcccagctgatagaaggcccttcttttggctcttacctatcccctggcttccattctactctttttcttgccccagtggacttggacagggtctgtggactgggcttacagccgagtggggagcagaggcagtgacagatgcagcttcctactctgccacagtcgggagtttcctctttatgccctgtgtctgaaaagccgagagaccagaggtagttgccaggcaccatttctccccagtgcaccacgggcataaactattatttataaactttgccatgattaatatcaagaccaaaaatcaggtgtgtttttaagcaaactatgaggtacaaagcaatggactatgttgttcatttttttaaaatcagtctaaaaggccaaggtgaaggtgtttcaggctggcccagtcctttgtgtatggcagtggcatttcttcgtggaggagatagaccatgcaggggaaagagcatggggctttggcattcaaagatcaccgtacactaagtgctggctgtgaatctccatgagtctctgttttctcaactgtaaaatgggtctaaataacccttaccttgcagagtggtcgtgaagttttgaataattgtgcagagcagctaccaccatgcccagccactcctagggaatctctgttccatttttgacccagttggactctaaacttaagaggtggccgggcacggtggctcacacctgtaatcccagcactttgggaggccaaggcaggtggatcactggaagtcaggagttcaagaacagcctggccaacatggtgaaatcccgtctttactaaaaatacaaaaacttgctgggcatggtggctcatgcctataatcccagctactcaggaggctgaggcaggagaatggcttgaactgaggaggcggaggttgtagtgagccaagattgcgctacggcactccagcttgggtgacggagtaagactccatttcagtaaaaataaataaataaacttagaggcacacatgtggagattgttctcagggattgaattcctctggctagatgcttttttcagttcagcctgctaataggtaagtgcctccggaagaagatggatgttgggtgttgttactttctccttttcaaggacctgttgctgaaagtgcacccaataactccctgaagagtgacacacgtctgactgggggcatgagatatctggcaggccactcaggagaatggcatttccatgagaaatatgcccagtaacccttcagatgcctgaagtgttgtttctatcagcagtctggcccagctcttggcatgcaccccaaaccctgattttcttactaggaaggtttagaattcattttgcaagagttccaattttgtgacaccctagagagccttcagttatctcaaggaggtattctgaaattctgtaaaccagagtttgtcttaaaaaatagggagtgagattgaatccacgtcactcagcaaggaggtggggtgatgctactgcaaaagcttaccctccacatccactgttgtaaatggaaggattgaactaaatctggggctctttgaggtgaaagagataggagcagttgtctcagttagccttccgtctctcttatcgctcccaatgtgaccctttggagccatgtaaaagaagcctgctctatagtcaataggtagctctatagctatttgaaaatagctatcagagtgccccattattctctttgccaatttaaagttccctggtattttatatgagtggatctttattacctttagaaacctttggaagtcctccagataatcagtgatcagtgtgccttcttttttttttttttttttttttccgagacagggtctcctgctatcacccaggctggagtgcagtggcacaattttgactcactgcagccttcacctccccagctcaagcaatcctcccactgcagcctctcgagttgctgggactacaggcatgcatcaccacacccagataatttttttgtaatattttttgtagagatggggtttcaccacgttggccaggctggtctcaaactctggcctcaagtgatctgccaacctcagcctcccaaagtgctggaattacaggcatgagccaccaagcccagctagtgtgcttttattcacttactcagtcatccatttatttattctctccatctcaagaattttcactagattataagccgtggtggttaaaagcacaggtttcgcagtcatacagacctgactttgtcaagttactttttctaggagttggcctctatcaaatggagtttttaatacccacacccacaaatattttgaatctggagtgcttgtaaagaatttatactggctgggtgcggtggctcatgcctgtaatcccagcactttgggagtccgaggcaggagggtcccttgagcccaggaagctgtggttgtagggagctatgactgcgccactgcaccgcagtctggatgacagagcgagaccctatctaaaaaagaacttatgctaggttctggtacacagaaactactcagttgatgaaggctaaatttcctggctaagttagattgttagaacacaccagcatcatcttgttcctagtattaagagggtgggggaatgtaagattgaaatttgttgtctgtttcctagaaccatggttagaaggaggctttaaggtgattaggaatagcttctttgcagcttccatttctgttccttcacagcggtttatttggaagcctgttttattgaacagtgctgttagtttcaacaggcatattctgtaggatttgagattgttaaaaacttcaatgatagaagatggatgaatgtgatttaagtacagatgctctttggttattcagattgtatagctaaccttttaaactccaaatgtaaaacttttcgacttttaaccttttaaactttaaattaaaaaaaaataggaaacattttaagtggggagagcattgtttgaatcattgttatctggttgcaacaatgtgtgaaacagaggcactcagcccctcttccccaccccgcccctcctcccggagacacagtcttgctctgtcgcccaggctggagtgcaatggcacaatctcggctcactgcaacctctacctcctgggttcaagtgattctcccacctcagcctcctgagtagctgggattacaggcacttgccatcatgcccggctaatttttgtatttttgtagagacagggtttcactatgttggccaggctggtctcgaactcctgatctcaggtgatccgcccgccttgccctcccaaagtgctaggattacaggtgtgagccaccatacccggccagccctcttatttattattttgagacggggtcgcactttgtcacccaggctggagtgcagtggcacgatctcagctcactacagcctcgacctcctgggctcaggcgatcctcccacctcagcttcccaggtatctgggactataggtgtgcgctaccacgcccagctaattgtttttgtattttttgtagagatggggtttcaccatgttgcccaggctggtcttgaactcctgagctcaagcaatttgcccacctcagcctcccatagtgctaggattacaggcattagccaccatgcccagccttaaattctttatgttatacttcatataagtagaagatgctagagacacagtatagactcgttaaattatttcctgtaaatgtatatcatacatcgttaattggcatttccttacttctttggtaaaaaaagtctgaagtcagagcctgtttgcttcagtctataaggggagcaagcagcagccattcccccgaacctaggaggctatgccactactttatgaggagcaggtatctcacagtgagtggggacaggctttatggagtacatggttcttccctgagaccccagaatccattcacattatagcattctccatattgagtcaggtagcaggctgaatgaagattggattctcattgcctttggtttgtcatttgaagtaatctcacccagcagcccagaaatggaatgatcttgctctttccttgtgtacattatattctgatctgttctttttttttcttgctatttgtttgcacaggaagttctcaacgaatctcagactaaacaggaagtgatttttttcttatacaaaggggtactggtaggaacgaagatgggcaggagaaggagagggaataggtggcctgcggcctggcggttcgttgtttccttcagtggattttatgtaaaatccctaaatactttaggtttatgggctgtgcacatttctgagtaaatctgcttttctaaattggtttcatcaactggaaaatgtaactggattgctggagatacacctgggtctaatttaccttgatcctatttggttacttttcttttttagtagatattttaacaaaaggccaaaatttcaagtgtatttctttggctttaggaaatttatcatttgtttagagtaattttttctccatttaaggttcaaaataaaaagattgaatacttttgaggcagagtatctcagtattaatcatgttaatgagcataggctttggagacaaaccttcctggatttgaatccaagcagtcacttagtagttgtgtcatttaggcatgtgagagattttttccttggtaagattgagtgtcatcaggtttaaaagaaataatatttggcaggctgggcaacatagtgagaccctcatctctacagaaaatttaaaaattagcctgggtacatgcctgtggtcccagctttgggatgctgaggtaggaagatcacttgagcccaggaggtccaggctgcagtgagctgtggttgtgccactgtactccagcctgagcaacacagggagaccctgtctgaaaattataataataataataatatttggaacttagtctgtgcatagtaagttctcaagtggttgctgttgctgctgctactgctgctgctagtacttcttgaagaaggtgactagggaaaaatagacaaaaaaaatactttatttgtcttgtttgattagtcgactttaccttttcctaatgtggatgcaactgagaattaaccccaagctaatgtatcaaaggacattctcatttgggtctatcagccctagcagaatgcctgctctcttttctagaaagaggaaataatctgttttccatttcattttttttaaagattttagctatctttgagtatgtaacatctattatccttgtagggtgtttggaaaacttcctgtttactccagtgcatccctggtagaggatgtagataatcatcgtattgttattttattacataaacatggactgcttcttataaacatctttgttctaataatgtggtctcatactcaaggtgtgactttctggcatcctgtgtggtattcagaggccagaagatagaaaattaaaagtagtgagatgagccaagcgaatctttttaatccttcttgaaatcttttttttttttttttttgagtcttactctgtcatccaggctggaatacagtggcgcaatctcggctcacctcaatctccacctcctgggttcaagcaattctcctgcctcagcctcccaagtagctgggattacaggcgcccaccactacgcctggctaatttttgtgtttttagtagagacacggtttcaccatgttggccaagctggtctcaaactcctgacctgaggtgatccacccgcctcggcctcccaaagtgctgggaatacaggcatgagtcaccgtatccagccacttcttgacattctttctagcagtttttataccactgcttcccttctggaagccttactgatgtttaagttacatgttgatactcactttgtttttgtgcttccctttctctttcctggacagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggtaagagtattacctcatagcagtttataactttcactgtctacaggatgcttactggagggtcaagccatctggagattctggaatcagttgttgttgattgtgagatgctcttggagaaggagctgagcagtcccaacagttgtcagatgtgtagattctccatttgtgtgcagttttgaggctgtcgttgggcatttattaggccttggcctacgaaggagctgttctgtgctcaaggtggcagctatggctgcttgggcgctttctctgtgctacctcacccaccagagcatcagcactctgtcagttgcctgcccgcctgtgttccctgcagatctgtgaactccttgagggttgtgctatcattgtgtcctcagtactatagtggatacataatacattttggtttagtaaaattaatacagccctcagcattgttcggatgcctgagacccatgtattgataggatttttttctgaggtaagaaaatgattaggatgtttgggatatcttctggttatgccgctcctctgacaacttgatgctatcacaaaggtagactgtcttgggaaatttttttgcattgttcttgaaataattaagttttacttgtgttgaaaccatttgctttattcatttgagctctcatgtgtccctttggccttccagtttcactaaggtgggttcttgagcattcggagttgggctcaggaacacaggcttaaactaatttgaaactaaggtagggattacagccttccaatctgttctttctaactctgatattatctacagtggtattaagtattgtgtggtgtggacagcctactaggctctgctgataatttcagcagcatcgtgtgaagctgagtgacagtgttcatatttacttaggatgttgtaaagcagggaagatggctttatttattattttatttttatttttatttttattttttgaaatagagtctcactctgttgcccaggctggagtgcagtgacacgatctcaactcactgcaacctccgcctcccaggttcaagcgattctcctgcttcagcctctgagtagctgggattacaggcgcccgccatgacgcccaactaatttttgtatttttagtagagacgggtttttgccatgttggccaggctgttcttgaactcctgacctcaggtgatctgcccgcctcggcctcccaaagtgctgggattacaggcatgagttacggtgcccagccgaagatagcattttttttttttttgagatggagtctctctctgttgccaagctggagtgcagtggcatgatcttggctcactgcaacctctgcctcccaggttcaagtgattctcctgcctcagcctcctgagtagctgggattacaggtgcacaccaccatgcccggctaatttttgtatttttaatagagatagggtttcaccacattggtcaggctgtctcaaactcctgacctcgtgatccgcccacctcagcctgccaaagtgctgggattacaggcatgagccactgcgcctggcctgaagatagtttttaagttggagcccaccaaagactttgtatttatttcctaggttttctgtggaaaccagagaaataattccccccaggcttgaatctcagtaataagcacttggcataatcattacagatctatagctttgtttagtccattctgtacccaaagcggtttctcattgtccatcttttttttttcctgctgtagacacaggggtctcacttattgcccaggctagtctcacaatcctagcttcaaatgatcctcctaccttggcctcctaaagtcctgggattacaggcgtgagctaccatgcctggcttcagtgtccatctttttgacactcgttttatattaatttcctcctttatctgtctctataaaatgtttgaaagttgcaggtgtgatatgcacctttacatttatttatttatttatttatttatttatttatttatttat

SEQ ID NO: 13079 - DNA, 10486 bp, Human
aaaatgtggtgcattcattcaactcacacttttttacccagtgtgcatatttctttgataaagagaaggtcagtttctttaaggatagaaaactttgggtgataagaatgcttagaggagggcatctggatattttgatgacagacgcgatggtgtgggggagggggtttgttactaaatcagttgtatcaagatcacatattatctattttccagttttgctaagaataaaaaatgaaatccaagttaactaaagggcaattcttactgagaaagactgtgaaatctgtctaacagaactttaaaattaggtgtgatgccaagttatcttgtatacttggggagatacaggatgatcctggagttgtgaagattttgttaaaagcagcccaccagcaaatatttactgacaattgaatgtctatgtgcatgtgctgttttaataattggcaacatagccatgaacaggacagaccactttcattacagcagcttacattttattggggagacagacataaacaaatacaaatataaaataggcctggcacggtggctcatgcctgtaatcccagcactttgggaggccaagatgggcggatcacctgaggccaggagttcaagaccagcctgaccaacatggtgaaaccctgtctgtactaaaaatacgaaaattagctgggcatggtggcgcgtgactgtagtcccagctaccctggaggcagaggtgagagaattgcttgaaccctggagatggaggttgcagtgagccgagattgtgccattgcattccagcctaggtgacagagtgagagtccgtctcaaaaaaaccccaaccaaccaaccaaacaaacaaaaatataaaataatggattttagctaagtgctatgaagatgataaaacaaggtaaagtgtagagagtgactggggactgccttagttgggacagttaggatagtcctccctgaggggatggtgttgatgatgaaacctgaatgataggagccttgcttggtgggtaatgatgaacgaagatgctttccactccactctagttttagactattggccatctgaaaggaacaaagtgtgctggtttacctcattttacatctaaaatactagcacattttaagatactatgattttttcttttctttctttctttctttcttttttttttttttgagatggagtctcgttctgtcgcccacactggagggcagtggtacaatctcagctcactacagcctccaccccctggtttcaagcaattctcctgccgcagcctccctagtagctgggattacaggcatgcactaccacacttggctaatttttgtatttttagtagaaacggggtttcactatgttggccaggctggtctcaaactgctgaccgcaggtgatccacctgccttggcctcccaaagtgctgggattacaggcatgagccaccgcgcccggcttggatactatgattttcttggtaatgaagttcactcatattaattactcagattgccaccctgaatttcttgtggcctgcttaaatgcaaaaatagatcttgaagtttttagttaaaatattaaactcaattcagtaggtcacacaggaagtgtgtcctcaggcttagtggagattgcaaatgtgacaccatgctaacctaatgttttcagaaacaaatgtcccactgtgagtgcgagtatgtgtgtgcttgtggtggcacatcctccagaaaagaaaaatgaaaagtgaagggcctaatttcaagtagccctctatgtttctgcctttttctggaaaagatcagttcatcttgatagtagttgaaagaaaagtaatcgagagactaattttgggaaatctttgcccattctgtgggattaggaaaaacaagaggtgtctagactctagaagtttagttggctcagacatacctactttgtccagtcagagtttgcatggatactgacactggtgtctttcctctggcagatggctcaatcacaaaggagtgagacagaaacgcctgaatgtctggctgggaattaagaatgaggatgctgatgagtaagttctctctatacctttctgtcagagggctttgttatcaatataagacatgcgccttgtttatacgtggtaaatattggttgtcattgtcacttgaggacattgaatctagaactttgactatcttttgaattgaattgcctgaaggtaccctataggcactggagttcagagacctgcttctgaactcaaaatctggatgtgtaagctactttgagtatagctacccaaaatctggctgtaaaagcacttttattcagatgttcatatttcagcttattggatgaaacatgaattctttgctttatgcaccatagcaagtaatgaagttaacacccaaataattgcaattttgctttgttatttgtggtttaaagatttagaagagtgttttatttatgaatttgcttttagatagaagtaacttgttagaataatatactaatatttaatttttaggaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtgtaagtcttctctggggatataaccttttgaaatcttttgcatcaattattataaaatcaacccctcataaaattcagatgaaattagttaatgtacagtaacgaggacccatggctcggaccataactattagtacaaaaaaacccagctttatgagaaatgatatctgaaattatcttggagttttaatttacgtggtaagtagattaggccccgcagtattgctgttggatttcaggtgtctgtgaaaggtaatgtgagatcttaaattgaaaaaaaaaaaaaaaaaaaaaaaaaaagcacttaattgtttagtagtatcctatatgtctagtatggtctccagtgtcagattaggaaaagcttgattaaatagaactgtttttacttcagaaggaaaactctatctaaaattttaaattacatattattctgttgatgtagtgacaggaaatgtgggcgtgttttccataagataatcgtgacttttttgagaaaagcctattttccttttaatggaaagtgaaattttggggataactaactgtgcttcagtcagatttttgcctgagtgtggaatatattctttaagaaggcaaacatcttcactgacaaaagccacacttagaaaagagttatgatggtgccagatatactgggttcagctcctggctctactgcttactagctgggtaactttgggtaaattacttaatctttctttgcccagtttccttatctgtaaaataaggataatacctactttagggtttttgtgaggattaaatgagttaatctgtgtaatacaatatgcttttaacagtgcagggacataagaagtaaatgtcacctactaatatgatgatgatgctactgatggatgtggcagaagtcaaacaaagtgacaaaatgattgtgcccttagagggcaaggtggagaaggtagacgaaaggcattcatattaacagactgctcagtgctttatgtgatcatcttgttcatagtgctctacttgtaccatggagtcagagtttgaatccaagtttacctggtttcaaaacccacatttttctattgcaccaggcttttttcatttcaccaaatatccacaatgaatagaaccactgtgaaataagtattattagtaggctgtgcacatgtggaagcattaattttagtggagaaagagcggattgggaggttttgtggaaaaggtatctgagatggacctcaaaaagatgaatgggatgtcttatgggcagaaaatgggggaggagttgaaaagtgcattggattactgttatccaaggatagaactacttgcaacatttcatttctccttgacttgggctgttgaagttatctgagtggaaatgtaggcgagaatggttcttgtaagacttaggatcttctaagaataataaaaagaaggaaggcagtaagcccagtcgctcactgtcactcaggttattgggtggcagcctgtaggttcaggacttggctgcagtccttacataaactgattaatcaaaaactacccttggctgggcgtggtggctcacacctgtaatcccagcattttaataggctaaggcaggaggattccttgagcccaggagttcacgaccagcctgggcaacatagcaagaccccatttctactaaaaataaaaaagtagctgggcatgtggctcacacctgtagtcccggctacttgggaagctgtggtgggaggatcacttgagcccaggagttcaaggctgcagtgagctgtaatcaagccactgtaccctagctttcgtgatagagcgagaccctgtctaaaaaaaaaaaaagaaataaataaacccttacatttgtggttgttttaacacccgtatctgtggccaagtctgtagggaatgggaacgcaatttcacaagctttgcctggttaacaaaaaacacttgtttgcataacaattgctctcagacttctggccatttagtgtccttttatctattgttacctaccttaacatttcttctgtggtttgtcattgcagggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtactttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaattttttgtcttcatgctatgaagggggtgggctgggggcagagtgggggtcaagagagaagagtactcaggtgttgaacagcccttgaaacttccaaaccttctctccagtaagcaccaaaagactagtactggggcagccagaggctcttttcttcctaggggaggacattgactccaactaggcatgatgccagagtcctgtccaccgaacacagacacaggaagtcttactgactctgagaaaattaaaactgaatgccatttcctccacacctcactgcccactcctaataagctgtttattggttctcatatttctgcccagaatgaagtgtttccacattctactctgggggagggggaaatgggcccagctttataatctatcctcttattgccccaggcccttgtcatctcctgccaaggcacactgttgagcttcctgtattctgggaacgtaatgagccaacatgcgataacctcttgttgcataggatactgcagcgctcatccatgtctcaggccccacccatgtgtactcaattataaataagtcagattgggcagggaacagcctgttgttctaagtgaccttgcctatgtcttttctccccactacactttagctacacagcatcccaagaccactgccaggaactatggatttctcctaatcccagagttgttcgcacttctgtgtttaggatgctcaaattcctagctccttcccagttctttcttctgaactctacccgctggctggatgtttccactgggctcctgggtatctcaccgacacttcaaacttgtttacttggggctgggcgtggtggctcatgcctgtaatcccagcactttgggaggccgaggcgggtggatcacctgaggtcaggagttcgagaacagcctggccaacgtggtgaaaccccgtctctactaaaagtacaaaaattagctgggcgtggtagcatgcacctgtaatcccagctactcgggaggctgaggcatgagaattgcttgaacctgggatgcaggggttgcagtgagctgaggccgtgccactgcactccagcctgggcaacagagcgaaactctgtctcaaaaaagcaaacttgtttacttgtcagaaaaagtatgattggctatgaatttcctcaccttcctaccaccaaacctacaaccttatctatatctacataactattctccctcccatctgttaaattacaatagtcccctccaactaaagtcaatccttccacatgtattttggaatctattttcttccacctcaggaatctcccaagattaagatcaattctttctctacttcaactggatcatttccactgacacttaaacatggttggttggttctcattctactcccctaatccctactcaatcatcccatatacctttatctcttttctcctcttcaaagccaagcctttggaaagaactgtcttaaatttccttatttccccatctcaaatatttcagtactggttccaccactgtttgaaactgcttttcttgatgccttcaataaccatcgctgttaactatcctgtccatggaaagctccttcatggactctatcacaactcactaatctaatattcttctgacatctgactgttcttttacatctcctggattccttcagttctcaatgccattttacctggcagttttatccacagccatgaatccacctaccatctctaggctgattacatctgtttatttcatttgcccagacctctattggaagctacttcatatttagcgtatggaatgcagcactgaactacttagccctggttctcttccttgtttcttatttcggtgaatggaaatacaattcatctggttatataagtcaaaaatgtagtcagtcatcatccttgatagccctctgcttcatacctaaagtccttcaccaagtgtcaatcaaaacatcacttctaacttcactgcttcactaccatctgca

SEQ ID NO: 13080 - DNA, 105733 bp, Human
ggtgctttttaaaaaaaccaatctgctttctcttctgtaacatagacaaaatattaatgcatttttttactccactagtaattgacaaagaattgttatttgtttcatacttaaggttaattctaacagtgatgaagtttgagaggatgaaattacatatcaccgaccaattaaactatcccttttgtctttaggctgcatctaaccattccagattttcatctatctatctcataaaatctttttggaaggagatttttcatctttccttggtaacatatttcagtgtctctcaatctttccataaaaactaagttcttatttctgtttaacctcggttccacctgctggagtgtaatgtcactatcttttgtccatccttagccttgttatcatatattgttagtgagaggcaatgtagtataatggcatggtttttggaatcagacatgccagcattccaatcctagctctgttactttctaggtgtgtgatgttgggcaaattacttctgaggtttaatagcctcatctgttaatgagtaacctcagagcattgttgtgaagataaaacgagatagtatcttattctgaaggattatggggtaggacgaggtatggtattggagacctaaaaagtgttcaatacatactataatagctatttatctgattatgtgcatgtatctgacttaattcataaactcttttagagcgggaggcatacttcctgagtacgccctggatttcaacagaagtatagtgttgtgcacatagtatggtgcagaggctcaatattactgaatgaataaattgttttgtttttattccctgagtggaatgaacagcccccagctatctgcaagatcccacgcatgtagaaaaaaggtgacaaaaatcaatctgcagtttttaaatatgcagatacctgactttatctagatgttttagcatggtgtagatacaatgcaaataacttacgctttctatttctatcacgttcatttctacgaattttaacatttgattattgtcattatttttattattaagctgcacttaggcacccagaaagggactgactcatatgtctcctcatccatccaagcatttaattgagaaattttaaaaatgaatattaagagctaattatatacttgaacaaaatctttcaatttgtgactaagtacattaccttccctatttatctctaagatctgagcactacagataatattcctaattgctttgtacccaagccaagaaataaaaaccaaaaccagaaaagtccaccactgcaagtcccaaagcacaattagtatctttgaaccagtgaagtattagttaggactttatttttggcttttaaatgtttaaacggggcaaggagggtaagttgggggaacaagtacaagatacatagattcagtcggacttgaatatttctccataaggaaaggaaagagtaccctggtgtgtgcttaggctggaattaaaaagacagcagcgtggccatttcctggattgctttgtacacactttacaggggcggtctcaggtatggagctctgggcacctgctcgctcacactccaacagttcagaaacccgtgtatttgaggccgggtggctcaggttccacgtaactgggcttaagtgtcattaatactgcttgcggcggggggttactgagctgtgctttgggacctggatgcttacttcggactttctcctttcttcccccctacccccactagtttccctttccctccttccttcccgggcgtgcccaccttctccctttgctcccactttccgctgtctgactcttgtttccttcaccttcctttctaatcggcttcctgtcttccaacctctgccggccggagagattgagattggggctggggctggggctgcggctcagaagaggcacgagtcgggcgggacaggcgcgaggcgcccagccgcgaaagcgaggagcgcgcaccgaggcgggggcgcgcgcggggcagccgcgtggctaggcagacggggccgggagcggcgcgcgcgcgccccgccagcctctggcgcgcccccggcggcctgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctagtgagtaccgtgccctccgccgccctctcccttgcgctcgggatggggctcagagttgaggcaaagtgcgagtccgcctcccggccggcggatgcccctgccctctcgctgcccgggtccccggagctactcaactgaactaagggcaccctgcgctttttgccctccgaggcaggcaccccacacttggagcagggtgctgctgcaaggaatggccccgtggctcctagaggtgttagctttctctttgcgatgacttcgaggagttttgactcctttacttgtctccttcaccacccccaccacccctcaccctgccccggttttggagatctgggttactcaaggtgttgacctctcctcactttggtttccattaccccaagtgaaagccccgccagtattcccgccccgcgtatcttgcacatggagaactactatcccattgcaggatgaaaaatagcaactatccaacttctgttagtgatggaacttagctctggagcttgtgaggttacccatcttctcctctgggttttcttgtgccctgggaaggggggaggtttcttaaaacacatttttcccttactacttatttttatccaaatacacccattaaaatgtgtttctcgtgtagcgagcgcactgccggcttcctcacatttgaagagtgcgaccttttttttttttttttccattccaccgtctggataatagctcattcaaagagaactgtccccacagagccacggtcagtttgtacattaagcgtgcattcgcttttgtgtcgatttcactttttaagaaatccatgttatacttgatgatttgagaacagttaaatagtaaatgtgtaggaattgttatggtttcctttggttttgtatcttaaattattttacccttcaagtgtgtggttgaaaaattttaaaatagcactgttacagctaaaagccaggttaattctaatccctgtccatttggatgtgtgggaggtggggcatatggttttttttttttaatgtgtaaactgaatgtaaactgactttttgcgttaaatgctagacagaatgtaaagaccaagagagggcagaatgagaaaaagtgcaattgcttttatttgagtacttagcatcaacaagaaaaataatacagaaaaaatttcagtgaaactcgtactgaaaggcatcagccccttttccagctaagacaagtgccccttgtcccccatatcataaatacctgaattgatgttcttttaaaactgctccttttcattttgtgagattagaggattggactactgttgtataagtataaacatttctgcctagactaaaatattaaattaatatgtaaagtggaaattacaataaagtgtcctggaaattgtgcatttgtactgtttgttttctttggctttcattctttaaatgtctttaattttgtatgactcttctgtggtctgtgcattttcttttagacttggttaatctttgggcattggtttatgagaagtgcatgaaagagcatccaggagaacacttcgtcaaataaatatctttataaatttcatagtgttaattctagaagcttaaatcctaagtccacacttttatttagccaattcatttttttggttaagaagtaaaattcattttgaaaagactgccatgtaaaataaatctatgaaatatttattagcttgagtcacttatttgtgacttttatgccttctcttggatgtctgtgatgtattaaagctagtcctgggatgatacttaggttggctctgcaaagtcatgggactgcaaaaattcactcctgtttagttcttgagctgttaacatgagtttggcaaaggctgctttagtattcacgctccattgctccaaagcatatgagaacacactttcaggaggtgctattttcacacattttacagtgagtttgggttaactcaatgactataacaagaattttaaaaggaaagtgagcttgaccagttcatacagaaaatgcttttgaaaatatcattttaacagtagccactttgcacacgtatttagatattattctattcaaacaccccagcccctggatttctttttcatggaattaagcagatgataggacacactttgaccactgtggatatgttgaaacggtggtggaagaataataactattatcatctagcagaccttgaatgtgtcatgtattctataaaacaactaatgtagagtagacactaaacatgaccaagtggagaatgaaagttcacttaagtggaaaatggactgtcttatttccatttatcttcaactcatttttgaggtgtactgtggaaaattcaggaaaacttcctgattatgggagggacataactaagcatttcaacagtgccttagtaactaccacacatttgtctttctgttttacatatttaacagcattgtgtacttattagtgttgctttatcctaagtgccataagacataaacagacatattgggatttttttttctcatagttattatcatgtcatgagcagtgtgtttcaggtcatgtctctgcccaccagatgttgtgcttttgacagttttaacttctcatacgtaaacgcacactcttttcatcctttcccaggacttttctctcagaatgtctgtaactggtgaaatcctcgttttatgggtttagaagctgtagatccatcagttagttatccttccactcagtattgaggggatgtcaatatatgaacaagctgtatggatacaaattcttcactgttgcccccatgttttgattacctacccaattgcagaaagcattgtacaggcaagtttgtgcacagaaatctggttaaagacatgaggaaaacttaactttactgcattttgatattcaaaatcagcactcttggatttatgtagggagcccagatagctattttataggaacctgtttgctactataaagggatccactgtgccaggtgttgagctagttagactccagagcagtcattcttaactttggctgcacattggaatcactgggaagttattaaaaatatggatgcctgagccccaactccagagattctaatttaattggacttgaatggggtcttggatggggcctgggaatcaggattagtaaaagctcaccaggtgagtttaatgtgcagccaaggtggcgaaccactggttatagtctactgaatctttctcttgagatttggataatttgggctagggtagtgccttggaatctgaattttatgagcaccctaaatttcagtaaacaaccgatttgagaaactcttgcattgtggtctgcagaagacatcacctgggaaatcattacaaatataggctctcaggccccgcctcagacctgctgaattagagtctgcagtttaacaagctcctcaggtgattcttacgcacattaaagtttgagaaggactggttctcatactttggagtacatcataatctatagtgcttgttaaaacacaaattgttgggccccattcccggagtttctgattcagttggtgtggggtgggactgtgaatttgcatttctaacaagttccctggtgatgctgatgctacagttcccagggccacacgttgagaacctctggagagagaattgaggacctgaataagtacttgagcgactgtaatggaatggcaattttcaaggccagttttcagtataaaacttcctgcttctgtgtcactatgctttagcatgttcattctaacctagcacccaggagattgagtgctgccgagagtataagagtctgaggttcttgggatggttttagttgaggggtgagggtgactcttggaaacctgtggtatgattttaggtcctttttcagaaattgttaaatgtaagggatacattttaggagttaaaagcattacaaatatgataccttaaggtgaattatattgattttaataagtaaagccccctttgttcccataaaatgctcttatgattctttcactaaagtattgtgaaaagattttaaaagcttttacttatgcctatggttgctggatttcattttaagactttccctctgtaacaaaaatatgaaaggattctgctaaggcactgggattgttcagtcttatatctttaatgctgctgcgtgtcacgttacttgaactttttattttaatcatcctaccacctttgaagttaacgtaatactacattttgtatagaccatagcacatagaagattctttattattaaagtacatcagtaagtgtggttttaaattgcaattaataaaatgtattttaaaaaaatccactcccgcatatgcagattttgagactctgaagaggtgttttaacagttaactctttctcgtcttgccaccgtagtcaagttgctgtttttcagtgtgcttgggaggaattgggttgtgttggggagtaggcattttgtttcaacagaactgtggcaatcctattgcattatcaaaaagatgatttgatagtgctgctcaggttaaaatgatattaaatttgtattttaaatataagccattatatttctgttatatgttttctgatgaagattgaccagaatagccagaagatgtatctgtctatcgcagatgatgccatgaggccatgacagatttccttatccacactaacataacggtactaacttgcattctctggtcataatgtatagtttttcttataaaagcaaaacactgtctgaacaattgagtcattttgaaggtataatatggttgtttttttttaacaatgttgattcccattggaagacaatctgatgtcgtatcttatggatagaaaagaaggcaggcatgtccccagttgtcagttgttctgtaaaagccatcagtgactgagctagaaggatggagaaatataaatcacaaaattgtttttatatccatgcataaaggtgtatgtgggacaaggtatatttagttaaaaagaaaatgcttattttgctttctcccccatatggccaaagggagtgataatttagcccataatttttcttgcttatgaattatgtttgtgctatactcaggtttcagttagcgggtggcagccaagtaggaatctctgctgaaatctctcagtccaatgggaagaaagaccactactgaaaaagtaaaaaatggtctgttaacccatgcatgagttgtttttctaagtatgtatttctcaggcacatgctaacatgtgtgttgttgtctttttaaaaactgtatgctttttgaaaccaaatttgtgttataaatactaaaaccttagctgtagtggattatatttttgaagtgaattgcatttcctatttatagacagttttactttttgagaatttatgtgtgaaacactaaaacttgtgtaatgagattagtcagttcccaagttttcctgatttcaataggcattattatgtactctcgatgtcacacatgcttggctcttataaagcagcacaatgaccagggcttttacatttaaattttgttaaatagtctctttttcaaacttgtgtaataatgtctctttttgatactgttctgaatcaattaagctaagtaagtgaggaccagcagtaaaacccagcatctgccaagaatggaccctcaatgtgtaagctgtctttccacaatcagtaattgggcagttgctcacaggacactggagacagtgtgggaaaccagtggttgtgtaggtggaaagagtagattcccaacagtaagcttatttagagtttagcttctgtagttagtgttgctaagagcaaaaatgacccacagtttatgtagtataaagaaaataacccaaaggaagaagtacagtgtaatagtatagttggttgggtggagcatgttttatgttcagtccaactataagtggcatcttttgtatcaagtgtgggtgtattttctacagctcttaatgtttcagacattgaaacttgctcaaagttaaaaatgttagtgttgaatagctgagtggaaattatatgtcattggaaaaaaaaaccctgtttttgtaaaaaatatacattatcctgagtttcatggttggaaaccagaaaaatagaaggaatagtcctatcctcacagagcttacagtcctgttcaagatatgatactattatcaaagttgcttgaaatacttacaaagcaatatatacatgattgtagattaataaaatacacataaaatgcatacacatggaaatgacatggaataaaggagtggtcagggagaaggctatagggagggaataactggaaccaagttttgaaatggaggaggtacagaaattattggtagagtctgtttgaccagtagatcttgaagtcttacttggttgttcttaaacccgttgctgtcaccaccacaccccttgccacagtacttggggattcccagcagctgtcttcagtcagcaacttgcactctcagcattcttcatatcactccccttgctctggtctctaagatcataaaacttcaaggaaattaaaagtggcctttgtgttgagaatcctctggggaggctggataagagatcttgtatctgcttatagtttcttgtattaggaagagaacaggatttgcagaagagtcctctagagtatcagatgaattgggagaagagtctcaagataggggagactaactaggcttaaggttatgagggcagtaggaaaactggcattggaaagtgggaaagccaccccaggggcagagtttgtgaatataggaatgttgcaaaattgagaattggaagaagttatcagcatatgcaagggttcatactctagggccaggttttgtgtaggagtggaaagattgtagctcacctgtttttggcttccatcattgcctcttcttttcttggctctgtgcctagctattcttgtgctcagaaaaagtttgttaaacagctctgttgaaatggctatgaaatttgatcacaggcataagaactctcctcccctttccctcttcacctattcccagctgtatctaatttgggagaaaggatgagaggacacatcggtttatagaatttgtatcaaatataaagatagctggaatagcttttggatgaggacctgtgattaggtgactacatgtgcatggagaggcactgcaggaaaaaaaaaaacaaattctggttgcttggcagaagtaaaagaagagaggctttgaacatgattcagagttcataagcctggggaaccatgaggatggtggtgccattaaaaaacatggggggaatatgggaagaaacaaatggttgggcaggtgaaatcagatttcttactatgtgtagttccaagtgttggcagttatcaaatgttatttctttttgaattaccagaaccacagagcagcaacagagctattgtgatgttttagttggccccttgggatcactcccccactttgtgactttgaatggctcagataagtagatatcagtgatagttttcagctttgtactgctagtaaaaatacctggcagaattttgggtttctttaatgtaggtttttacattttcttagtcttcaggcttatcaatttgtaaagcaggcagtgatccttttatttccttatgtgtatatcatagtacagccttgagcaagataaagcctcgtggcaggccatctcaggaattcataatttcagaactaaagggaaatttttgaaggactagaagtgcctttggtacaagattctaggttgtgtgtcctaaagcttagaaagtaaaatagattgaatcaagctggatctgttttgtggctttgctcaatgatgaaggatggatgttatgaactgatgggatcagccatattgctttaggatctttgcgatcttcagtggatgggcaaaagtgaaaagttctgcttgagtaaagacctactaatactagtttttttcaataaagtctgtgatagtcttgatgattcttgccttttccctatctgtttcattttacagataatccacattgttacccaaagccacatgcagtgccgggagagcacagttgactgttttatgcagtatcctgccagaagatgctgaccagttctctaataatagaaagtagtgagattgaattaagagcctatatagttcaccttgccattcgatatactttcactgtgatctgtaagcatattacatacaactttagtaacatattttctagtgagatcttggattgctgcaaggtggtaacagattctctgctttgcttcaggtgttagtggatctttgagtaattcctatggaatggagtctctgaaaaattggttttgatgctgttagcctaggggtcccacagcactgtatctgcctcaaataaatgcttatgtactagttacattagtgtgtttcttttctgtgatatcattatcgcttatagtagcctagcaaccacacggttaggtttaggtggtttggggtgcaaataaattatatagctggtaaaacttgggcctcagtacataattcattgtagcaaggcaaacactttgtgctgattttgaacaaaagtgaagtgtttagattgacgggtgcttttttacctccttttttatatggtaagtagaagatggcattggtgatttattcaataaagaagaatctcatgaagtctttgccttttttccatgttagagtaggtattctcaacacaattcatgtgttctcaacacaattcatgagtttccctatgataatgacaaaaacaaattaaaaaaaaaacttgccacagcttcttttgcattaaaacaaaacaagccaataaaaaacttgccactagcttggctgggtacttgattttgtggaatagctctttgatgttaggagtaggtacagagaaagtcagtagttaaaattttttttgagttcacagatccatctacccccacactcttctacttgtccattcaaaaaaccctcacaagaacaaaaaggaataatattctatttttccgacactaatgaggtgggtgatatgtggtttgtggtatactttactccacaaactcctccaactattgtcctgtctggcaatttttgtgggaattgactctcccacattgtaggcattggctgtgtggagaaagagagtcacatgtggttcgaggcagggacagagggcatataggaatcagggagggagtaaaatgaattgtattcaagttaagtgaagcatggattcagggcagaaaagggagattgagcacctgatctggagcaggagtgctttttatgttttacatcataaaaacttagatgtccctcctttagaatcaatggccacagcattcttgttaaaaaataattattctggctaggtgccatggctcacgcctgtaatcccaacactttgagaggctgaggcaggaggattgcttgaacccaggagttctagaccagcctagacaacatagtgagacccccatctctacaaattatatatttgaaaaacttagctgagcatgatggcatgcgcctgtagtcccagctacttgggaggctgaggcaggaggattgcttgaacccaggaggtcgagggtgcagtgagccgtgatcacaccactgcactccagcttgggcgacagagtcagaccatgtctcaaaaaaaaaaaaaaaaaaaaaaagaaaaaaaaaagtttctagcagaagcaaatgcatatcatgaagtttcataatatgaggacctgctatgggtccttttaatacttataagagaccatattgaaaaccatttgtacagtgtcttcagaatgaggcctctacataactctggaagctatgggacaagtagctttacccaaaacagcataaatgtagccactctcctgtaattatccttacttatttttcttgacttgtctatgcacatagctataaatcctcaggtattcagacatatcttctttttaggcctgtatatttatattaatagcctctacttagatgtgtgaagtttgtttcatgtagtttgctcacagttattatctataacaaagattatggaacaggcactattaaatgatagacccaggtataatttctgactggctgcagaatacagtcatacaaaggtacatacctatctcttttgtactttatcttagaaggacctactatggtcaatttaatttgtaaattacattctcacagataactggagtgtcagccattttttgtttatcagtttatcttttatcatatacatgtaggctgatggtagtttactttttttttttttttttggagacagaatcttgctccatcacccaggctagagtgcaatggtatgatttcggctcactgcaacctccgcctcccgggttcaagtgatttctcccgcctcagcctcccaagtagctggaattacaggcacctgccatcatgcccagctaatttttgtatttttgtatttttgtagagacggggtttcaccatgtttgccaggctggtcttgaacacctgacctcaggtgatctgcccgcctctgcctactgaagtgctgggcttacaagtgtgagccaccgtgcccagccacttattttttatggtggtaaaaaagatgagatttttaccctgttagtaaatgtttaagtgtatagtaatgttaactataagcactctgcttagcttaatttttaaaggcacataatagtggctttacctaaagcaactcatttcttctaggaattttgggaatccttcacaaattaaccttataaacttactagaggggccaggcgcggtggctcacgcctgtgatcccagcactttgggaagccaaggcgggcggatcacctgaggtagggagtttgagactggcctgaccaatatggagaaaccccgtctctactaaaaatacaaaattagctgggtgtggtggtgcatgcctgtaatcccagctactccggaggctgaggtaggagaatcgcttgaacccaggagtcaaaggttgctgtgagctgagatcacgccattgcactccagcctaggcaacaagactgaaactccgtctcaaaaataaaaaataaaaaaaataaaagtaccagaggtgcatagctcctttttacaagagagcctaatttaggcttcgaggtatttatttttccaaacctattgaaaattatgaataaactaaaggcattaaaatcaaaagtaactttttaatttttttattttttattttattttatttttcgagacggagtcttgctctgttggccaggctggagtgcagtggcgtgatcttggctcactgcaagctctgcctccgggttcacaccattctcctgcctcagcctcccgagtagctagctgggaccacaggtgcccgccaccaagcccggctaatttcttttttgtttgtttgtttttagtagagacggggtttcaccgtgttagccaggatggtctcgatctcctgacctcgtgatccgcctgcctcggcctcccaaagtgctgggattacaggcgtgagccaccgcgcctcgcccaattttttacttttttgagatggagtcttgctctgtcacccaggctggagtgcagtggtgtgatcttggctcactgaaagctccacctcacgggttcaagtgattctcctgtctcaacctcccgagttgctgtgattacaggtgtgtgccaccatgcccagctgattttttttttttaattttcagtagagatggggtttttgaggaaatgtgttttctagagagatggaaaattggaagataaattgcataatgggatattataagtaaggccgttaagtctatatgtgtatatatagactatataaccatttcagttaagcacttcttgaaattgcttcttacagtatacacacttgtttctaatgaaaaacttacatctaagtgtggcagtggcatctgtgaaataatagatatgatcaagttgcaggtcttgaaagttgtttgtttgccctgttttctgtacaaccagtatgaggctctctatcattagctggggtgtagacgttttaaaaataatatcactgaattgtaatgcatcaatttgggttttggagcagtatctaacttgttccatttagaggtggctttgcagttctaaacaagaaagtagaatttttactatgattatccctttgcttacaggcttttaaaatgaatatttgttgaagtctcaagtcttttttgccagtattatcttaagactgtgtttgacatcaatacctatctcttattctatgcaagtactgctcttaatattatgactggttctaatatttcatttcaacaagtaatacagctgttctgggtagaacactatgctagacccctttatgagtatgggtgagaaatctataaaataggcataaaccatgcttcatgtccttaaaaagcttgcagtcatactgaaaagacaagattcatgaaacaaataatgaagtcacatatgattcaacagctaaatgagtgatggagacagtgatgtctgtaggactcattgtttgggtagactaatgtgggctaagattgtacaggagagctttacagacaaaataggatttaggctaggtagaactttcatagatggaaaaagcagtctaggcagagaaacatcttagacataggtcaggatgagcattatacagtggtcagtgggtaccaatcaaaagtaggttgaagtgggggagaacctagcaagaaaggggacctgtaaggagactagctataacaagcattgggaaatgaaggtctaacagttgacaattttaaaattttaatggcctgtgagtggcctctttcttggtaaaatttctctttgtctgtttaattatgtctcaccagcacctttaatgttgtgaatgtcatgaaaccttgacaagagactaggaaataacacaagcagtagtctgctctgtagacaaagtgctttcattcttcagtacgcattcagcttaagtcagttagattaacattggttatgtcacactgcctgagtgccttctatgttcagtgatcttttttcttctgaacttcagtgtctcaaagatgaagttagaaaaattgtctagctacaaagttatgtagtttaaaaatactataattatgatacaattaaatggtttggtcactttctttcctcctaaagttaatgaagaaattttacttggatattgcaaatttaactgagataatttaggtactagggattataataattttaggaagattgtgaatgatgacagtcttctttatgaaattaatttaaacatagattaggctaatgggaatgttccttatggttcttcacatgagctttaagaatgctacaactcttaagaaacaatctatataagcaaacttgtaaaggttttatactgttatttagaaacaaaattctaaaatagtttcctgaattacaatgagcagcatatttttagtttatgttgaggaatgattatgctttgaagaaaaaaacaagcaaaattctcagtattttagctgaagatgtgtctttaagacataagtttagaacttaaacttctttttcagtgatcactgtaaaattctattttagtaactcccttctgttattcccagaatatgttttagaatataagaaaattattttccaaatatgggactaatctctggcagattgtaaagcatgagcattgtatcagtatactcaggaaacagaaaacaacactagcgtaatgctcactaacagtgttctctatgtagtcagtttatgtctataagtaaatgaactctccctcctatcatagtcgaatctgcaatttgaattatatactattagagtgaggagaaaaaataccagatgttaaaatagtggtagtacaatatttttgaataaaagttgttgaagaggtagatgttgaccctatgtaataatcatagactcctgccacataatgggataggaggccaaatggaatccagtggtttttagtacagaccacacagaggttcctgatcacttttaatatccgtaaatctttcttaacaaaggtggatgccctcatcaggggagtgggaggcaattttgtttatacagggttgaactatttagatttcaacttcatttttcacagacttcaaacaacgtgcatctcaaataggcaggcacctccatagtgtagagcacaactgggggaaaaagtcagggcttttctgttttgattgtggcaagagaacaagcaaacccattttaaagtgaaaaaaatggatgtaggtctaacgggccctgattcctgtctccattgggctacacatagaacctttgcttctgtttatttccgctcagtctagagaaattcagataagttcttacagaagaggagtgctttagtctttaaggtttctttcactttcattaagttatattcaccatctcataataacccttcattaactcttaactaatttaaatagtttgtaccagtccagcacggcctcaggtccattcattttctcagaattgttatatttaaacactttttacttcaatctctcccaccccaaatttgaagtataaatttaggaaaatcagtcaatctctctctctcttttttttttgttttttgatttgtttatttatttttttggagaccaagtcttgctctgtcgcctagactggagtgcaatggcgtgatctcggctcactgcaacctctgccttctgggttcaagcaattctcctgcctcagcctcccaagtagctggggattacaggtgactgctaccacgcctggctaatttttgtatttttagtagagatggggtttcaccatgttggacaggctggtcttgaactcttgacctcaggtgatccacccacttcggcctcccaaagtgctgggattacagtcgtgagtcaccgcgcctggcctaggaaaattctcctcttaccccttcttcaatatagtttctctctggagctttgccattttcaagagcagtaatcttgaatatttgaaagcttggtagcaccttcattatagaatttttactgtgtaaattctagcaatgtttatcactagcaaagttctttactggtcctgctggttttccatttttgggagatggtagaatgatgggaatggggaggtgtaaatttatgacttccaagtttttttttcaatcattggatttgagtgtctacagcagtgtataaacactgtctaactgggtgaattttggaatcagggcagtacaaatctaaaaagtttctagaattttttccagggtgattttaaagcagagaataaatgagatgtcccattgtaccccttcctcctgtgctttacctgaaagaaggtatctttttctcttatgcatataactgaaaccataagatcattgtggatttatttgatattattgttagttagagactgacctggttatatgtagctgtattcaagatggtaggactatgtgcttatggttttcagtgaagtatggcacaggcttatcttttactctatgattccattcccatggaagattggaatgcttgaaaaattatttggcactatttctttcttctttttctactgttttgttttaaattgtaggtttcaaaatgtttaaataaaattttttttctaatatgtttaaagtcatggatttttgatttagtgtctaagaatggattttagggggttggcagacataatgaaatttcatgcaaagatttgtataagtgcatttttctgattagaagtttcatatctttcatcaggtttccatagaagcttcctatagtgccagcttcttaagaatattcaaggagtttcaactaacattggctgggaaagtacaagtcggcttcacaacacccctgaaatctatccttggactctagactaggacctcctaatggactctagattaagaccccctgcaagctcctcaaatatcttatccccagatatttgtcactatttgacctgtctggcagctccttgggaaggccccattcaccaggcttgtctttatttgatctgactcagtggaaaagccctatcctcaggacatttgttgaaaacaagcagcagcaattgtttagcactgtatctgcctgaggtggctgacttttagaccctgtgcaagcaggaagtgaaggctatggcagaattgtaaactctcagagcattgaaggcatacccaacacagggccctttggcaaaggatgaaagatctcttggttcaaaacattttagaaaatatgtcgatcattagctgaccactaggtagctgaacagatacttcaatggacacacatgacagggaatataggctttacagaactagtccaggaaagtcactaaacaaacagtaacaacaaaccttaggggagaagtgatctgatttccaaactttccactttatattgtttaaaatgtctagttttcaaccaaaaaaattaaaatacaaccaacagtaaactatggcacttaattcagggacgtaagcaatcaataagaactgtcactgaggaagcctagatgtgcttactagatgaaactttaaatcagttgttgtaaacctcttcaaagaactgaaggaaatcatggctaaataaaagaaagtatgagaatattagacatattaggaaagaaagaagcatttatctaaacatattggaaactatagctatgtggtggtgtgctagaggataaatgaagccacagggtaaacatgatgtctcttcttcgaatgtcagttttccagaattaaaactgagagcataaatttgatattgaaacaaatataggtatgttatagtgtagaatgtaaaattcacaaaaataaagcattatgaaatttgccatttgtgatgggccacttacggcaactctcaattcctactcatttcacacctttaatttattttgcctatgatgtacgtcagttgaaaagtttgagaagtctaatctaatgatctgttgcttcagtgattgtggaccaatgacaatcctatgttagaaacaaatgggcatgtcacagataagagataactgtaatagaaaaccgatttccacagtatactcactaattgaccattgtgttattttcacacttggaatatcctacctttgatgaacaaaaggaatacctttacacctgaattgacatttctccaaaaaagacatgcagatagctaataggtacaggaaaaggtgctcaacatcactaatcatcagggaaatgcaagtcaaaaccacaataagctatcacctcacacctgttaaggatggctgttatcaaaaagacaagagaacacaggtgttggcaaggatatggacaaaagggaacctttgtacactgttggttggaatgtaaattggcatagccattatggaaaacagtatagaggttcctcagaaaattggaaatagaactactatatgatcaatccagcaatctcacttctgggtatatatccaaaggaagaaaatagtatattgaagagatatctgtgcccccatgttcattgcagcattattcacagtagccaagataacaacctaagtgtccattgacagaaagtggataaagaaatatacacaatggaatattaatcagccataaaagaagggaatcctgccatttgcaaaacatgagtgaacctggtaaacattatgctaagtgaaataagccaaacatagaaagacaaatactgtatgatctcactttttatgtgaagtctaaaaaagttaaactcatagaaacagttgtatggtggttgccaaggtctgaggggtgagggaaattgggagatactgagcaaggatacaaactttcaattataagatgaacaagttcttaggatcttatatagagcatgggtggtgatgggtgtgataatttgattgtgataatacacagtgtgtatacatataacaaattatgttgtacaccttgatctataaaatctttacttttcaattaaatatttttaaaagggaatacctttcttgttttgaaaatgcttgatgtgtcttttctcacattaatgtaatttagaggaagagaaacagatttgaagaagcctgagccaagggattataagttatccttgaaagcacaaatactatttatcatgcagtttccctcatgaaatgttttacggcagacctgtttatctcatagatctgagtcaaagctgaatttaacacgttaaactttaacttatccagaattagtatcttttgtctaagaaccaacactaaaatatttccttatgttaatcaccaacactagaaatttgcttaattttttttcaaaaacaaaattttgtatcactttttgagttactgcatagtttataatgcaaagaaaacatccaagcttagtgaaatgataggataattactaacttagcaattcattcacacatattaactttaaagtacacaagattcaaattcttcaaattaatttctcaattaaatgaaatacaatgaaatgtaaataaaataattaaatgaaaattaattaaggaccttaatggttgcttataaattcctgaaattgcggattgtatgtccatggagtctgaagatccatagtaattaaaacgtattgtgttatatatgtttatagtatgctcatgctgttttttaaaatatgtatagaacattgaactccacataattgatagcatcataaatatcattgagactactgttgttgattttcatgagtgatttcctctatattatctgctctgtttaagttgattttccaagaagaggtcttaatgactttgtaatcactcttacagtgttttattcattgtgattgactatcagtatttttcctcttgcagcctgactcctaaacccagagtctcatatacaattgtaggtgctacgttaagagagacagggcagttatatggaaagtattatgtgttctttcttttcgcttactcttctctctctctcccccaccaaccacacacaaaggtataaggttgttttcatatcatacctgcaactaaactcattcaggatccccagacctctctaaatgggaaaccacttgtaataggtttaacatctcctaatctagtattagggtaatgctactattgttgtaaaagtttctcataacttgtaatttgctttggcatcattataatgaataatcaattgtatgatataaaatagtaagtgttctaatgaaatgcattttaaaaatgtttgattccttataagacttagatcttataatgaccattttcttatttgatcaaagaaatacactgagaccttagtaagcttccttctgtttagttatgacttcaggtattgaactagatgctgtgcagtcagtcctaccatgactaggatcatttatagtctctcatgttcttttatttaaaattaaagtatgtgaatctttaaaaaaataaagcagtattttaaaaatacttgaaatacagccaaacgtttataacaataaatgcttttttattccatctgttattaaaaatacatttgtttccctgtagtcaccaaaggtaaagtagaatataaatcaaagctgatcatattttctctcttctaattctatagatgtttatgaactttacctagcagcttatgtgtacatatcaccagggattccacatattttgttgggcaattttaagagctgatgccttttaggaagacaccaataccagaatgattttcaaactcaagtaaagagggtatttctggaatattggagtaaggacttcagaaaatctactcccctataaaagcaatgtctggcaacaattgttaaaaacaagtttttcagaattctaaaaattaaccaaaagcttccaacaacctgaggagtgtttattcaataaaatagctgattttcggttaaaaaaaaaagttagatttgttgtattttaacttgccctaatccaatcaacctttccccagatccaaaatatctctggaaactagtaaccttgcatccatggtagctgtgaaaacctgtagctactggagagttgcaagctcctcacatcttatccccagataattgtcactattgacctgtgtggtagctccttgggaaggccccattcacgaggcttgtctttatttgatctgactcagtggaaaagccctatcctcgggacatttgttgaaaacaagcagcagcaattgtttaatactgtatctgcctgaggtggctgacttttagaccctgtgcaagcaggaagtgaaggctaaggcagaattgtaaactctcagagcattgaaggcatacccaacacagggctttttggcaaaggatgaaagatctcttggttcaaaacattttagaaaatatgtcggtcattagctgaccactaggtagctgaacagatacttcagtggacacacatgacagggaatataggctttacagaactagtccgggaaagtcactaaacaaacaataacaataaactttaggggagaagagatctgatttccaaactttctactttatattgtttaaaatgtctagttttcaactaaaaaaaattaaaaccaacagtaaactatggcacttaattcagggaggtaagcagtcaataaaaactgtcactgaggaagcctagatgtgcttactagatgaaactttaaatctgttattgtaaacctgttcaaaaaatggaacgaaactgtggctaaagaattaaaggaaagtaagagaatgatgtctcaccaaatagcaaatatcaacagagaaagagagacgttataaagaaccaaatagaaaatctggagttggaaattacaatagatgaaattaaaaaaattattaaaagggttcatcaacggatttgagctgacagaagaatcaagaaacttgaagataggttaactgagattatcatatgtggaaaaaaagaaaaaaggtagcaaagcctaagagacctgtgggacaccatgtagtataccaatgcacacataatggagtccctgaaggggataaaagaacatttgaaggaataactgctgaaaacttcccgaatttgatgaaaatacttagtataacatccaagaagctccatgtactcaaagtaggataaactcaaaaggattcacacccagatacaatgatagtcaaattgttgagagacaaaaagaatcttaaaagcagcaagagtgaagagactcacaagggatcctcaataagcttaacagctaatttctcagcagaaactgggtcggaagggcagtgggatgacatattcaaaatgttagaaaataagactgtcaaccaatatttctatatctagcaaaactatattttataaaggcaagataattaggacattcccagataaacagaaacagataatttgttgctgaagacctgttttggaagaaatatgaaaggtaatccttcagggtgaaatgaaaggaaactattaagttgaatgtacagaaataaagagtactggtaaaggtaactacataggtaaacataaaagacagtataaaggtatgtttgtttataactcttctatctgatttgaaagacagcagctgcataaaaaactaattataaaactgttgatgggcgtatttcatataaagatgtaatttgaatgacagtaatagcacatagggggagggagggaatagagctataggggaacagagtttttgtatattattgacactggttggtattaatctgaactagattgttttaggttaagatgttaattgtaattcttaaggcagccattaagaaagtgactcaaactagaataaagaattggtagttagctttagaaatttcagtgctttggcatgcaggttagattctgaaagtgaggttatagattatttccaaagttaagctttagttgacaatttcatatgttgtaaacatgtacaagtatattgcctaagtagaatatttggtacctttttagataaacttcaataaaatacagagaaaatttataatcattaattctcagaacattttcatgagttaagaattgattattgctccagtttttaatatgagaaaactataccaaagagaatttaaactttgcctgcctcttccaagtatgatttctaatatggtgggagttgcagtactcaagcatggtttagtaacatatccctctactctcctcaaagtgcttaatgatatttttgatattaaaattaatatctttaataatttcatcacacttctcaagaaactgaagacagtttaaaagtctctttgagcttccctgcctttctttcagaacaatttcaagagaccttcagtctaatgtgaagtatctatcactaaatgtgtacatctattgcccagaaagttgtttttagctcaggtggagtctctaaatagaccgtggaaaattgttttctgaaataattatggcacatcaataaaactgctgagtcttttttttttaaaatagaggtttatggattttagaatttagttatctgttaatgagcaaattaaatgcatccttgaaaaaattaattcaagtattttttttttaagtttatacctaaggcagtgtgggagattcaaaggtagaagagatgtggttcctgccctcatcaagacttcctattaggttggtgcaaaagtaattgcgtgttttgccattaaggacaagtgtaaagagttgtaatatgaaaatggattacctttcataattaagtataacgtatctcacctaatgacttacaaaataacaaagttcagtatcataaataccattataacttacattatagtactgatttgttcctctgggaagaaaatcagcttttcttttgacttggtttgagttctgtttatttgagaaagaactaatgtggcaaaccaaatgaataaaagctctcaacaggttttaacgcatcttgaaccatctgctattagcaccaagccagtactgcaatgtttctggagctggctgtcaggatcagggatgtcctgcagacaaaacaagattcctagtgtaggaagctattgaactggtactctcagaagtgactaccatcttcttccctctccccactagggatcttagtctccttatttagcatttgtttaccacatttcaaaagagtagcttagcagttttttagaaatgtttcagcttagatgtaagctgtacatgattgaggaagggagaaaggacacagtgctagtatatagatagtaaaagtgctgatctcatctccgtgaagtcagagcaacatcctcggggatgaggcttggtctagttatgatagcatactttctttccataatatgcttggaaaaatatttaccctcaaaacaaatccactgtactattttaagcaaattagtttggttttaaatcatattttaaaagttatttaatttttaaattacgaaattttaattaaatgaactgtcttcagagatgattgacctagacacaagtaactatgggaatactgtgatagataaggcttccctgcccttaagaagtttatactctagtaagagagctaagttatacaactcagataactgtaatacaaataagtaagtgccttatataggtataaacaaagcctgtagtagttagaggatgatgactgtagatgggagattttagctaagatgtctgatgagtcattgggttcacagacatacagatattaagattaaaaggaaatttataaatcatatttccatgaaaaatcctgccttcactagaataagcctacatatttttcagcattggtatttagggatagacagctgttgacctgaggatgacttaggctaatgagttaatttttaaaacatcattacaggggcagaatcaatggtaaagtatccttctgtgtctgggtttataagagtaggtcaaaaggaatggccaggataacaggtcagataaattcaagaaaatcaggccccctaatgtgtcagacattgtgacaggtacaggtaatactatggtcctttgctcttcagtagctcatagcctagcaggagaactcagaatgctagatcattggaagaacttatctctaaatcttatcccatgatccctggaccttctaaactagatgaaggaaaatataccagatggtggggatactttaaaatcttctgacaggaaaactgtgctcctggaatgaactttttaaaaaggtagtatactcacatggtgtgaaatccaaacacacgaggacaatgagatatagatttccctcctactcctttcgcccagctacctaggtgctcttcacaaaggcaaaaactgctgccaccaatttcttgtgtatctttacagagacagtctatgcatatactactagaatttatgtacatatgcatgtctttttgttttgcacaaagagtagcatactatacatacttttctacatctttttttgcagttaacaatcaattttgtagatactttttaaaagactgttttaagagcagttttggctcacagtgaaagtgagagaaaggtacagagatataccgtatactccttgctcgcacatatatatagcctcccccattaacaacaccccacacctgagtggtacatttgttataactgatgtccctacattaacacatcattatcacccaaacttcatagtttaaggttcacttttggtattgtacattctaagggtttggacaaatgtataattatatgtacccaccagtatagtatcatagaattttcactgtcctaaaaatcctctgtgctctacctattcatttctccctccctaacacttacctttttactgtctccacaattttgcctttttcagagtgtcacatcgttggaatcatacagtgtgtagactttttagattgacttcttttacttggcaatatgcatttaagtttcttctccatcttttcatggcttgatatttcatttctttttagtgctgagtaatattccattgtctagatgtactatagtttgtttattcattcacctactgaaggatatgttggttgtttccaggttttagcaatcacaagtaaagttgttataaacaccatttttctgtgggttttgtgtggacataaggtttcagctcctttgggtaaatacgaaggagcatgattgctggagtgtatggtaaaagtatgtttagttttgtaagaaactctcaaactgtcttccaaagtggttgtaccattttgcattcccaccagcaataaacaagagctgctattgctgcacatccttggagatacttctgtatcagcacacctgcaacttcctggttcttttctttttaaaaactatttattttgaaataattacaggctcacaagaagttacaaaaatagtgcagcaaaatcctgtgtacccatcactcagcttcccactggtgatatataattatagtgtattatcaatactaaaaaattgattgtcacaatgtaatcaactagacagcagtacctgtttctttttaatgcctacaagacattccattctatgggtgttttatttaaccagtcctttattgctgggcattaaaattgtagtattgctggtatagggaaagataggagaaaataaagtctgtgtattcggggccactgctggcatttacattgcttttatgtgaattagaaaagagttccctctctgggtggatgtagtcccataggcacatggcttgggaaactagaatataacctagataaatgtttttagcacctctgcatatatatctctttgaacttaagtgggaatacatatgcaggataatggactgtcatttaaattctgcaatataacatcagtgttccaatgtgaaacttcgaagctgtccctttcagatttagcatgtgctcccatcctcctacctgtaaccgtcatcacctctcccaagtaccttaggtcttgtatattttgtgttattattattattaagacagagtctcactctgtcgcccaggctggagtgcaatggcacgatctctgctcactgcgacctctgccttccagtttcaagtgattctcctgcctcagcctcctgagtagctaggactacaggtgcgcaccaccacgccggctaattttttaaaatacttttactagagatggggtttcaccatgttggccaggctggtcttgaactcctgaccccaagtgatctgcccacctcagcctccccatgtgttgggattaccagcatgagccaccacgcccggcttgtattttctattatttatgtacatgtctaccttacattggatagtaagcttctgtcttcttctttatattttctgtcttcatctttatattttctttcccttctcttccccactccactattatcaatctacatagaacatcattttttataaacgtgctgagtgaatttttgtttaaaatttttcttaaggtgaggaagttaagagcagtgaatttttaaatctgcctctcaatacttcaagaggtgtcatgaaatttttaaaccaaaattattttcaattaaagtacccacacactccacactcataggagagaaaaagagtgtgttattaagtcaaccaactcataatggggtgctacagtttcaaaaacattaataagcattgtagtattgaagaaaacggggtagtagaacttgtgacattgcaagcagggaagtattttatatgtattgtacactcatgttcaataagtagaattctgagaagttgcataagtcttgtgccctaaaaattcctgatttcatcagatcttaacttctgtatgccattgatttaggagggaaattgtccatttttaacactggccttttcattactgttaagcaccagaaatattttataaaattttaataatattaaatatttcattaaaacttacatcattggactcatatgtggtacatatcaggactgctacaaacacacaagaatggaaatgtactttttaaaaaaaatgtgttttctattacatagacgttatactagcaatgtaactaaaattagcagagtaatcatacagcctaatcagcacataaatcttatacaagtgacaagttaaaatagataatagtagttgcaaaagtagcttgagatcaatatcgggtggttatgtttgcttgtatatactatttaaggaggtaagcattggggaagttgggctgaataaaacgggggaggcaagggtgagaaatgctctttagatctaatgttcacagtggatcatcaagtgagaattgctttgctagcaacacataaatattttttcattataggggatgactgttactgggaaagcattggagtaaatatttgttttccttgattatttgctgtaaataattttttgtaaccaaatcaacaaagtactgtgagttcactataggatattacattgtaatatagaagttcctgttttcctgatgttaactataatgggtttctacctgtattccaggaaatagagcaagttgggttgattccagtatgttttatttttcagcttcagtgctaaaatcagattgtgtgcaactctgaatcatggttctataaattcttggctatactaagtaaattacagtatatcttccagtacaattataagaatgctgtaacatgcaggatgttttcttgagcgttttcatgattaaagattaatttcttcctgaatttggcttgatagatttgtattgaagagcactgtcaactaccatttgagtgccatctgtgtatttgacagtatactgtggactaataggaatttaacgaataaaatagtgcatttttggtttggcaggatttcttacagagataaataggctgggcacatttgccttgtaggtatgtgtgtttatgtacatatatgtttcatatcaacgttggcctgtaaacttccagtataaatagaataatttaccaacttgttcttccactgggacataatgtaagtaaactatcttttctagctaactaagcaggtggctatttctatgactagtatgtttcaaattttaatatacattgatgtaattaaattttgtgtgtgtctatgagtataatcatctctcattatctctgcttctgtgggggatcctaatgtaaatagtgtaaaatagtaatatccttgcctccttttcttgactttttccctcattctgtgaactggctttatgtgccttctgtaccttgctccagtgccttaagtggtcagaagtgggtgactaaaagaggtagaaattgccacatgtggataatggggagttgggtatttatgataatacatgggaatgagggagacatattaataattttgaagttaatggacttatttgttgagggaaggattcatggacagttttgaattatgtttcaaatatggatttagaattttatttagggggagaggactagacattctagtcagtgaggatcataaacagagctgagtaagtagttttgtttagagagctgttgggaaataagtatatttgagaattcttgaatcaagagagagaagagtggagtggcttaaaattaaagcatctgtttattcattttgacttgattttctaacctatgtgggaatgctgtagaagttatatggttgaataagtgagggattagacacatttaaatcagagtcattattgaagaaaatatcagaatagtttagtccagggtggactctagtctacataagaattagctgtgagattagatttgtgaggaaagaataagtacaaacaatagtacaggaaagaaatggtatagtttggcatttaactgaataatgtgggtggtgatctagaggctcatgttaggctagcattgtttatccaaaaagaagggctgtaccatttctaatgaatttggagagctctgtcagccatacattgatgaagccctgcagtaatgtctatgattttgcttgcagttatactttgaagatctccagtattctgtcagtttctgagagcgcacaatctgactcttgaaattctggtagagcttgtgaggagaaatcaagagaaattgctgagaacctattatgtggtgtgcatccttctggatgttttacatacctgctttgcttccctgtttctctaccaaatcaaatcttctgtaaagatatatgagggtgggtaggtgaatgggcatcgtgctgagggagaactctccactcttcaaagtttttgccacctaaaaaatgccaaaagccatggtgctacttcagctctttgtgagatttctagcctgccttcttcctttactctttttgatttatgctatctgatggctccaagtcacagatactgagctaaagtcctttctgcagtcatggtcctctttcttgcttccctgaactaccaaactggctaagtgtctctcctttgtgtcccataattcctcattcatagctattttcttatcatttactgctgtatattaaattctattcatgtatttctctccttcacttattagagtataagctcctgaagagtgaggatggtctttttcctttcttatcccaagtgcatggcaaaaatagtagagaaggtgcttaataatggtttcttgtactaagttgaccccatcaactgcagtttggcttctcatcttgtttatccttgtgggatggccttgtacactgtctaaaccattctctctattgcgaaagaatggggcaaggaaacttcttagctttctttttagtctcttttattccagccactctatgctttgaatacctagttttgacttgcttcccggtaacagactaagtctttcaggggtatggtattcacaactctaccctgtactagacagtgtcatgtagactagtaacttggaagattaaggtataagaaattgttgaggtcgggtattctgagcatcagtatacacactgatttcttccccagaatggtgatactcaggaaaccagggagcccctggttacataaggaagtgtgaactgctgcagatagaaattggaacaagacatcctcattactgtaactctgaggtctaatagatgtcctccctacaactacaacaaggtggtctgtgttttccaggattggagaagaaaccaaaacaatttgacagtttttgtcaactaggtctggaggcacttccctgaagtaaaaagatcatctgattcaacgactcctcctcagtctcagtcacattaggtgactacaccagttagtgtgtctctgcattttggttctatttgagaaaaatgtttctgtatggaaaggtaacacaatagtaagagatagtttatccttcatcccctcttttgacaccctactcttgaattctgatagctggagttctttttcttaaacccactaccttcacaagaaggcaaactgtttaaactcacctatctctcacatgatagtagctggtctcataattgacagaatcattggcagtaagaccattatctcttttaaccagtggttgaaaattctacttagttgtctattggagctcaagaaactattaacttatgaacgtaatttagtattgaagcaccttgtgggcctcctggctatcaaagataatcagataccccaaaaggacccttgaactggtatcaaaattcagtagtaactaatgtaggatactagggattagcctcatgattttttttaactaaggtctccagatggccaatgaatttatgaaaccggaaggagctggtggaatgggaggacagagaagatgacgttaagtaactttgcatacatgctctaatttttttttttttttttgagacagggtctcactctgccacccaggctggagggcagtggcacaatcacagctcactgcagcctcaacctcccaggctcaggtgatcctcccacctgagcctcccaagtacctaggactacaggcgcacaacaccatgcctggctaatttttgtaaattttttgtagagacgggtttttgctatgttgctcagggtggtctcaaactcatgggctcaagtgatccggctgcctgggcctcccaaagtgttaggattacaggagtgagccattacgcccggcccatgctctaattttttaatggtcatgtgcccattgagcattcatcattcaggtgagtcataactagagactgtataagggtattgtgaaactctatgcagttctttagtcatgctggggttgggttcttttaaaaacagaccatttccagatagtaaccatatattctggatttccaggacagccctgatttcattttgtcccattgtgtccataagtatacttatgttcgttagacgttatgccagtttttggcttggaaaatatggacatcaggcatataaggacttccttcttgccaactgaaaacagttcatcacagcatagccttgctctttcaaccctgccatcctaactgccagcagtctctgattttgctcccatcttgtatctcccacacttactttaaccctttgtgagttaatttatctcttttctttggtgtctccttgcctctggagtccagcaaattgtgtatccttatactctcacaaagctacttgtatcctagcattttggtaataggatgtactcttttgaaaaatgggacactttcttttttcccagggtgctcttgggggttgaaaactgttctgtgagatactcatcttcagaggcctccgaaaacacattcagtaagaagcagtactactactactaccatgtattgagtgtttactatgtatgagaagttgggtaaaatatttttaaaatctcatttaatcctaaccacctgtgagattggtagtgttcccttttcacagataaggaaatatacttagagagtttgagtttttcaagattctgcatttggaaatccttgctacattccaataagatattagttgtgtacataccaggcttagaattgtggatgaactaccaatgactccaaccccattatagaagaaatttcacctttttacttggtaccaccaggaaataagtatttctatactcttggtagatgaatttttatacattcttcttgtataccactggtcctcaaacttgagaatgcatgaaaaccacctgaagggcttgttactcccagtttctgattcagtaagtgtgagaattaagtgtgtaaaattaaacttgagacttaatttctagtaagttcccagtgatgccaacgttgctggtccagggaccacactttgagtcattgttacatactaattattttttattcagcaaatcattattcagtacttatggtgttctaggcaccgttctaagcactgtggatataataatgaaaaggttaggcagggtctttgttttcataaagcttatagtctagtgggacagatgactaattttattgggataagtgaacagggattgccatagagaacaacagagttgctatcctctactttagatgggttgagaaccctgtctaaaggatggtagttgggtctctttgaggaggtgatagtctaagacctaaaggatatgaagagctcatatggctttcacgcttgaattttcttagctccaacttctgttgccatcactggtgatgactaccttgggagaactccatgaatttcagactgacccctgtgtaattcattctttggtactttgtgtggccttggccaagcttgactgaatagttcctttaagattgtttaccccctctccaccccaaccttcccccaccatccagtatagatacagaagtcagaggaattttaagagtgggctaattttgtcttctggcttcacctagatcacattctttggtatatgatggcttgagaagaatatatgctaaggaattgtgcctgtgaacctgccattcatggccactgcccttaccttataactatcaatgataccttaagattctgtcttaattgccagtttgcaaatttgcctcaaaaggggagacagtgtgggaatctccacaactccttagctaccctgatgttaggtttctctagggaagatttctagattcatgcagtctaagaaggtgttgtcagagcaacacaaaaccaaacttcccttccagttgtggtgactaaagctggaaaaattctagatattcgaaggagactttctacggaactatcatgatttcttgccttcagagttttagttctgaagtttgatgccttactctttttttcccccctctggttctgtcctaccatgacttaaccagcttttcctttgaatccctcctgcctctggagccatttccttgctgtctagtttcattttattttttatttttatttttatttttgagacagagtctcactctgtcacccaggctggagtgcagtggcaagatctcagctcaccgcaaccgccgcctcctgggttcatgcgattgattctcctgcctcagcctcctgagtagctgggattacaggcctgtgccaccacgcccagctaatttttgtatttttagtagagatggggtttcaccatgttggtcaggctggtctcaaactcctgacttcaagtgatccaccctcctcggcctcccaaagtattgggattacaggtgtgagccactgcacccagcctcattttattttaattaaatattttctctggtattctgttcctttggaggaaaagagacccttaccaggtgctacggtatgaatatttgtgacctcccaccagatttatatgttgaattctaatctccaagatgatgctattaggaggtggggttatttgggaggtgattagatcacaaaggtggggccctcatgaatgggattggtgcccttttataaaagaggcccaagggagctcattcatccttcccactgtgtgagacacagcaagatgttgttgtttatgaggaatgggcccgcatcagacactgagtctgctggctccttaatcttggacttcctggcctccagaactatgagaaataaatttgttatttgtgagctacccattttatggtattgtaaatagtccaaacagactaagacaacagatatttctctaggtattttcaggcagagcatttcacttggcctaggtgtatgtatttttggatagcagacttccttagtcttctctcaataaattcctgaaccagagaaggggaatatgagtaattgacttttctggttgccaaagatgtctttagtttacatgaaaaatgttttgaacagttatccagtgcatgcttaaatgggctgtctcttataacacatctgcacatacaggccagatttaactaccttacccagattgaaaatttccttttccttgtggactcagaagtttcttcctgctagtctggttcctgatggtatacagtggataaacattttttttttgttaacccatatatcaaccataagaatgactgaaataaaaaaggaaatggtgtgccagctcactcatagctggagatgataaaccttttctgttgctttagagccagatatccttggttggtagtgtcatgtctgctccatattaacagtgtcttgggcaagtaaaccaatcttgccgagaagaagaaaatgcatatgaaagcacctaatagtacttaattcataatatcataatatgctctcactgaatgttaatgcttgctttcctccttgatgttcttaaagccctgaaacacttgattgagcaaggcataatctctcatggtgtaccccatcagcaccataatcttacattttccagatatggaatccgtttaagaactacctgcttaattatatttattataaaaatgataatctcagagtatccctacttcttcaaggtatccaagaaaggaaattaacaattttgggcgtctacctagtagaggtctcattgacccaaaatgatgatagcattaataattatacctttattgacagaattataatacttagcagtttccaggaactttttaatggatagcgtccttggattcctgtagcagttcatcaagtaggcagtccccatcttgcatatctgtgtccaaggatgaagggaataggatgattccttcatggtcttttgactgatggatagtggagctgagctttgggcctaagtcttctgacacccctcctttccctgccctattccagcacttttatccaactatgccacatttttttttttaatctgaggttctggtacatgatttctcaaattactagaattctaagacaaaatgtttcttaggtttcacctcattttatctctgagatgtttatgttcctaagagatagttcttacgtgtgggagttttaaactctacctagaggtcagagaaagctgtttatgcctttgatgtaaattttgtgcaccatacttagactatactacacattccaaaacagtatttcttgggcctagacttgtaacaaaactctctagtgtgatgtattctcattcactcttttatattaacctattttattctttcagcaaacatatttagcccttactatgtgtcaggggataggaataggaccgtgcaaaaagacaacctctgttttcttggagcttacgctgtagtggataggaaataagcaaatgggtagtgatgtgtactgtgaagaaaaataaagcacttttaaattttcgcccaagccatgagattactaaattgtggtatctatcagtgaccccttgtagaccttatagaccttctaaaaagttagttattgagaagatggcccaggaaaggaacattgtctctgacatccctgtgcagtttctaccttcttttccattatttgaactaagatcttgctttcttgtatggttgtgagcaaccctgatcgagtggagtgtaagggcatggccaaacaaagacagattggagaggaagcctgttaggaataaagcaccttcggagaaacagtctcacaacaaatactgttagagttgtatttgtcatttatcctttaaatgtaatgtgttgccttatagagtgtcacatcaagaacactgaaaagagatgtatttcaaaatatgtatttagctatacaatggttaacaaaacacagcataaaaagcagcctccttaaatgcttctagttttatggtgtactactgtagaatgagttctttttgactgaagtgttttaaaagttttgaagaaccagggagtctgcaagttggaaagaagccattcttaccatgaggcaaatatacttgagtttaatttttaaactataactgctgtttgaccttaaattaagacagtctgttttcattgtggtgttttactggtttaacaatgagaacatttaaagcagctgccaccaattaaaatgattcataagtgctggttgtaaataaatattcttgaaattttaactcagtgaagtcagtctttttagtggcactttctttctggaaagcaatttggtaaaatgcatcaagagctataaaaatgttcatacactttgatctggtaattcagtttcttaaatatccttagaaaataaaactgagatcttgataaactttaataaataaagatgtccctcacagtttatcaaggaaatagttgcctaaattatggtctacctatatgatgtaccatggggccattaaaatatttttgaagagtattaaccatataggaaaatgtttatgcaattcagttgaaaaacaaaactatacaaaaccatacagtatgatcctaaaaatgtgaaaatatttccatagaaagagtgtcaggaaacattatacattttcattttctttgggtagtgagattgtgtatgatatttattttctcctttctacttttctgtattttctagaattttttatagtgaacatgtattgaatttatagtgaataaaaatgttatataagtattttaatcctttcaataagggtgccttttatgaatatccagtccatttatattattatgacctaattttttccacattttcagctttagagcatttttttctagtgaatttttgtttttaacgttttaatgtttatttttatggcacataatgtcaacaattttacctctgcttggtctaatttctaggtattcttctttaaagccaataattcagttccttgttggaatattatttttcaggtggtttacatcaaacagcacacacattcgtagtatgtggtaaagagagttgactctggagccacaatgcctgggtccaaatcttggccctaccacttagcagctatgtgaccactgacaagttaatggctctctctaattctcagtttccctttctttaaaataggggataataatagtatctacctcatagggttgttataaggatttcaaagagttattacatataagtacttaattttaaaaggcctggtatatagtaaatattcaataaaaattggctatttttagtagtgtgtgtgcatatatgcacacatatacacatacatattttcatgataatttgaaaaatgcccttttatatctgccttttcttttatacaattttaattttaaaatgaagggttttatcttattttcagataaaattagtttttcttatatgctttgaaattatttcaaaaagttttcagcaatagaaacctggtttgctttcaatcatattttttccatatttgtaactgatcattcacgtgggctggatggactgaagatcagcttcattctaggtataaaataacttttatttacatacacaaagttgatatattcataaccagttaccctcatctattatttacctcatttattaaagtactgctttaatagagaaggagggggatgggtaggtgtcagtatacttcaaaaataataaaactacatttgtttctttttaaactttataatccagccttctctaatcaaactgatactcccagaaagatttggagggaaagagagctaccttttattgaatcacgtgttgggctagactcttacatgtattatataattctgtagtccaatatgaaaactattttaagtaaagcaatcatttggcaattttactgtcctggattacagaatcacaaatgtgttcctatagaaaacaatttggatttaactgattaactgtttattaaataactaattgcaatagtttttccattattctgtttcatttttttgaaacaggtgtttctgtggtatgtttgcattggcagaataaagaaagaatctgggcaagtttgaaagcatgaaactggtcactgaaagtttcttttcaagaatgaagcatttttttaatcaatctaataatattcaacagagacacatatagataatccagatatcttcatctttagctggatatttggttagtatttaatgccaagaaggagtgtgagaagtagtccctgtgggaaattgtgttttctttggtctttggttctacagctatgtagaaattctggattgagtatgaagtttatttatacatgtacatgtacatttatctgtgggatttatctaagaagcagtggtttggggtattgttcttgctggtgaaagaagtggactgggtggaactctagagaaaaatttgcttttagggataaacatgttcaatagctcaggtggcaaattttgctttcttgtattgatgtgataagctgagtgggtcactgccatttccagaccatatacaccacctttggctgatttgtcttctgtcatgtacctagcagttcagctggaggctttttaaaccaaagtatttaaatatacataggaagttgttgtactggtgcttattggtggctactgtgttctttcttatcttcctagggagtgtggtccttttgtttagcttctgtttcatttgtttacaaagttataggctttgaagtaggcagttatatataggattgcctaaagagacgtggaaagtgagaagtctgctttataagtaagcaattatccttatttcactgccttattacctcagtttctcagccagtgtctttcatgaatttggcttttctcataggcttgacattggcttacttactgctatcctaatttttttgtggaaacttacttagttttgtgtctcccagattagatactagctcagtttactttctgaacatttaactatcaaagctttgcctgatgtgttagtgaggaatttttaaaaaataatttttgataatttaatgatacacatcacattattttttctatttgttccatcataaaagaaattttcatatctggtttccttaatgtagggttcctggccttaggtgactgtccttctatagatatggcattgttattacaagatttgtactggtaagactatgataaatttagtgttttctaggacagtagtgaggtaaatagctgtgctgtaagattgtttaaatcatcatagctgaaaaaataggcctttaaaaatagcgataacagaatacacatacattagacataatgcatgactattaatgacttcctcaagatcttttaggagttatgaataaggtcattcagattgcactttttttaaactcatggagagagtataagaggagtgagctatttttggcatgggcttaaagaaggaaatatcagtgtgactggtaactgacatgtttgtcaagttcagtttctacctgagtgctttaatttcttttaaatttcattactttggactttagagttctcagtatgaaattttttaagagtgacttgtctaacctttgggttctgagtagtgtgttgcccctgaaattggttgagtcattttatattcttctaagagttcaccacctgtcaaagctgaagagatctgtcccttttgccctttatttcctgaaccatttttctttttttattattattatactttaagttctagggtacatgtgcacaacgtgcaggtttgttacatatgtatacatgtgccatgttggtgtgctgcacccattaacttgtcatttacattaggtatatctcctaatgctatccctcccccagccccccaccccatgacaggccccatgacatgtgtgatgttccccaccctgtgtccaagtattctcattgttcagtgcccacctgtgagtgagaacatgcggtgtttggttttctgtccttgcgatagttgctcagaatgatgttcctgaaccatttttctgctggcactaatcttatttgtgataggttttcccacatttaatatgtaaaacctaccacagagtttgaaccttaatgtgacttagggttaaagggctttgagacttctacttttgtccatgaaggagtaactggtgcaagacttgctcctttccaccttacatctcccataaacaactagaaaccagacaaaatacatgaaacaactgtttttagacatcgggcaacagacagcacaggactgtggtcactgagagaaagggaacaaacgaagtgagctctaccatcaccctgactttttgtcagcaggcagtttctagaccacagcattgtgagggggaacccaagcagaactgcaatcttgctgaattggtgagacagagataggaactcagggaggcctaggtggcagaaatttatggagcagagtactggaggaggaaagctactcagagacatagctccagaaatctgcatagatgttccccttatctctggctgaatatgaatctgtgcatgtatcaagggcaacactgtgaggctgggcagaaaacaactgctcaggagctataagctgaaaacttaccagagctcatacagacctgagagatatatgagttcctacagcaagagttgtgagcccttgttgaacacccagggcattccagagagactccagaagggtcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaagcagattaacctacttgcaactggagtcccataaggaaaggagagagagaaataggcagaaaaaaaattgaagaaataatggctagaaattttccaaatatgatgaaaatgtaaatccataaatctaagaagctcaatgtatccaaaacagaaaaaccacactaaagcaattataattttttaattatttatttatttatttatttttgagacggagtttcactcttgttgcccaggctggaatgcaatggcaccatgtcagctcaccacaacctccgcaccctgggttcaagcgattctcctgcctcagcctcctgagtagctgagattacaggcatgcgtcaccacacccagctaattttatatttttagtagagatggggtttctccatgttggtcaggctggtctcgaactcccggcctcaggtgattcatccacctcagcctcccaaagtgctaggattacaggcgtgagccaccatgcctggcctaaagcaattataattaaattgttgaaaactagtggtagagcattttgaaagccactaggaaaaaaaggacacattacagaggaacaaagagaagaaccatatacttctcatcagaaacaatggaagcttccagaagacaatggaatgacgtctttaaagtgctgaaaaaaaaatactgccaatctcaaatttgataccaatgaaaacaccctttaaaaatgaagaccaaaagaaatgaaggtgaaatatatatttttttcagacaaaaatgaaaagaattatcactggcaaaccttaactacaagaaatttaaaggcagctgtccaggctgaaggaagatgataacagatggaaacttggatctctacaaagtaatgaagagtgccagataaatgtggcaagtgtagggtaaatataaaagacattttccccctcattaaaaaatttctttaaaagttaagttattatttaaaggaaaattaataatctattataggattatatggtatatagaagttaaaggtataacagtagcctcaaaggatgggaggagttaaatggacgtatacgttaaggtctttacattgcttttgtagtgatataatattagctgaaagtaggttgcaataagataaagatgcatcgatacaacctagaaaaattactaaaaagggcataactaataagctaataatggtgataaaattaaatactaaagtatactcatttaatcttacagtaaaagagaagtggagaacaaatgggaaatatagaaaacaaatattggatgtaaagatggtagacttaaacccaactctgtcagcagttatattaaatgtaaatagtctaaccactccagttaaaaggctgcataaaaaatgcaagacctaaccatatactgtgtataagaaacccactttaaggataaagacacaggtatgttaaaagcaaaaagacagaaaaagatatacaaacattcataagaatgctagagttattatgccaataagagatgaattggacttcaggacaggcagtgttacgaggaatgagggccatgtcataatgataaagtggttaactcaagaagacaaaatactaaatgtgtatgtacctaacagatcctcaaaatacatgaaagaaaaaaaatacacataaaaggataagtagacaaaactacaattagagttggatatttcaacattattaattcagtaattgatagaacaagtagacaaaaatcagtgaggagatagaaaacatgatcaatactaccaaccaactggacctaactgacacttataaaacattggacctaacattaccagaatacattttcttttcaaattcacaaaagatctctataaggagacctacaaaacactgatgaaaaatcatagatgacattaacaaatggaaaaacatcccatgctaatggactagaagaatcaatattgttaaaatgaccatgctgcccaaagcaatctacagattccacacaatcactatcaaactaccaatgtcatttttcatggaattagaaaaaacaatcctaaatttcacatggaacaaaaaaagaccatgaatagccaaagcaatcctaaagcaaaaagaccaagttgagagtcatcacaccgcctgacttcaaattacactataaggctatagtaactgaaactaaaacagcatgatactggtacaaaaatagacaaacagatcagtggaacacaatagtgaactggatataaaaccacatacctacaaccaactgatcttcaacaaagtagagaagagtaaacactggggaaaggagtccctattcaataaatggtgctaggaaaattggctagctatgtgcagaagaatgaaactggacccctatctcccaccatatacaaaacttaagatggattaaagacttacatgtaagacctgaaactataataatcctagaggaaaacttaggaaaaactcttctggacatttttctaggtaaagaatttatgatgaaaactctaaaagcaaatgcaacaaaaacagacaaatgaaacttaaaagcttctgcacagcaaaagaaataatcaacagagtaaacagagaacctacagaacaggagaaaacatttgcaaattatgcttctgacaaaggactaacatccagtatctacaaggaagtcaaacaacaagaggggaaaaaccccattaaaagctgggcaaaggacatgaacagaaatttctcaaaagaagacatacaagcagccagcaagcacgtgaaaaaacattcaacatcgcgaatcttcatgcaaattaaaaccacactggggtaccatctcacaccagtcagaatggctactattaaaaagtcaaaaaacaacagatgttggtgtggatgtggagaaaagggaacgcttatacattgttggagggtatgtaaattagttcaacttttatggaaaacaggatggccatttctctaagaactaaaaatagaactactgtttgacccaccaatcccactactgggtatctaccaaaaggaaaagaaatcattacattaaaaagacacctgtactcatgtgttcatcgcagcactattcacaatagcaaagtcatggaaccaatgtaagtgtccatcaacaattgactaaataaagaatatgtggtgtgtcatgcaccatgaaatacaatgcagccattaaaaaaagaatggaattgtgtcctttgcaacaacatggatagagctggaggtcattgtcctaagtaaattaagaaacagccaaataccatatattctcacttgtaaatgggagctaaacagtgagtacacatggacataaagatggaaagaataatagacactggagactccaaaagtgggaagggtgagaggggagtgagagttgaaaaattacctatccagttcaatgttcactatttggttaatgggtacactagaaaccaagtccccaccagtacacagtatacccatgtaacaacaagcacatgtaaaccctaaacctaaaagaaaataaagacaaataaaaaacgcttaactgttttcattgttttgtttgaagtgttacgaattccctgaccatcctgcatacacagtcaaatggaaataccaaaacaaagttccatacaagtttttaatggcataaaaaataggagttgactgtatcaattaatattcattctaaaatttctggacctagttcttctgttattcttagttttgcttaacatttagcttaggaatcggaagacttcaatagaagctcttttttgcctgatttgttttatattaaaataattaattattattatttttttgagatggagtcttgctctgctgcccaggctggagtgcagtggcccgatcttggctcactgcaagctctgccttctgggttcacgccattctcctgcctcagcctcccgagtagctgggactacaggcgcccaccactacgccctgctaatttttttgtatttttagtagagacggggtttcaccatgttagccaggatggtctcgatctcctgacctcgtgatcagcccgctttggcctcccaaagtacaagcgtgagccactgcgcccagcctaaaataactaattttttttaatagtaaagactaagtctcaaaccttaaagccctttgaacaaatgggttcagaataggacttccaaatagaaattacttcatttttgaaatctatagcaaaatgtcatttaaaattaagttgtattttcaggtaatagagatttctggtgtgttcctattatcaggaaaaaaaacccacagctatttttccctttaaatgttctcagtgtaaactaagaaaatatgtgcaaaaatactatttttttccaattaaggtagtctttctcatctaatttagggctctaaaaaactataagattgtctcagcatatcaaatctgggactaattttttttttcgtttgctgaaaattgttgatttgctcttgttaaaggaagaaatggttctttcagttcaaaaattggcagaatcaagctaatcccttaaagtatgcttgtgctttggctgattgtatgtctgtggtgattacccttgattaacaacagcaaaaaattctaccttcccaatcatctgttagactttagtctgccttccttcctctggcatttgccagttaaattggaattatataaatgggagaaagggaatataatgctgctatgatagaatttcttggaacaccaggcaaagaaaagtattgaaagattggtcctgatccccgctttcagatatttgtggtctcctatactaatttatgctgtctatctaagcagtatgatcttattttcctgagccctgtggggtacaggctatttattatacaaagcttggagggaggagtgtggtataaggatacagtggtgacttagtgcattttctttatctacagcaaatggttggatgagaaatgcatctgaatcttaacttctcgaccctgcctcagattagccccctcccatttctctccattcctctcaatttgaatttcatattatctggaggagtctcattcattctataatatgaactacttaatcaaataatcagatcaatacctagctgaggagttgttaaccaatggtataataaatggaaattttgatttggaggaaatttgtatttaacagaggacctgggtttgatgaagtccagctagacaacaggaaaaaatgaagtgagaaggctgagggagatcagaaagagtgctgggaagccatcaagcataaaatggtaggccttgctgtgggcttctaatggtgataatgtagaaacttataaattggggctagtgtttctaggctgatgcagcatttctagtttgtcctggtgtcttctcagctaatctttctctctcccctactgggagaaacaggaggaagaggagattgtgcttatgctcacctgtgtggtgctatgtagtattcataggattttcctattctttggtcttttagaagacacctaggtttgccactcacatttttttttcctgtagtgggggaaaaaaaaaccatattataccagtagtaagaaaatttggaggacttgccaggttctaacactaaccagtttggtgattctgcactgtctgcctggatctctttttgtttttcacctgtaaaatgaaaagcaaatggattatctcttaaagactctttcagtgaatgagcttagatacattgttatatacactttaaactatgtactaaagtttgggttagggatttgtaatggactgaattgtaaccccccaacctctacattcctatgtccaagccctaacccctaatgtgactgtgtttgataaggcctacaagaaattaattaaggtttaatgaagtcatgaagatgggggcctgatccaataggattattgtccttataaaagactgttggagagctcgtgctctccctctccctgcacacactcagaggaaaagctatgtgagtacaaagtggccgtatagcagccttaaagcctagtaaaggaagagagcctttaccaggaactgaactctgccagtaccttaatcttgggctttctagcctccataacagtgaggaaataaatttctgttgtttatgccacctagtgtatagtattttattatggcatccctattacatgatttaaccatgttaggtatgtttttatgaattgaatctgtagtttatatgatttagaaatgaaatgtaaagcttctttttgttgaaataggaagtgaaaggtttttacctggtggtggaaagaagacatcatcatttctgtacttctgcaagctgctagatcctggggaattatggtatttttagctggatgttatgaggaatatagttgtatttttgagctaaattgctgagaaacctgaatacagttgagaaacaatcattatttgatggcagaagaacagaacaagttacagggcttctctcttttcctgtatccccccccccaatataaataaccttgttgagtaccctattctattaattattataattattattgcattggtagagattgatgtaattttgttaatgttgcctcctataaatctcattctaaagaatcttattctaaagaagagcaaattgccagagtctaagacttttttgtaacctctgttttgccttgatatggcaggagagatagggtttaaggtaaaatattattaagtaaatacaccttttttgttgtatcacttaattgtattctgctcctgcaaacatatttctgatttgttctggctcacatcagtagatggggagtgccctgttcagatttacattgcttttcgtacttttgctgattgtatgcaactacatttccctagagctactgttgacctgacagtattggctgctagttggcagggaggattcatcatctagattagatggttacttcctgttcctgtctacagacatgaaaaaatggagtgtttacttttctccaaaggtttctcagaagtaggaaaattactttaaaagctttgtctggttgccttcagataaacattttcattaatatttcatctcattttgagccctcttctagtttgtagtattttttcaatgtatgtaggtggcctcaaaccatatggcaaaagcatttcccaaaacatccaatctttgtcttactatgaactggttttctgtattttttttctcattgagcagctcctctcaacaggctcaaaaccctttttctactttgatctgcctctgattatgctgatgtattaggtcctttttggaactcatacatgttttaatagcacatttaaaaatgaaattgcctattccttccctctgtgttgcgtgaagaaaaaaatttgttcctatttttagataatatgtgttgaatgttctcgtagtcattgccctgtacaacgtggttatcacacacaagatacaatgtcttgtgctcagggatgtttattacgtttctgtctactttaaaatgcttaacttcccggattcttatccccattaaatgttgcttttaggtattttagttgtttttaattccatacacgtgtactttataaaatatgttggatgagcatttgtaatgagaaattagagtcccagatttttaatgaatagttttgttctgtctactaaaagtctgacttcttccatcttcaggcatctgtcctaaacacagtgaggttgtggagtagcactccctcccatctttgacacagatacttccccgcaatcccaactcccaaagtggatgttgcctggggtaggtaaggatcagggagagtatagatcattctgtatctgctctacgtcttatgaaggctcttgagaacacatagtccacagtgcttcaaattcaaagaaatgttaaatctgaaagagcccatagcaagttatcaagactatcagactacttcctgtttcctgaatgtgctgtgcacttttacatgtccatgcccttgcttgttttggagcatctttgctcctcaggctgccttgtaaaatgcagcttgtcctccagcaacttaagctctgaattaatcattctgtcatcagtgatagcatggcattataagaaactattaatatataatttctcccatcttatgtttgagtgccctacaacgtatttcatagtatagtgtttagtttgtgttatttttctactttaagttttaaatgtttacttgagcagatagggttatattatagtaagaatggtgtatgtatatatttcctgggataaataagaaagtagaaggtaaaacacttaaatgactttcatttctagcgtttttgataggaaatgaattcactcacacttttaggtttctcatggaagtcattgaggaagagaatatacaacgtagttctgccttattcagaaaccatcatggtattttaaaaacatgctattatctatattacattgtgattcacttcattctgaagctgccaaaagacctgtcttacatagagatactttggatagccattgttacgggagaggattgatacatttctgtatttctgatttcttaatttatgatcatatgctacttctgtgatcaaaaaataaagtttttttttttttaaaaaaaaagaagagacaggatggcgatcattaaaaagtcaggaaacaacagctcctggagaggatgtggagaaataggaacgcttttacattgttgggagtgtaaattagttcaaccattgtggaagacagtgtggcgattccttaaggatctagaactagaaataccatttgacccagcaatcccattactgggtatatgccgaaaagattataaatcattctactataaagagacatgcacacatatgtttattgcagcactattcacaatagcaaagacttcagaccaacccaaatgtccatcaatgatagactggataaagaaaatatggcacatatacaccatggaatactatgcagccataaaaaggatgagttcatgtcctttgcagggacatggatgaagctggaaaccatcattcttagcaaactaacacaagaacagaaaatcaaacaccacatgttctcactcataaatgggagttgaacaatgagaacatgtggacacagggaggggaacatcacacaccagggcctgtcggggagttgggggctaggggagagatagcattaggataaatacctaatgtaggtgatggattgatgggtgcagcaaaccaccatggcccctgtatacctaatgtaacaaaactgtgcgttctgcacatgtaccccagaacttaaagtataatttaaaaaaaaaaaaagagacaggctgggcacggtgtctcacgtctgtgatcccagcactttgggaggctcaggcgggcagatcacgaggtcaggagtttgagaccagcctgaccaacatggtgaaaccccgtctctactaaaaatacaaaaattagccaggcatggtggtgcatacctgtaatcccagctacttaggaggctgaggcaggagaattgcttgaacccaggtgacggaggtcgcagtgagctgagatcgcaccactgcactcagcctggcaacagagcaagactccatctcaaaacaaaataaaacaaaaaaatggttgctgatattgactatgccagattagaaactgaaaaatgaagaggtgaatttcatccttaaagataaggtttaaattttaagatactggtatttatatgagtaatgaaagaattggtgagaaagtaatcccatctaattcttgtcttcctgatcagtggttagtcaagaacaattggagaaaaattcccaaatggagcattagaatcttggctcaagttataacaggtttattgcatatgatatagaaagcaaaaaaaaaaaaaaactggcttttaccttttgtttgttattttaatacctttagtgtaggtcatccttcacttgaatgctaatgttgacagtaacttgaccttacacttaagtcatctttttgaatgccactggacatttggctcttggaagatggtaactcttagtacttctccctggtttgtatatattacttatttgggaacctatctgccattgtggctgtcagagctcagcataatttaaatgtttaaggagggtgattgaagtacttgaatgagatatcttttcatctatctgctgatgactcactaaagagtattttgaagaaaggatgttctccaactcaccagtgtattagaggaaaaaaacatatggtatatccccttaaaatttaagtttttagaaagcagaaatgcattattccagtattactgtgaatacttatattaccatagaccatccccattgtaaggtacttatctttttataaaatgtcctaaaatgggtaaattatttcataaaaactggcatacaaagttgctctaattagaacgtaattgtttttagacttaaccattaattgaggctgtcagtagtttgcagcagaatccaagcatctactgtattaaacttcatctaaaaccacgttattcttgatgatattttgttataattgatactttgttctttgatgcttgagagattgtatttgcaggtaatacttttatctaaaaattaagatgaattttctggtttcagagtattattttgttaatgtctgctgttgcccttcacctctctgaaccctactgatttttctagatcaagctaaagaatgtcaagcttgatgaagttttcttctatctcaatagcttaaattatggcatttggacatggtttatagtatctatttcctttttccttgtattagttagctgtgtaatagttatgcctgcctcttatactggctcctagagagcaatgactgtgttttaggcatccttgtagcacctttcacagtacatatcccctatattttcaggaagtatttatgaaaaccattggtttttatcccggattttccaaattagacttacaaataagtcagtaatttgaggtttaaatgagtaattacacagttagccataatggttaaggctctatagttaagattgcccaggtttgagtgcctgcttcattatgtatcaactgtgagactccctcatctgtaaataggaatgttagtatcagcctcctagaattgttgatgaagactaacataattagtttgtttaaaacatttattgagatagcaaacatataggatacactcaatataatgtagtagtagtataatataacttttgctaaatgtagtcctattgggctggcctgtgagccccttgaaggcctgtcttttggtctttatatctcaggcacctaacctagcagacagtcaatactcaataaatacttgcttgaattgaattgatttatttaccctatttttatcttccattacagcccactgtttgtaacatggaagattggtcgagacaaaagattacgtggatgcataggtactttttctgccatgaatttgcattcaggactcagggagtacacacttaccaggtgaagaccaatttttgttacctctgcttttacattaaaaaaaaaaacttatgaaacttgaatctgatactttaactccttttactgaattgtcaacgttcttgtcttccttcatgtcaggtttttcctttgtctttaaccatttaccttttctctggtaaaatgttattgatatatattaccataatataaaatactgtgattaatgtattctgccatcgatgttttgaagtgttttttttttcttccagtggccagcttattttgtataacttgaaaaccaatgaccaaatgtccacgggttaccaaaatatgtgatttctatagtaacagtcattatttcttccctcttgtgttttttaaaaatagttgttgtctctttcatcttacacattttgttacacttttaaggacttttgaaattgaaaggagagcctaggaagaaagtgatgccacagcctagcagtataatcattcacattcacacttcacccagaattaattgtagcttgcttattttcttttatctaataaaaggacaaagtaattcctcattacagttgtttaaaactttgttcttaatttctgaattcacaaaaagctatctagcacacaatgtgaattttttggttcaagtttagatttcaagcaaattgtgacccaaaattatttcaaaagaagaaaattccttaaataataagctattagtaaaggaatttcctgtttttgttcacattttagggtgattatctgatacagtttctatagttgtaatatgcacagtgtctgtccaacaagaaattgctccctgctgactattggtacttggggcatgtttctcaacctccataggtaaaatagtaattacagtattttgttctatatacttaatagaggtgttaggagaatgaagtaataatcactattttacttcaggattaatgtggaacattattttactgtagaactgcataaatgcaggctcatagcaccagttaataaaatactgtaactgagtttggtattctcatatttgaaggtatgcagtagctcacagctgcagggttttctcagcttacagtgaagcccagaaaaaaaaccaatggcttgggggatcatattcattttttagcttttcacaggtataagaaactgggtgtttggatttgattaaataacatacaggctgtaagggttgaaacacatattctggaaataaattcaacttgttaaagataatataagtactagtctaggcatgttagattttttttttctgacataaaatacaatgggctcatttttgggacttcagcaaattctgccaatggctacctttttgggacaggtacatattaaattacacatttaatactaatcaatggcaatttattgtacatttcccaaaataagttgttatgaggaacactggttcctttgcgctacctgaagaaaagaattctgtgaccaaataagtttgggaaacactggttaaaaaatgtaaacaactctgctcactgtaggacttctcagaaccttttatgttaatagtgttatgtatatctaagagagagaaatagaatgtagcattttccaggcttatttgactacaggacccttttatcctcccaccccaaagtctgagtgttccaaggaaaacatttttggaaacacaagtctgttttcaaaacagaatattactttatatttgggtagtaagagttggtattatagaaaccctttgtgctttctagtgaaattgtagcagaaatcccattatcaaacattatataccttagaaatctttcgtagtggtcattgtggtagcaattgggttttgtttaaagaaaaaaataaattcttttgccaatgttggcaaggggtgaaaacatccaacttttctggacttgtccatttatatcctagggtaatgaccagaagaattacagtataattttctgacaataatgtgattctgaatgaattgttcaaatacttgaagttggaaatttgcctacatttgtataccttgttaccctcattgcaatctatagctcttcctgtttacttttcatcttttttctcatgtttctatacagcttcctcaaattgtatatatcacattaaagaggcgtgtgtgtgtgcgtgtgtatacatatgtttgtgtgtgtatacacacatgcacatacctggttttacttctcatttttgtttggcttaatttcttttgtataacaagatattaacaatcatactatttggaaaagatgaacaaaagaaaacaagtcttacaaaatacaattaatcttttttcctggattcattttagcatcaaaagttgtaaggagtcatttttaaaagttggaatataatatttttctgttcagtagtgtgcttatcatttttacgtattatgttattatgattatttttgttaatggctgccatttattaagaatttactatgtcagacattgttgaggagctttacatgcatagtccttgtaataacccttaggtactaatatctacattttcaaaatgaggaaactgagaattaggtaatttaaataatttacccactcacacatctattaagtgatagaaccaggattcaaacccagagcatgtgtctacaaaatccatcccctaaccgaggcaaaattttctgattatttatgttttgcagctttgtcatgaaaataatgaacttgaaagcaagttactataaattttataaatcatagatcagtaatccttcaaaaattctagttaggagttaagactgaaattttgcaacaggaaaatccatagatattattatggaaagtatacaactcagagttgtatagagcagacagaagaaaattgacttgaactaatattgtattaaggataaagcttattacaaaacaatactactgtaggataggaaattgtattctttggctacatggactagactttaagaatacaattttttttgaacataaaaattggtgattcttggcttctggtcatcccaccttaaaaacccataactcacaaaatgaataaatagaattaaatgaacttaggggataggggcataaaggagggagaaagcaaaacaaaaaacaaaataaaacaaaacaaaaaataagcagtgaaattaaaggcattctaggtataggcatctttttaaaaattcaaatatccggttcatctgtgattagatagactattgtttgattttcagaatgttactcaattatatctcttctttttttttattgtggggaaatatatgtaacataaaatttaccattttaaccatttttaaatgtatagtcctgtggccttaagcgcaatcatgttgttgtacagtcatcaccaccatccatctccagaacgtttttcatcttccccaactgaaactctacccattaaacatgaactccacattcttcctcctccaggccctggcaaccaccattctactttgcgttgctatgaatttgactactctaggtacctcgtatcagtggaatcatatgatatttgtcattttgtgactagcttatttcacttagcataatgtcttcaaggttcatccatgtggtagcgtgtgtcaatttaccttctttttaaggcagaatatattccattgtatgtatataccacattctgtttatcctttcatccattggtggacgtttgggtgggtggcttctaccttttggctgttgtgaataatgctgcgatgaacataggtgcacaaaatatctgtttgagtaccctttttcctcttaaaagtgaaccagtttatagaagacaatgatctagcttgtgtgtagtcccttaactctaaaacctttcttaaaaatatgaccagatattttttaaaatgaaatgcctatcctgaattaagtttttatttataaataaaattataaacttttaattttaataaaattatttaaacttttagaattaaagtacttgtcatagtcaagttgtatgttcaaatatgaccgggtattttttaaatgaaatgcctatcctgaattaagttttttaaatatatatataaacataatcttttaaatgtaaagtacttgtcaaagtcaagtcatatgttctcctaattgaaattttgattttagattgaaataaaatcttataaagaggctgaggatttcttctcaattgtgaaaatacatagtatttgtgtaggtaatgaaaagtttatgagaagtacatggaactattataaatagactattctttgtctgaccttgaaggatctgggtaaaagcaggaaagattatagaaaatacgaagcaggatggagagctcagaattattgataaaagtctatccatagaatttggtgataaagtccacaaattaccctatttatcattgctcaagacttcaaagtagaaatattctttgtccgagctgaaggagataatttccagtattgtgtttatggcttttatatattagaaagcagaggcagattcatttccccaattttagtacttagaaaacatacttttatagagaggaaaattaccactaatatagatgaatataaacatctcagtcaaaaaagattcctggccgggcgcggtggctcacgcctgtaatcccagtaatcccaggccagcggatcacgaggtcaggagatcgagaccatcctggctaacacggtgaaactccgtctctactaaaaatacaaaaaattagccgggcgtggtggcgggtgcctgtagtcccagctactcgggaggctgaggcaggagaatggcatgaacccgggaggcagagcttgcagtgagccaagattgcgccactgcactccagcctgggtgacagagcgagactccatctcttaaaaaaaaaaaaaaaagaaaaagaaagtttccttaaaattttggctaataaatttcccagcaaaatgcagatctatttctttatgtaaattcaagttggcagtaatttttctagaacacattaagtaattaatagatgtattcttattcagcaaaacaggattgtggtctgtcaccacacttaaaagactatctttttttctcctttgttgtacttagacctctcggcagtgaaataattatgcaggtgctggcagttctagaacttgattgtgaactatgccacttttgttgaactacttaattctaagaaattagcaatgaaagtttagccctttctagggaacagtatgaccacataaaaggtgatgtgctgtgttttgttttggagttttattttgttctgtgtgggttagtggggttgtgtgtcaggggagtttgaggggggattgattgcttgcatggtacaaatattcactttccattagattttttgagatactgaaaatagctaacaaacctactttattactttcaaaggtcctagctagattgggtacttatgggattcattgtaaactgaatttgcttttatattttggtgttgtaatctggcatttttctaaagcagtatgagtttaaagccattataagcagcataatattttccctgtcatagtagaccatcgtgtgatcatttttattcttgattatttgggtaaccactctaggctcattgtgaacacttagattaaacaagttcctcctccctctcatttaatattagtctttatggtagcatcacccagattgatttttcttatgaaaagaaaagctgtatgaatcacctctgactgtacattattgttatggaagctcattctggagatgttaaggccaaacaatttttggcaagtggttgtggcaagacttctggctaaagtatgcattttggggaaataaattagatgtatcacaaacaatgcaaaattaattagtttaatttacaacctacattttttgcctttttataaaagagatgatggcctgagtcctaaaacttatacctaatttgatagtttcagtttattaattacaaaatgagaaacatttgtcagattttataggcacttaatttaaggtacagtttggaacctaggttgttgtacgctctttactcaaaattatccacatgaagcatggtgaactatctgctcaaactggaatcctcattttagccatgaggttaatgcactccttcgttatcccaaggttgtgctaatgtgcagagatgtagccacaaaattcccagcagaatgtggaaactaagcagcaggaaccatttgcagaatgggtaatggctcctgaattgtagagaattgtctgaattcatatagcacctactgccacagaaattaagtgtagtgagtatatcagattctaattccttatcacatcatttagatctttagagtttccagttggaatctccctgctgctttgattaagagccacaggcaaaatgcctggggcagaaaaggccatctgtgaaaaggtagtgttgagagaagctgaaaatgggctttttcagcaccagggctcttggttcttaagtttgatagggagagagtgaactataagaaatttaccctatttttacatctatctgtaaagtttaatacctctctggtccttcgaggctgtttccccttttaatcatgtttaaacagttcatcctgcaaatcttgtcttaattttgccttaggagtttatgatatattaggagagataagaagttatcgaaataattgtagtcctaggtagaaagcagtttttctcaagaagcagaggacgtgatactggatgattactactctatatctgttataaaagctaaaatgtatttaaaggtatctataaattattttatttggttcatccctagttcactttttataaaagcaaaacagtatgtaccactttctggcttgtttttatcctacatggtccaaaaaggtcaaaattatagggatgcgtgtaaatcattattatcaaagcaaccatatacaaggtgttgggtatttatattttaagaaatttgtaatacatattttaaaggggaaaatgatcttgtcatagaagaaaaagcctttgaaatagaggactcttaagagtgtgcatgcacatgcacacatacacagggagtttaccaaacattagctagaaccaagttggattatagctctgatgcttggcaaatgaagaaaattaaaagttatagtttagatttcactttcctcttgtcttgttaaagtgaattcatattttgttttagtacagtaaactgatatctgtctcctttcctgagagtcattgtctgcgatagtcttcattttttcagatgaatgactgaaatggtaaagctaagttagaacacaaatattgtatgaaattattacattggatgtggcctaaaattatactatagacattaaaaatatatttcttttgtctgaatatttacataataaatgttgggcttacttataagtgtctaaagtatttgagtcattaggacctgaatgaacaggaggacagatttgtatcttagtgttctggaagaataagatggttatgctttgatgtaactaaaggtgattatcatgcaaatcctatgcttttaccacttttaaggggacaatgttaggaatttgagtactttaaaataattgaaagttgaggttttggtgtagcaattgaatattaaaattttagttatgatcttatgagcatgagaaatactttttaaaagtagaaggcaaaagaaatgaagcccttctctgtgatctttccccttctctcaaacttcaaactgccttaaatgtggttatccaaagtagtagtccttggaaaaaacttacttttcatcattgataacaatttgttgatctttaaatgctaaacacttattgcatcgtaagtcctttatcttgcatcataaatatatttttcttagaaacaactctagtttttcttacattctctctcaatttttaaataaagagcaaactttcaacataaaagtcctgtcctaaagaactacattatctgatctacttcttgttaacaaaagaaataaatatatctatatttatataacaaaatagacatggacaaattgtaacatttaaaaaattttctattggaatagaatatcatagatgctaggaaattctaaagatggaaaacaatatagtcatgtaccgcataatgacgttttggtcaacagtggactgcatatacaacagtggtcccataagattataatactttaattttactctatcatttctatgtttagatgcacaaatacttaacgattgtgttacagttgcctacattatgcagtatagtaacatgctgtacagctttgtagcctaggagcaataggctatatcatatagcctaggtacgttgtagactataccatctatgtttgtgtaaatacactctatgacgttcacacaacaatgaaattgtttaatgatgcatttctcagaatgaatccccaccattaagcaatacctgactgtatttaatacattcttttgagaatgaagctctaattattgttaatatcaaatatgcagtgtacttttcagtatatttaaaatctgaaagtgaagaaaatacatttggattcataaggtacagatttacacttggtgtgatgttcagaaaactcatttttgttaattttacttcagctcaaaaaattatcctgtaaatctacatatggaaactatagacttattcagattagattagcatgttattgtctccatttttaacactctgttttttttatttctacatggaaatgctaacttttgtatccttcctagtagtgaaagagaaagttagaaaaggccataaaataaattcttcagaagctttaattaaagggattgcccagaactcaacttcttgttgctatacccaactaccttcaggactactttgtatgttctacaaagctgatttaaaaggttccaactgcagtcacttcactgaggatggcaggaaagagaatctcttaagttctgcaggctgcttttaacctaaaccattcttctaagatgaccattacttgcctcctagctaagcctggagaagtattttaagcctttgaaatgagtggagctgtgttgcatatgaagaacagtaaacaactgtacactgctggttagacttgtactgctaatgagatcatgggttcaatccctatttggaccatatttttagacaatagctaccactagatcccaggcgttgattacagtggggctcagacagagcacgtgggcgaatcagtaccaaacccaagttttagcatcatttcagcatatgaaacgtgctacattaaaagtacccaaaacaatgtggtcttaaaatgtgatatacacaaaccctttgaaagtagcaagacagacatgccctttttctaaaattgacaaatcccgaagaggaagaaaagagttgggacaataaaacactggttctggaatctggaatgttgctttaagtccaggccagcagtgacaaaagttattgtaatgacctctgaacagacagacactgccattgagcaggcctctggtatagaaaacatggtacatttgggagttgtgaatatagctccaggtgtgctcctaaatcagttcacagtagattatgcttaacaacattgagatgttattggaggtgtggatgaggaagtttgttgttgcagtccttttttgcaccttattttaaagaataaatgaaacatttttctaattcccttttaaaaaattttaaatggaagggaagtttacttctgatgcttcagtgttgtaagttcaacatatagactgtcaacctaaattcatggtataacacagttcttttcttttttctttctttttttttgtatctgttcaatgaaaataaggtacaacccaggtttttacatagtctgactagaagtattccacttcaagatctgagagtagcattttctcaaactttcaccttaaaaaacaacatcactaaacaaaaactatcacacagaatggataagaagttttgtagatctttttggtgatgaactatgacatgagccttatagattgtaaaatatagttgaaactaatgtacataatgaaaatttttaaattttatttgctgttaaattctgtgaaatttcagttatttaaaataaacatgcaaaaatatgaaatgtaatgtttcagattgcaaggtaatatgtaatatgtttgtaagatactctggtctaatactaactagtagtatttggatttgtacagtcataattcattaaaatgacttcattttaacatgtaccgatgtagactaatattgtaagttctgatttaaagaatggtgacaaaatggcgcatgtaatacttttgcaagtgttggggaggtcggtatgttttgaaaagagtaatttaacttttgggtgctaggaaatgggttatctcaaagaccattgctggcaatgggcaggcctggtaatactggcacagagcattaatcatacaccttattaacggtgaggtgaataactttgaaataaagttttagggaagaaaagagactacccaaaacttagctatctcatgaacagttgatactaattataataataattgctttgaatctaaaagaaaaaagaatatttttagatgttaatttttcttcacaaactctttgaagagtgtcaatgtgacattagagaaaaggtctttggagtggcagtagaactgacaacacaggttggacttcagcaggcctgaaaatggtatggccaaaaggggagatttctttctgcctctaataaagagtagtggctaggaataggagtcatctcagatgatactggatttcagctgaagcaactcttaaatatttcagtggtaaaaggatgactatgttaaattcatgggtttgtaaatacatgttataaaatgtaattgttctttttaaaagcacatatttttttaaaagcctacattttaaagttgtcatctattgtgtattgagatgttcctgtgcctcacagatcagctcactaaggtgtggtagctattgtctaaaaatatgtaccctctcatactgttgcagcttcctcttcataggctttattattgcccagagcagcacatttaccccattagccaaaatggcacaaacaacgcccattggcatgactgaactctccttagttggtgtcaatccttatatctgagataagaagctttcctgtgtctacctttctcacctagagtaaaagccaaagtatttaaaaaacatatatttcactcagagtaaagttaatgttctgcaatgaatgccaccatgctcagcttgcccctctcacctcatctcctactcccctcttcccacctccattcattctcttggccttagctaggctggtttccttgtttccctttgaacacaccaagcatggtccccgccaggggctttgcacttgaattttctttacttgcaacagtcttctactagatagacatgtagcttggcttcctcacgcccttcaggtctctattcaaatgatgccattatcattgacacgtatgtaaaatagcaaggcctacatttgatatctggctctccctgcccgtttaccctgcttcatttttctccgtagcacttatcaccacctggcatactgtaaatttacttgtatatttgtgagtctttcttaatgcgaatgtaaattccatgagggcaaggactgctgtaatattcctcaaagcctacaacagtacgtggtacatagtaggcattcagaaaatattagttgaataaataaaagtcttgtttttatcagcatttagaaattgtggattataaagtataattctttgtcttactactttacctagatgtgaaattatttggtcttattgtggctagtttcttatagttttcattgagtgcatattgaatgtattttttgtgtgtgtgagtggtttgacattaaaattctcttttaaaactcattttatcatgaacacttttaaatactcgcaaaaatagactattataatgatgcagtcatttttataatagtgattttttttctcttttctttttgtggggaacagcgtctcactatgttacccaggctagtcatgaactcctgggctcaaacaatcctccagcctctgcttccctaagtgttgggattacaggtgtgagccaccatacctggctgctttttcattttacttatttttattttaatacttgctttttaagtacagaggcagtatgaggttgtagaaagaggtagccatatctgggttctagttgtgaatccctcaattcttagctttgtgacccaagggaagctactgaatttctgccatgtcttggttttctcatctgtaaaatgggtataattctaaactggtaagtttgttgtgaggattaggatatatatgtatatgaagtatcttatacatactaggtacgtagtaaatatttatattgtagtacatgcatagtaaatatttatatttctgcttcaggaagaaattaagtagtgagaatggccaagaaatgaaattttaaatatatttatagcaatttcagtttttctttttctcttggacacatgtaggtaggcaggaattttcataatatgagaagaaacaagcattatcagtaaataaaccagtgaccccataatcagtcaccatcacatttctgtttatgtaattctttaaaaaatacacacatacatgtaactgatcattgagcaaaacgctatcagtctatatttcctgttggttctgccccacagatatctcttgaatccaccccatcctcttcagcctcactgccactgcctttgtctgggttcttattctggctcactggtttccctgcttccctttgaagccattgtacaccaatcaccagaattatctttgttgacaaaaatctatctcactctccttaaaacagtgcctgttattccttatcaccagagaggaaaacccatttttattaagaagcatagtacttgaggacctaacctcacactccagccatgcacacaattattcaccacttcccaaatatattctttcatgtctctctggcttcacatttttttctttgcctctccccatttccacccagtcaactcctacttatccttcaagactcagcttgctcattgcttcctctgtgagatttccttgacagtccccaggaaaattggtcagtctcttttaggcctctattataacacttaacacactggattataattattaattttatgtttgtctctcccttttgaaattgcgctccacagtagtttaccaagcaacatcaaagcaaactaacaaaaaccagtctcattgctttgtagcaactttgcttgatcctgataaccattctactctctttcttttctgtttgcatatgttagcttatatctgtcacctcttcttgctgccagcatacttgagccagtaagagttaccagtgttgattgatagtgcaaagggtggcttaaggccacttggaattagactgagccagaggacagggatctttatacagaacactttagaaaacaaattgacatgaggttgatctcattataagtgactgaagatgcactatgtgaattgattcctgccatggaaccatagacctagaagagattcttttaagtcatctagtccaacccctatcagatactttaatctctcttaaaaatctcctgagtaatgggcatctagcttctatctgaacatctctgtagacttggaagtcacttccagttaagtagcccatttcatttcaaacacctctgaactctactcccataacttcagttaccacatagttttagtcgaagtgctagaagtcaaagattgcctgcaattagcactttattctttatagaaagctgcattaaccagcagtggttaaacttaaccctccgagtaatatctgaattatctgagtctttaggagtttaggagtagtaagataacacagctttacaattgagtctcatccacccacccatacaaattttaactcttcccttattgttgaaacctttgaagctactgctgccacaatatctctcacagtctaccttagacttctggagttggctgaaccctagagcccagagattccaagatagacctggtgctagatcttttagtgatcccaacaatgtcacagagttggaactagagttagaacacaggtctcctgacattgccttggactatcattacaaattccagaatagaaagtacccatattatatgtgacttgatgcttaaaaaatgaaaaagtacccataaaagtatatgaatttgttaattttagttaagaagcatacaatttcaaggaaccctgtaatgaaatgatcattttgtaatgtaaagatttattcttgagttatctgccttgtgtcaagtttaggcatacttccataaaatgaacaatacccttagaactattcaactgcaggagtaacaatatcagagttagagaatctcaaagcaaaaccttagatttcccctttcctttcctttccctttccgtttccctctcccctttcccctttcctttcctttctttccgagtctcgctctgtcaccaggctggagtgcagtggcatgatctcagctcactgcaacctctgcctcccaggttcaagcgattcttccgcctcagcctcccaagtagctgggactgcaggcatgcgccaccatgcccagctaatttttgtattttcagtggagacggggtttcacaatgttggccaggatagtctcgatctcttgacctcgtgatctgcccaccttggcctcccaaagtgctgggattacaggtgtgagccaccgcacccagccagatttcccttttctttaaacatatctctgcttgttatgtgtcccaatcatacttgtaacttctgttttgtgtgtgtgtgctggaactctcgtaggtattttatataagttacctcatctaatatttccaacaaccttatgaaggtgaaagtatttcacttatattgcagttagggaaaacaaggtcttagatggttaagtaatttgctgaatgacagctaataataacctgattctatctaattccaaagcctgtgctcccaaccactgtgcgatactgcttccttccagtaatatcactcccccttccctggtgaaagcttcttatggacatttgtttcactgactcaacaggtattccctggtgtccacttacagaaaaaaaaaaaatcactgaataacctttctcttcatttgggaactcagtttcttaactcagttttccaaaatctcccttatacccctagtccattaattccagtctcaacttctcttgggttctctttccttttagaatcttgaggcactgtctcccttaatatgacttttttcttcacagctatcctcccagttcagtttggtattctgaacttccatagtcccatcagaatttaccaccttctcagggatacatactccccaaactgatttctttctacatttgatcttagccaaaaggccaagaagtgattgatctctttctgtacaacatttgcacttaatatcagtacatttacatggaatactagtttagcccttagattctagccagacacaactctctgaaatccactgctgactagagagcctcgggggaaggattcaccataaaggaactgtgaataaaagtcctgactcagctattctcttcaactggccaaaaggtagacatttaggagttaagaagtgagacagttccttagaaattataattaaggaaacaaattccaagtttctaagtaattaagaccaaatatattgtcttagttttaatttttgcaatttgaagttccttaggagcagtttttgatagaacaaatgatcataaaacagttagataagtggcagacaaatatatccgtgactggtatcaggaaggaattgaaagtatgtagtcgtggactgtgtccatcttattgaacttagatttcttacaatagtaaggtttaaaaaaacaataaaattctccagattgtatttttttcttttcttttcttttcttttctttttttttgagacaggatctcgctctgtcacccaagatggagtacagtagtgcaatcacagctcattgcagcctcaacctcccaggctcaaggaattctctcacctcagccacccatgtggctggtactacaggtgcataccactatacccagcaaaatttttataatttttgtagagacagggtttcgccatgttgcccaggctggtctcaaactctaggctcaagtgatctgcccacctcagcctcaaaaagtgctgggatttcaggtgtgagccaccacggccagcctcagattgtgtctttttcttaccacagctgggatttgaggatctcagtatttaaaaggcaaagaagatttttagaatgtgctttctgtagtatacaagtattttatgatgcattcttttaaaattctgtggcaaacaatagtgaaaactttagaatcataggcatcattcattatcttctattttgctcctgaaccatttaaaaacttttctttgtctgaaacaagtattattggaaacctgttatcaggataggtatttttaaatttgacagtgaaaatatctttcaaacttgttttcatatactgcctgttaataataatgaaattaatgaattaatagccaggttggttgggacattgtccatgtcacacgtgtttctttctttcgtttttgtttgtttttttttttttgagacagggtttcactcctgttgcctaggctggagtgcagtggtgccctctgggcgcactgcaacctgtgcctccagggctcgagtgattctcctacctcagccacccaagtagctgggattacaggtgcaagccaccatgcctggctaatttttgtattttttgtagagacggggtttcaccatgttgtccaggctggtcttcaactcctgggttcaagtgatctgcccacctcggcctcccaacgtgttgggattacaggtgtaagccaccacacatggccaatttttgtattttttgtagagacggggtttcaccatgttgcccaaggtggtctcaatcacctaggctcaagctatccacctggcttggcctcctaaagtgctgggattacaggagtgagctatcatgcgcagtgctgggattacaggagtgagctatcatgcgcagcccatgtcacgtgtttcctaataggttttcaaagaattttgccacagtaagaagtttttatttcacatattcaagtcccacatacctgatcatggcaaaatggcaaattaatgatgtagttgaagagaaaccagcaaagagctgtagatgctagctcagaaatgagtaacatttttagtctttgggatgtcagtgatggtgcacagtgtatttaagtgtcatttttgtcataagccagagaagcaggaggaaagagtaatgggacatggtaaagcagaaattctgctaagtagctgaatgttagagttgattgctgctattctgtttcttgcctatagtgtagcccattttaagttcaagactaagaaaaccctccaaaaagtttaaaaaattcaaagcaaataaactagtaaatgctcatggctctacacttttacactgcagatttcttctatttcccaaaggactcacccagtgatgtttcctaactccccagagttactgtttcttcccttgtatgttcataacacattactggtatctctgttacagcacttgctttatcttgccttccaatgtagtttcttacatgattgtctttcctacttagattggtagtcccttgaggacctgaactatatttttcacatctttgcatcccctaagtagctatgagggattaggcatagagcaaaataaatgtttgaataggagagtcatttcccctagtatactgaggtatttgtttactagctgggtaagataattaaagaaagtgttaggagccacagcctatgcaaaggaagtgagaaatgaagattaaagcatctctgaaagtataagtcataggaaaataaaattaatttgcaaaggtgatttacttttatttttaggaatggtgagatgtatctgcattttgttttctatttatagttttaaatcaaggaaatttttactcacttgttttataactggatcagttttcatttaataaaggataggaacactcaattcttatgggatatttagatattctaatcacacctattaagttgtgctattataaaaatgaaacagttgaaatacaagtttaagatgtgctcccatggaagaatctatatgtactaattgtacaaatgagatgagaaacagaaatagcctggggaaaagaaatggggatgctatttaacatcctatatattacttctagcagacaattgcaatttacaatcactttataagaagaggtgccatgagggctgcttattaaaattgttttatgaaggacattttattcacagtagcactactgtccatatattatttttaaatccctacgagagagatggtcatttttgtgaagtttcggttgtagttcctggtcctacaaaggtttagtgagtgagtgatggcttgtcagaaatgatctttctgtgatggctgaaaactttgggaggaccaaagtttcaggtgagcaatcctaggtcatagcttcacatcctgccatttattatctagttaattatgcttgattctgcttgatacaaaaataaaatttgcattcaacaaacaaaacagtacctcacctctttttcacaaagaagaagatttgggctagagattgggagattttgtatttagcaaatttttaaaagtccttttgagatgtgtcttctaagggcttttgtttgctatcattaactgtgggaatatttgctcctgaatggatcccaccttatgctgagcccagcttcccttgtcattccccctgcaataaatactatacaataagtgtctatgtaacaaataaacagtttggaggttaaatggaatgctcaatataataaagctccattgcagtagggagaaaagtccttttgatatgcatttgataggaatgtgttaatttcaacaaaacatctggtataaaagagttgtgaatgcaggacatttgagggggttacagaaggagaagggatttactgtgcttaacaattgccagtagtcaggccacttccaagttgtgattttgtcagacttagaaattaagtgggatcacatctactcagcccttcagtgggagaagatccaaatccagctgcagcaaggagcagtgactgattcagaagtagtgagctctatccagtgtctcctagctggttttcattaatatgcttactattgccctctttatattctggctttttaaaaaaatatggcctttgtggtttattggttgaacttgtacagctgaatctactgtaaaaggtcttttttcactggcattatgtcctacagatttgagtgttcttgctgttctatataagataattcaaacttagaatagtcactatagtttcaaagcttgattgaaagatacattcagtgttttctctaaatatgtagcaattataacaacacagctgtagttaaatacataacttattataaatcctgacagtcttccttctcatttatatcaggctgacataaggtttagtcagttcaattccacatttatcgagcacttaactctgaccatggtactgtactaggtactatgcagctacaaagatcaacagtacatgatgtctgtgctcaagagctgagtgatgtcttttgagggaaattggcatgtacacaaaataactgcattagatgtagaaacaatgctactggaagtgggagaaattagctctagttggatagattgggggaaggttttactgactagctgacatgtaagccgaacctctatggacatatacgactcaatttcaacattcaaaagtggggatatggagaagatattcattatgcatccagaaaacttcctgagccaaatgtaaggagacagagaaatatatatgagaagagaaatatatacaagcagcccaagttacatccctgactattactattaccctgactcgggctgcttgtattaatatataggatggaatggaaaggatagagattagagaagcagttatgaagctaatcttaaatattccaaatgaaagatggtagaggcctgaattaggttagtaacaggagggatgtaaagaaacatataacagagacaaggtagtaattgaacaagatgagacttgtggaaagtaagctaaagggaagagttgaagatggcttcaaaggttccttcttagatgatggggcagggggaggatgataagatgaaaggtgataggcaacacaagacaagaagcacatttgacacattgtttgttaaagagtcatttttaatgtgaaagtaatttttaattaatcctagattatctttttctgaatttgaatgttgaagattttttaaaattaagaatttattgaaaattgtttgctttcaggatatggtagtgagagtgaaatagagtaatacattattatacattgtatcttattaaatattttatttaaaattaaaataaataaaatagttggaaaagacccttgatatcattattttctcttaggccatgccacaaagcaaagcttagaaaatacagctgaatcctcaaacttctttctaaccaaaaatacattttgtggataagaaatctataaagaaataaatgtttgtaaacattgggcggttgttatggaatttaaatatctgttcttattacctaagaatgtctgggtttcaaggctgaattaaaatagattccaggcatctttaaaggtaaacaacacatctgttgatttgtctagtacaatggaaactgactgaattttgattatgataaaaatcagcatcttccatctatttagcaatacttttgggtaatcttttctcctttggggaattttccagatgtttgggaatatgattccaatttacaagagttgtttttatattgtagctgagtgatgtcctaactatgaaactcttaggttggtgtaactgtatccaaagggtcctctgcaatgtgtgtaggaatgccctgtgacaccttggcttctttgacttgcccagactctcaaagctaggtggctggaaggtttcctggaggcagagtccagttctcattgtagtaatttacattaacaaaggaattaacatttccagctatcttctgggatcactcagttttgagcaacattcatataatgcagtgaaaatgaatagctagtaccacaaaacaatttagatggttcctttggtacagacgttgacttgtattttctgaaaggaagagaagctctgaaattcagtgaaaatgacagggcggttgctattgtacacattattagaaagaaccatttcaaataacaattgtaaacatgtattttaatgctaatatactgtaatagcctagcattgagtagtgaaacaatttcagacaagtgtccaaattgttttatgactacatttatttcttagtatttatttagaaaattagtagtcaatgcttagttttatcccagtatggattataacttgtataatattctatagaaaaatgttacctaactggaataactcagagctgcctccctctgccccagcagttggtttgtgccctatgtttgctgattaccttaaatatttgcccaagtcaagccataatttaaaaagcaaaattctcatttaaagagtcacaagcttagggtgtcaagttgtagatgagtttggacttgtgggccctcttgttcctcctgattaacactgatgatacagagatgacaaatatgattaacccagcatataaagagacataacatcttaaaagagaggagagatttttggtgactttcttggccaatactattttggagattttttttccatacgaaacttactggctagcatttcacttttgttggaacattgacctatgattattttattcagtattcttgcataggcctttgaaaggatacctatcaattttattgtaccaaatgttcttaagaaaacacatttggtagttctgatattttgaaggtttctatagaaacaagaaatcttacagccattttttttatattgttgctctgatttacaattctgtatatgtaaaggaggagtcttatcacctcaaaccaagcaaaatttgtagagcaccgatgatgtgcaagttttgtgtcttacagtaagggaaacctgtacaaatccaggagcttacaatataattagagtagctaggctctctttgtgacaaggtaactaagactcctaggcagtgagccatgcttgcagagggagtggttgtggagagctggaagactgccctgtgctagtgaagtgagagccagtatagatgtgtgaggagtaacaacctccaggaatgcttcctttggacaatgatgctactttgttgggtttgcattagatatttatttcataatgattatatgtttagtacttaacttacaggtttccaaagaattttagctgttgttttggctttttattatgtttgttttttttgtgtgtcggtctataacctcaggggcataagccttttttcccttccccctattttacagctagatgtacccccaaggtatctacattaggtatttctcctaatgctatccctcccctaggcccccaccccccgacaggccctggtgtgtgatgttcccctctctgtgtccatgtgttctcattgttcaactcctacatgtgagtgagaacatgcagtgtttggttttctgttcctgtgttagtttgctgacaatgatggtttccagttttgggcgggtgtatgtgtccaggaatttatccatttcttctagattttctagtttacgtgcgtagaggtgtttatagtattttctgatgttagattgtatttctgtgagataagtggtgatctcccttttataattttttattgtgtctgtttgatccttctctcttttcttctttattagtctggctagcggtctatctactttgttaatcttttcaaaaaaacagctcctgaattcactgatttttttttgaagagtttttcatgtctctatctccttcagttctgctctgatcttagttatttcttatcttctgctagcttttgaatttgtttgctcttgcttctctagttcttttaattgtgatgttggggtgtcaattttagatctttcctgctttctcctgtgggcatttagcgctataaatttccctctaaacactgctttagctgtgtcccaaagattctggtacattgtgtctttgttctcattggtttccaagaacgtatttatttatttccaccttaatttcgttatttacccagtagtcattcaggagcaggttgttcagtttccatgtagttgtatggttttgagtgagtttcttaatcctgagttctaatttgactgcagtgtggttggagagactgtttgttatgatttctgctcttttgcatttgctgaggggtgttttacttccaattatgtggtcaattttagaataagtgctatgtggtgctgagaagaatgtatattctgttgatttggggtggagagttctgtagatgtctattaggttccgttggtccagagctgagctcaagtcctgaatatctctgttaattttctgtcttgttgatccaatattgacagtgaggtgttaaagtctcccactattattgtgtgggagtctaagtctctttgtaggtctctaaggacttgctttatgaatctcggtggtcctgtattgggtgcatatatatttaggatagttagctcttcttgttgcattgatccctttaccattatgtaatgcccttatttgtcttttttttttaatctttgttggtttaaagtctgttttatcagagactaggattgcaaaccctcccccccccgtttttgtttttttttttttgctttccatttgcttggtaaatattcctccatacctttatttgagcccatgtgtgtcttagcatgttagatgtgtctcgtgaatacagcacaccaatgattcttgactctttatccaatttgccagtctgtgtcttttaattggggcatttagcccatttacatttaaggttaatattgttatgtgtgagtttgatcctgtcattatgatgcaagctggttattttgcccgttagttgttgcagtttcttcatagtgtcaatgatctttacaatttggtatgtttttgtggtggctggtaccggtttttcctttccatatttagtgcttccttcaggagctcttgtaaggcaggcctggtggtgacaaaatctctcagcatttgcttgtctataaaggattttatttctcctttgcttatgaagcttagtttggctggatatgaaattctgcattgaaaaatcttttcttttagagtgttgaatgaatattggcccccactctcttctggcttgtggggtttctgccgagagatccactgttagtctgatgggcttccctttgtgggtaacccgacctttctctctggctgcccttaacattttttccttcatttcaaccttggtggatctgatgattatgtgtcttgggattcctcttctcgaggagtatctttgtggtggtctctgtatttcctgaatttgaatgttggcctgtcttgctaggttagggaagttctcctggataatatcctgaagagtgttctgcaacttggttccattctttctgtcactttcaggtacaccaatcaaatcaaaaaatatttggtcttttcatatagtcccatatttcttggaggctttgctcattccttttcattcttttttctctaatcttgtcttcatgctttacttcattaagttgttctttaatctctgatatcctttcttctacttgatgattcggctattgatacttgtgtatgcttcacgaagttctcatgctgtgtttttcagctccatcaggtcatttatgttcttctctaaactggttattctagttagcaattcctctaactttttttcaaggttcttagcttccttgcattgggttagaacatgctcctttatcttggaggagtttgttattacccaccttctgaagcctacttctgtcaatttatcaaattcattctctgttgttttgttcccttgttggcgaggagttgtgatcctttggaggagaagaggcgttctggtttttggaattttcagcctttttgcgctgttttttcctcttctttgtggatttatctagctttggtctttgatattggtgaccttcagatggggttttggtgtggacatcttttttgttgatgttgatgcttttcctttctgtttgttagttttccttttaacagtcaggcccctctgctgcaggtctggtggagtttgctggaggtccactccagaccctgtctgcctgggtatcaccagcagaggctgcagaacagcaaagattgctgcctgttccttcccctggaagcttcatcccagaggggcacccgccagatgccagctggagctctcctgtatgaggtgtctgtcgacccctgctgggaggtgtctcccagtcaggaggcacgggggtcagggacccacttgaggaggcagtctgtcccttagcagagctcgagcactgtgctgggagatccactgctctcttcagagctggcagcaggaacattcaagtctgctgaagctgtgcccacagccacccctttccccaggtgctctgtcccagggagataggatttttatctgaaagtccctgactggggctgctgcctttctttcagagatgccctgcccagagaggaggaatctagagaggcagtctggctacagaggctttgctgagctgcggtggcctccacccagttcgaacttcctggcggctttgtttacactgtgaggggaaaaccgcctactcggcttgagctatatttctgattcagttattagtgactgtaagatttatacttagagatctttgagcatgacaaagactgtaggtgaggatctagcaacaccaacatggaagtaaaagctctcaaattcacaataattgcaggaagcccagtatactcaataaagaatgaatgaaatatttatttaaaaagtagttttgcttgttttagtgacaccgatttgcttgtgttagtgacaacaataactcagaatgggctaatggagtgttaccaagtagaagtcccccagagacctgctttttaacatactacacaaaagatttgtaattatgatgttacagtgcctgtagatggttaattccagaatcctggaaataatttattctctttaagcaagtcctgtatttcccttacaaccttaattataaagttgatttgcttagcagacccttcttttccaaacttgctaaggaaaactttcagtctaggtctgtttgaattagcacaaattttgaaatagtagagttcaaattaatgaggttttattctgttatgaagagcttgttttccatcattgataattatttccaggaaagttaagtctgcagaaagcattctctcagtttccttaatgttgtttaccaaagtttaagaagtggtttttagttacatgaggggagagtgaggacatggcagtggcaaaggaaaatgaggtgctataacctggtctctcagatttgtggagcaggctttgagcagcattctaaaccaatattattccttgtaaaaggcaaaccagaccttggaattttaaagtctaatgtgattgagagaatgtgtgctggtgcatagtaatactttaacccccatcagtcgggtaagttgtaagaacctcttaggtgacaaataccctgacagccccacgaggcatgcaccatttccacccattttccctagagtcagcccttctcccactagataattctcattgcttcagagggttgattttcaacaagtcctccatccccctagactgcttactaacctgaaatcccacagagaacaggaagagtggccactggatttttttggaggatttaaaaaaatttgtgtactaatatctgattttctttaggcccatgttcatctaaagagtccgttatcttatgtttcttttttctatgcctgcccttgatgtcctgtgattcatccagttcataagatgttcctttataagaaggtgagaaaagcataaaaatagactagtaatatgggtccctatgtgtttcaaactgcaataaaatattattattaattgccccatataagaagcaatggagctccttcaggatgcagagtttatgtgtgttttccaggggggtgatagaggctgggagatcaaagcaattctgtaactttatcatggaattatgtttttatctatttatagcagtctatgagttttagatagaaaaatgttgccaaactttgctgtactttgaatgtacagtaatctaaagactaaaaagaacagttaacaccttctaaatgaacagcattaaataaataaaaacaggggaagacacacttcagtggaacagtttaaaaggatattttgaatgtaggggaacactgaccatttaataaagtataaccagtaatgccatttaatatttgttatactgccaataactttattaaatttgaaactaccttcctatattccttcattcattcactaaatatttatttaccagctactgtgtgctaggcactgggtatataatggtgagtaaaaatgagcacagtcaccatactcatagagctaaagttatacctataacatatacatggggataaagagtccaaaagttagtttttaatttggatttctatagggttttgcttagcctggtagatttctagagataggctagtatccatgaactttaagaagtaataagaccttgtgagtttaggtgtcttcctcttttttttttctttttttgttttttatttctggaatgtgacttagtttataagacttgcacttctcattaggtgctttgagtaactcgtataatatggtattgtagtgtagtaaaacttcaatgaaacaaggtgttccacagcattgaaattgaatgtagcatgctcctggatgtatactcgtgcttggcacatagcaggcactcaatacatatttgttgaaatagttcatgttcatagttatgccctcatatcagtaatcattaggactgctacttattcgtgaaaagttttgtcactatggggagcagagctgttatcacatgactgtaatttaaattgcatagattttatccattgcccttttctcttttcttttttttttctagtcctaactgctagaaatattacccctgaaggtatttgttttcttttttttttattatactttaagttctagggtacgtctgcacaacgtgcaggtttgatacataggtatatatgtgccatgttggtttgctgcaccatcaactcatcatttgcattaggtatttctcgtaatgctatccctctgccagcccccaaccccacaacaggccctggtgtgtgatgtcccgcaccctgtgtccaagtgatctcattgttcaattcccatctatgagtaaaaacatgtggtgtttggtttcctgtccttgtgatagtttgctgagaatgatggtttccaacttcatccatgtccctgcaaaggacatgaactcatccctttttatggctgcatagtactccatggtgtatatgtgccacattttcttaatccagtctatcagtgatggacatttaggttggttccaagtctttgctattgtgaatagtgctgcaataaatatacttgtgcatgatttataatcctttgggtatatacccagtaatgggatggctgggtcaaatggtaattctagttctagatccttgaggaatctccacactgtcttccacaatggttgaaccaatttatactcccaccaacagtgtaaaagcattcctatttctccacatcgtctccagcatctgctgtttcctgactttttaatgattgccattctaactggtgtaagatggtatctcattgtggttttgatttgcatttctctgatgaccagtgatgataagcattttttcatgtgtctgttggctgcataaatgtcttcttttgagaagtgtctgttcatatcctttgcccacccttcgacagggtggtttttttcttgttaatttgtttaagttctttgtagattctggatattaattagccctttgtcagatgagtagattgcaaaaattttctcccattctgtaggttgcctgttcacgctgatgccagtttcttttgccatgcagaagctcgttagtttaattagatcccatttgtctattttggcttttgttgccattgcttttgatgttctagtcatgaagtccttgcccatgcctatgtcctgaatggtattgcataggttttcttctagggtttttatggtttcaggtctaacatttaagtctttaatccatcttgaattaatttttgtataaggtgtaaggaagggatccagtttcagctctctacatatggctagccagttttcccagcaccatttattaaatagggaatcctttccctatttcttgtttttgtcaggtttgtcaaagatcagatggttgtagatgtgtggcattatttctgagggctctgttgtgttccattggtctatatctctgttttggtaccagtaccatgctgttttggttactatagccttgcagtatagtttgaagtcaggaagtgtgatgcctccagctttgttcttttggcttaggattgtcttggcaatgcaggctcttttttggttccatatgaactttaaagtagtttttttccagttctgtgaagaaagtcattggtagcttgatggggatggcattgaatctataaattactttgggcagtatggccattttcacgatatcgattctttctatccatgagcatagaatattcttccatttgtttgtgtcctcttttatttcgttgagcagtggtttgtaattctccttgaagaggtccttcacatcccttctaagttggattcctaggtattttattctctttgtagcaattgtgaatgggagttcactcatgatttggctctctgtttgtctgttattggtatataggaatgcttgtgatttttgcacattgattttgtatcctgagactttgctgaagttgcttatcagcttaaggagattttgggctgagacagtggggttttctaaatatacaaccatgtcatctgcaaacagggacaatttgacttcttcttttcctaattgaatacctttatttctttctcttgcctgattgccctagccagaacttccaacactatgttgaataggagtggtgagagagtgcatccttgtcttctgccagttttcaaaggaatgcttccagtttttgcccattcattatgatattggctgtgggtttgtcataaatagctcttactattttgagatacgttccatcaatacctaatttattgagagtttttagcatgaagggttgttgagttttgtcgaaggccttttctgcatcttttgagataatcgtgttttttgtcattggttctgtttatgtaatggattacgtttattgatttgcatatgttgaaccagccttgcatctcagggatgaagccaacttggtcgtggtggataagctttttgatgtgctactggattcggtttgccagtattttattgaggatttttgcattgatgttcatcaaggatattggtctaaaattctcttttttgttgcgtctctgccaggctttggtatccggatgatgttgaccgcataagatgagttagggaggattccctctttttctattgattggcatagtttcagaaggattggtaccagctcctctttgtacgtctggtagaattcagctgtgaattcatctggtcctggactttttttggttggtaagctattaattattgcctcaatttcagagcctgttattggtctattcagacattcaaattcttcctggtttagtcttgggagagtgtgtgtgtccaggaatttatccatttcttctagattttctagttaatttgcatagaggtttttatagtattctctgatagtagtttgtatttctgtgggatcggtggtgatatccccttgatcatttcttcttgcgtctatttgattcttctctctcttcttattagtcttgctagcggtctatcagttttgttgatcttttcacaaaactagctcctggattcattgatttttttgaaggggtttttttgtgtgtctctctctctttcagttctgctctgatcttagttatttcttgccttttgttagcttttgaattggtttgctcttgcttctctagttcttttttttttttttttttttttttttttgagactgagtctggctctgtcacccaggctggagtgcaatggcgcgatctcagctcattgcaagctccgcctcccgggttcacgccattctcctgcctcagcctcccaagtagctgggactacaggcgcccaccaccatgcccggctaattttttgtatttttagtagagatggggtttcaccgtgttagccgggatggtctcgatctcctgaccttgtgatctgcccaccttggcctcccaaagtgctgggattacaggcatgagccacggtgcccagctagttcttttaattgtgatgttagggtgtcgattttagatctttcctgctttctcttgtgggcatttagtgctataaatttccctctacacactgctttaaatgtgtcccagagattccggtacgttgtgtctttgttctcattggtttcaaagaacatttttatttctgccttcatttagttatttacccagtagtcattcaggagcaagttgttcagtttccatgtacttatgtggtattgagtgagtttcttaatcctgagttctagtttgattgcactgtggtctgagagacagtttgttgtgatttctgttcttttacatttgctgaggagtgctttacttccaagtatgtggtcagttttagaataagtgtgatgtagtgctgagaagaatgtatattctgttgatttggggtggagagtcctgtagatgtctcttaggtctgcttgttgcagagtcaaattcaggtcctgggtatccttgttaaccttctgtctcgttgatctgtcaaatattgacaatggggtgttaaagtctcccattattattgtgtgggagtctaagtttctctgtgggtctctaaggacttcatttatgaatctgggtgctcctgtattgggtgcatatatatttaggatagttagctcttcttgttgcattgatccctttaccattatgtaatggccttttttgtctcttttgatctttgttggtttaaaatctgatttatcagagactaggattgcaacccctgcttttttttgctttctgtttgcttggtagatcttcctccatccctttattttgagcctgtatgcgtctttgcatatgagatgggtctcctgaatacagcacactgatgggtcttgactctttatccaacttgccagtctgtgtcttttaattggggtatttagcccatttacatttaaggttaatattgttatgtgtgaatttgaccctgtcattatgatgtttgctggttattttgcctgttaattgatgcagtttcttcttagcatcgatggtctttacaatttggcatgtttttgcagtggctggtaccagttgtttctttccacgtttagtgcttccttcaggagctcttgtaagacaggcctggtggtgacaaaatctgtcagcatttgcttatctgtaaaggattttatttctccttcacttatgaagtttagtttggctggatatgaaattctgggttgaaaattcttttctttaagaatgttgaatattggcccccactctcttctgtcttgtagcgtttcagctgagagatccgctgttccctttgtgggtaactggacctttctctctggctgcccttaacactttttgcttcatttcaaccttggtgaatctgacaattatgtgtcttggggttgctcttctcgaggagtatctttgtggcgttctctgtatttcctgaatttgaatgttggcctgccttgctaggttggggaagttctcctggataatatcctgaagcatattttccaacttggttccattctccccatcactttcaggtacaccaatcacacgtagatttggtcttttgacatagtcccatatttcttggaggctttgtttgtttcttacttttttatctctaaccttgtcttctcgctttacttcattaatttgatcttcaatcactgataccctttcttccacttgattgaatcggctcttgaagcttgagcatgtgtcacgaagttctcgtgccatggttttcagctccatcatgtcacttaaggtcttctctacactgtttattctagttagccatttgtctaatcttttttcaaggtttttagcttccttgcgatgagtttgaacatcctccttcagctcgtagaagtttgttgttaccgaccttctgaagcctacttctgtcaactcgtcaaagtcattctccgtcccactttgttccgttgctggtgaggagctgtgaccctttggaggagaagaggtgctctcatttttagaattttcagcttttctgctctggtttctccccatctttgtggttttatctatctttggtctttgatgttggtgacctgtagatgtggttttggtgtagatgacctttttgctgatgttgatgctattcctttctgtttgttagttttccttctaacagtcaggtccctcagcttcaggtctgttggagtttgctggagttccactccagaccctgtttgcctgggtatcaccagcggaggctacagaacagcaaatattgcagaacagcaaatattgctgcgtgatacttcctctggaagcttcgtcccagaggggcagctgcatatatgaggtatctgttggaccctactgggaggtgtctcccagttaggctacacgggggtcagggacccacttgaagaggcagtctgtctgttctcagatctcaaacgctgtgttgggagaaccactgctctcttcagagctgtcagacagggatgtttaagtctgcagaagttgtctgctgccttttcttcagctgtgccctgcccacagaggtggagtctagaggcagtaggcgttgttgagctgaggtgggctccgcccagttcgagcttcctggctgctttgtttacctactcaagcctcagcaatggcggatacccctcccccagccaggctgccgcctcgcagatgcatctcagactgctgtgctagcagtaagcaaggctccgtgggcgtgggagctgccgagccaggcacgggagagaatcaccttgtctgccggttgctaagaccttcgtaaaagcatagtatttgggcagggagtgtcccgcttttccaggtagtctgtcacggcttcccttggctaggaaagggaaatcccccaacaccttgcgcttcccgggtgagtcaacgccccgccctgcttcagctcgccctccgtgggctgttcccactgtccaaccagtccgaatgagatgaaccaggtacctcagttggaaatgcagaaatcatccaccttctgcattggtcatgctgggagctgcagactggagctgttcctgttcggccatcttggcaactcccattgcccttttttcatcctcaaatgaagctatttcctttctgtatctattgtggtgttcctaatatgtagcatagtacagaatcagcaattgccactatttcagcagcacattttgaagcttttccaacatattttattaccccatgtgcttatctcatggaaacaaaagtaaagtaggaccttttcaatgggagaattaaataacttttaagggtaatagaatggaaacctatacaagtaaaatttttctttgaaaactaggttcttaagatatgaccagacaagagatgaagagttaaaatgtccttttctgttttatcaggctaattttaaaaatgtttgttgaaaggagtaaagtaaaacctgttccaagttgagattggaaagtaggtttgcttaacgtatgagactttagcagtacatcaagaatcacatatttgacctgaactgaatctacccatgtcattgtgctatttacttgaaaacgaatgttgagattatcttgccctgaacaattttgtagttatacacgcacaaccagaacatacagttgcttttacaatagggacagattctctatttagagtttgataaaagagaaccaaatactctattttaaaaatgtatagcctttcccttgaataatcctttatgtagctcagcagctaagtagaaatgatgggacagaatggatgaactgcgaggtgagaccagcccctactaggagcgtataagcaagatgaggagggagtggagtggataagaaacgcagaggaagacaatagttaagactgcattctccacacacacatagtgttggtgctccgctgctcccccacccttatctgcttaatttataagttctgcttggcttcatcatgctgacacgtgccaggtgcctgtcagtgctgagttatgttgggcagctcactgtttcactgttttagctattccctggtgccctaggcatcattttcctctttgcatcttgaacatctgctctggagtgttattggattatgtgaaagaatgatggaaagatcagtgaattggggaagtcaggagatgtcactgatttctaagtagttttgtgactttgggcatgcagctttttgctcttagttatccccaaaatcaaatgaaggatgtagactagatgatctctaagcgcttctagctgacatttgcttgaccccatgactttagggggccttgttcttggaggacacctattatgatttctaatataatgtagtattagctttgtctatttcatggggctgttttgagtttcagctaggataaaagatgtgaagatgctttggaaactattaagaatcatataaaacaaaaatgatacgagtagtttaaaagattctttcctccaaagataccatatagtgataaaaattaaagtaattccatttaaatgaatgtgaggccaattacagaggccataagaacagacatgcagttatacttaccatagagaaatatgccatttaaaagcacacagatcaaggaatgattcaataaacattgattgattggttaggcagctaggctttggggatgaggtattctacttttcttcctgatcccccttgtgcttgtcaagtttgaaagaaacaggcagtggatcatgttcttttctctgtcactatcacccatccactccacgaaagttagaatagaacattaaaacctgtacagaagggaatgggtcatcttgacccaatagcagagtatgagaacatgaggccgccttgcatactggcttgtcagacttggcctcgccagcactaggtagcagtgaaggcagctgccgtatgcctttgtctttgtggtcctcttctcttcctccacccccattctgttctttcatgtccttcttgtgaccttttactattctttcttccttaccttactagagtagaaaagaggagcgcatacaaaaggtggggaaaaggaagaagagaaaggaaaataaagattaaaaactttacaatgaggtagtggggaaggttgggctcctctctttctctttctccttctcagtatgacggacttgataattttactttgtacctcatctttaagtttgacttcattcttttctttagttacctttagtccccgatcagtgacatatgcagaaaattataaacaggccgcatgataggaaccagtatcctgcctctcagcagacttgtatcatctaggactggcagtagttttagaaaggacagctgaaccagcctgacatgacacataagttagagtgacaacacatgttttgcagtttatagagttcaattaatagatttgattgccatggaaagagggaaggaaaagaattgcatgactcgtgtactgagtatgagagagcttattcatacaggttggaaaagcaaaattaaaaaatcagaaacaggcccaccagcctagatatgtccaaaactagtactttggtaacctattatgacttccagcagattaagtttcaaactgtggaaagggcttcggaataagggaaggcttagcatcccactaataaggcttattaagtttagataaaacagatgtttttcaatggtagcagctctgagtcaccaagatcaaaatggagaaagaagagaacaaaaacaagctaacactttcattaaaaaggtactatttttcttaggcattttcagaacctgctcacatttatacttaatactttcagttaaatcctatgaacggaagcattaattggggaaaaattccttaatactgattaaatgtatatacatttatgttgatttgctgacattctgaaagtggtactatgaaaagagaatgggatttagaggcaggcggtcctaatttcatatgtcagctctcttacctgtttttgtttctttgtttttgtttttgttttgagatggagtctcactttgttgcctgggctggagtgcagtggcgcaatctcaactcactgcaacctccacctcctgggttcaagtgattctcctacctcagcctcctgagtagctgggattacaggcatccaccaccatgcccggctaattttttttgtatttttagtagagatggggttttaccatgttggtcaggctggtcttgaactcctgacctcgtgatccgcctgccttggcctcccaaagtgctgggattacaggcatgagccactgcgcccgaccagctctcttacctgtttttagaaccattggcaagttacttaatctcactgatcatcactgaacctcagcttcttcctctacaaaatggagttgttttgaggactaaacaacttaatgcatgtatagtaccttactcacagtaggtacttagcagatattggctttctgagattttaagctgcttttgctcatagtgccatgtctaaatatcttaggaccagtcttctagagcttgatgaggagctttaggccatccaaagagggatgcacctgaaggattcattgtggggtgagataaaaatattagaaagtctatttatatcattttagataaaatataagaaagtatttaaactccactaatgtttaacatgtggattgaccctgatgctctcctttggtccatgttggagagtcactgtcatatactctaaatgagggatcccgagaaaagtgtgagatttcttgatttggtgagagttcatggtggcatgcacattcttttgctcactttaggcatattgtaacatatttcagtttacatgtacctagttaagtagatttctagttcttagtacaggttgagcatcccaaatccagaaatctgaattgctccaaaatccaaaacttttgagtaccaatgtaacgcttaaaggaaatacttcagatctcagaattttggatttgggatgttcaaccagtataatgcagatattcccaaatcacaaaaaaatcccaagtttgaaacacttctagactccagcattttgaataagggatattccaacctatataatcttcatcctgtggtttctttgcaggaatcttcttaagctgtttgactattgtgtgtaggtcagttaaagctagataaactaacccacgcagaatggacaagtggcttaggaagattcctgcaaggaaaaaaatgggctgatgataacagtgataatgcaagggcaagaaaatggtgaactagctgacacttctatgagtttcctcttaatttagccaagtcatgaagtgaaaacaaaaataatctaatcaaatctgacaagatgtcagccccaaaacaagaaaggatcaagagcattatttaatttatactcactgtctttaataacaaagcctactctaagtatcatgctttgatatattagcctgtcatagtagtacaagtatatactttataaatatacatattgaggatgtgtgctcaaactttttttagtgataagaatactcaatcaaaactgtttggatcctggtgatgacagacgacattgtcagccaatccccatgtggtagtgaggacatgtcctgcagttctgaagggattctatggattttttttaatttaaaaaacgaaaaactaattttaaaaaaaaacagcttggagactgctattttaaatgaggaaagcagttgctgcctatggaatctctcatctctcattctgtatctgctgcttagaaatcatttttcttgtttttgttttgttttgttttgttttttacctaaggattttgctatagtatgaatagtaggatagagagtaatatatctaaatccatcaaacatgatttagggaactttatttctgataaacatttcttctacagaagtaaaagaacaattcctgcccaaaagatttaaaaactgtagttcaagaaaactaagaaactgtttcaaagcagcatatgaatccctgcctgcagtataatggaaactcttgatgaagatgtaccttacttgatgtagatttgtttctgaaaaatatatatatatcttttttttatttctgtaaaactccctgtaactctgagtcagttggtaaccagtaaaccagtagcatattgtaaaacagatcttttcaaaaagagcgctaacctgctctgattattcctctcagcagtcctatagcatgattttaacacgtattttatacatatccatatattatttagtaatctattcttatattctccatggctctttgcataataaaaagcaaatagtgggtgtttaatacttattttgaaaatgaaagaaaatgaaatgaaaacaccagaacctggaaaggtagtcattatcccccgagatggccacatttaattcctagagaagataacttgtttagttcttcccacagcacagcttagtcctgtggctccctttctttcaccagagccataatatggggcagccctgtggacagacggatgatcaatcagagttctttgacagccactacttattgagtaggttagtaaaggcacttgtgcagttattattattttatttgttacagttgctccattaggtgggtactgttatgatctccatttcataaatgaggaaatgaaggctggcatagattaagagacttgcccaaatgtcacacaactaatgtatagtggagccaggatccaaatgcaagtatatctgactccagaacccaagctgttggccattgtaatatgttatgttctagagaactgtgaaatagtgctcattaattaacgattacttcaattttgcattttaggagctatatttattggcataagtcacagagaactgttgttataccttggagacacacttttgatgggtctggggaagtaatactaatttgggattgtagaccaggtttctaaattccaattcagttcaagaggtggttcattcagttttatagtatatcctaacttaagagaacacacggatgagatccctggaaattttgccagtctgtgtgttacacagtctcttgaaggtagagacaatctcatatcttcacatttccaagcttataattgtcagtggtcatatcgtaatcttttccaaacccacacatttttttcttgccaaggcctcgagagcactgttgttatggtgtacagtaacaaatgacccagttatattgagttttaaagatgaaccagattcataaagagaaaattaaattatattcattttactttggcagattttcatcagaaaaacataatttaaacaaaaatagtttctagtagttcatttctaaaaacaagatagagtaaatctagaaactctgcagagaaagcattatgtagacattttgtagagggaaataagaaatactttctgtatatacaaacatttagccatctgtttctttatgtatcttttattttccagttttagctctgctccactaaatcaaattcagacccaattctcttaatttagaggggaggaatttgtggcctaggaggcagattctgatgatacttgctggtcctcacagctggcagctcacagggaattttcccttcctggtgggcagctatggctatctcatagagagtagaggcttttaagaatgcaagatcagagcatttcaggaactttaatcagagggcagtaagtgataacactctaaagcctaagtgaatctcataggatagaagcccgataatatatatcaaaacctactgaacctgttatcctttatctccctctcctctctcttacttttccattctccctttcttgctttctccttgtttctttgcatatgtctctatttgagccctttctaagtgtcccccttttttgtactttctttgactcctacttcttttttcagcttcttgcttttctcttcctttctctttttacatattcctttttcctttttctttcttttttttttttccagaattggataatatggtttttttttttaatttaagttttagggtacatgtgcacattgtgcaggttagttacatatgtatacatgtgccatgctggtgcactgcacccactaactcgtcatctagcattaggtatatctcccagtgctatccctcccccctcccccgaccccacaacagtccccagagtgtgatattccccttcctgtgtccatgtgatctcattgttcaattcccacctatgagtgagaatatgtggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccccgaggaatcgccacaccgacttccacaatggttgaactagtttacagtcccaccaacagtgtaaaagggttcctatttctccacatcctctccagcacctgttgtttcctgactttttaatgattgccattctaactggtgtgagatggtatctcattgtggttttgatttgcatttctctgatggccagtgatgatgagcattttttcatgttttttggctgcataaatgtcttcttttgagaagtgtctgttcatatcctttgcccactttttgatggggttgtttttttctttctttctctcctatcttctcttccttttgttccatcccttagttctttcctctattccccatgaattacccatcatatcatattaagcatatatattaaaattaataaatgttaatggtcattgagcagcaagaaggttttattattactgtaaaaggaaaaacatctcccagttaagtaacactgtacatatagcttacaattgaaacttttcttttgagtaacagccctcaccaaaataaggcacctttcctccttccttaaccataattgtgtcttttgttcttcctctctacccttaggtttgatgaataggcacatttttacattttgttttgtgtccattacttcgtgaattttagaaagctaaaattgctacttagtgagacagagcggtagataatttttcagatgtgggtttaggattctagtattctgagtttctggggttcaaacatgccatgtatgcattctattccagaagctctagcagggaatgacagaatatggaatttcctggtggttgaaacccctcatgaaaaaactgcttttagttttagactaaaacatagttgaattgcttctctttgcctgtccaaacagggatttttaatttgggttttaattacttccttgtcctgaataatagttatatgtaatatgaagcccctctcagtttgataactttccagcagttaaccgattaaggtcaacaatattttagaaagtgaatgaacaagtgagcaaatgactagacagagtcccttaaattatttctgttacatgctctatcgtttacgatgagccttgtaatatctaaggttttgcctcttttcagcgacttttttttctttttagcatagtttccaggcactgtcacaaactctttggttctttcatagctaaactcttaatatcttttcttaaaatgttcatttttattaaagtactatataacattatatattaactttgacaaatgttaacgttccttctcaattaggtgaggtgtattcttgagaaggtgccaatttgaattgaatatatttgaatttgatatgtgaactaaactgtaattgtttaaagcttacccatccatcatatgggtgatggagcagctgactgattttacatgtaagtgttttgttttgtttttctagcaatatttaaacattagaaaatgatttcctattctaacaaagagaaattcatatgaatttacttacaggacccccttgtcagttccttagactgcctagaatttaaattggcagatactactttggtataaaatgctttctatggacagtattaatattttaaaatgttttactcctgcagatttccagtagacaggaagtctagctctgtttaccctttggctactaatgagtgctgctgaatgattatttatcatctttaggtagaggtaccacaggtatgagatcagaattgccaagtaaggcaagcatttaattttaaaatttgaaaacaaatccatgcaaaggtgacaactaaagtatagatactcgaaagaattttggacttgagtcagaaaatctcagttgtatccctacccttgtcattaacttagctgagtcaccttgagtaagtcactgcccaactccagattacagtattctctctaaaagcacaatttcaacattgcatattctaaagagagcttggttaaggaaagcttggttgaggaaagctgaatcttgttgtttatcagctatccacaccagcctggcagctctgaggtcagtctccagctgtattttcatctttttgtaatctcttaaatccttgcaggctttcattgctagttcatttccctagaaatttacatttagagacattgaggacttcctacctttgtaatttttctgtgttcatgaatttaatgaaaaattacttagagctggctaaaaaatgcaagaatcaaaagtcttgtttaaatgtctctgtaaaatcagactattcccatcatgactaacaacctttactatttcagagttttgaaatcagtatgtttgaatcttgacatggtgaggcaccattgtcattttatcccattcattgttctagcattttcctactaactccttgttctaaacattcttctttttttttaagcctagaatgagtgaacaaacaacaaggctccatgtcatgagaaaagcactgtagcctgatcttcacttatgttttaggtatttgaaaattacattgatttcaaatagtttgaactgcattgagctaaaacttatcttttattggtctgctaggaaatgaactaaacaaaataacttgcctcaaagtattgagaaattaactgtatagcgacttcagcatgtgtatttttaaaatgaaaaagctagagctaggtacaaaatgtgcttcattaaaggaggtctagcactatattcaaaaggtcaaacaacaacaaatattggtgtggatgtggagaaactggaactcatacattgctgctgggaaagtagaatcgtgcagccattgtgagaaatagttcattggttcctcaaaaagttaaaggtagaattacctttatgatccagcagttccactcctagctatctatccaagagaaatgaaaacatacatccacattaaaacttatacatcaattccctagcagcactatttataatagccaaaaagtgggaacagcccaaatgtccatcaaccaatgaataggtaacaaaatttggtgtatccatacaatgaaatattattaggcaatgaaaagaatgaagtactgatacatgctacaacatggatgaaatctcaaaaatatgctaagtgaaagaagccagacgctaaaggcaatatattgtatgatttcatttatacagaatgtccagaataggcaaatccatagaaacaaagtagattaatggtttccaggagctgggagtggtgccaatatgcagtgactgctattgggtacgtagtttcttttaaggatgatgaaaatgttctaatattgcataatggtgatggttgcacaactgtgaatatactaaaagccattgaattatatactttaaaagggtgaattttgtggtatgtgaattatatctcaataaaagtgttatggattaaaaacattagtgactgtattactataactatttgaaattataaaagtatatttaaattacattttatgccaggactaggggcgggggggaatggggagttagtatttaatgggtgcagagtttcagtttggaaagatgaaaaagttctggagatggaagatagtgatagatacccaacaaatatatttaattttacagaactatatacttaacaatggctaaaatagtaattttatgttatgtatattttaccacagtaaaaaaatccataaccccctaagattatattttatattattctaatgaatgatgtgtcttttactctttttcttcttttaacagtaaaactgaaaatgtgattggccttttgttttttatgcatataattcttctggtctgtattttagaacttctttcctgtgtggcgttgggggatgcgggtggttacacacacacgtctttatcttggctttgaatgagaacttggaagtattttttaaaacttttatttgtcagtaggaaaataaaagaagccaaaccataggaaatttacgtaattaaattataaaatagtgaaatgctgttctcagagtatgaattatcacagatttcctgattttcttggttaatcttggcatcttgaatgggaaaaacatatatacttttatacatatataacatctctgtatcttcctataagcattttcctttgtatagcaggataaaatgagcaccaaaatgtggtgcaaatataaaaacgcagtggatgagcttcaaaatgcaaacaaagggatgggaaaatgaaaaaaagaaaattcagcagtgagaaagtcactgaaaaaggaattaaattctttccaagtctatggaactatgttatgacccaagcagtttgtagagtctgagtttgtaacctctgaggataaatccatgaaaatatttctaagcctggctactatctaggacatttgaagatggatgttatgaataccagtagtgccattaatatagtaggcaatcagaggtatgtttgtttttcttaatcaggaagtggtttcttttaaaagtataaggaacacacactgtgtgtgtgtgtgtgtgtgtgtgtgtgtgtgtgtgtgtattttctattccgttgcaggaagaattatggtttttccacattttacagtggggttttctagagtttggcactatgatatcctacacttgattacaggatccaatcagagttgatgtactcagaaattcattgacatgattaatggtctcctaatcatacttttatttcctagattagccctatttcctgtagtttcacaatttttgagtcatatgttaaattatcctttattgggggcctgaaattcttatgagtatttttagtctataatttgcatgattatttcttttctttgttttttttttaattgaagaaaatgaaattttgatcttcctttgaattctttgagtgctgttctatggtgactggccttcctagtataatcttttttaaaacaatattgtatatatgtgtatgtttgtatacatatatatgtatacatacacacacacatatacacacacatatatatataattttactgccaccagcactagatccagaaatcttcctacaagtttccactagtctagtttttattcttctcaaaagcaaaataaaacattcttagattctacaagtagcagggaaagacatcaggaaatggctgtacaggaaatgtaattgatgattctctctttacaattgaagtggtcacaagattggctagcaaacacaatctattaaatgaaaaaaaaggtgacttctaaaatctttggggaatttgaatacatttgaagcttgttggtacctttgacatcttactgattctttttgaaactcttacctttttcaaacaattgtttgcatttgaaattgggaactttcatatccagtgattgctttaatatttgctttgtttttaacagtgcccttaaagatagccgttttcccccaatgacaagggatgagctgccacggcttttctgctcagtgtctctgctcactaactttgaagatgtctgtgattatttggactgggaggtaagattatagaaaaatttttaaagaaaaatgaaggtaactcttgaggagatgttaaaaattaggcccagaaaataactctttcagcccattctctattgtaatggaggtcgagagtaatatggatgaataaacctcacaactgaacgagatataagtaaatgagttttttaaaggacaaagtgccacgtgttgttataatccccaaactgaatttggttttcatttttctcctactacctcaccaaagcacctcataaaagctgttaataagtaataagaaggactgactggaatttatttctcctcttactttcattctggtgcactctggtataaccgccactaagtaactagttggtcagaggatacatctcagaaacaagaagaaatatttaggataatacaccatttgggggaatcagcttgtgataacaacaaggtattgattaactagagttaaataatgtgaattcattcttggctaccttagtttatacacttaaacactctaacaaataatactaaggttatttctagggtatctctgtgcattgctattgttagagtagcttatattgatcatatttttattcttctttagtacatggggttggctaacattgttagtgaagttcaaaggttctcaccatgatttgctttggtggctgggaggagatgttgagtgtaggtctattgggtctatgaaattttacacacaagcatgcccatattactgaatgcctgttttattccaggcaatgtgctccatgtataaaagtggtaagatttggttcccaccatgaagcatgtcataatttagtggcgagtaaatgtgtatagaaagtatgaagaaataagtgctatgagaatgaaacaatgggaactcagtgataaacataacattctctctcacacatacactcataaatggcattattgtatccttatgacagattttaattcttctgctgttttagaaggaccatcccccatagtaactgaactattctgccttggagacagatcactgtcttcacagtttattagacttgaatttaattttggctttgccctgattccttgtgagactttgaacaatttacttactccactgcaattcagttttccaatatacagaataagacatttataaggttcttcatttgaaaaaaaactctatgatataaattattgttgttataccagagctatttaaaaagttttagggggtggggtgaaaaaaaacttttctacagagagtacaatgctagagtcccctctgggttttgtgctaagattttctggagcattatcagaatatgaacacatcttaggatttttgcaaaggaagaaataaaataaatttatactgttgttcctaccaaagttggaatgtagaaaaccttttgtaaacttgaaatttctgatttattatttgctataagtttgttgttcttacttgatttttcttaaagaaaagtctacaaatattatggaaatattccttagtactttatttttaaacagccccaaatcatgttccctacttattaacatatattatagtctgggtggttcttttactgttttaaggctgctgtttcctcttccgcagccagatttacttttgctttctggattgcagggtgttgtgtatgtagtagtggggatgggagtgattatatgggaaaagcctgagatccaagggggatgaccaagctacaagaacacttctactcttgcagctactgagttggaagtacagttctggcatgtgtgtttctgtgtgtgtgcatgtgtgtgtgtcacaaacatgaacatactagtattacataaatgtgtgtgcatgtgttttgggggaaggaaaaaggggagaatacaacagctgttacataggcatggttaagcaccgagtacatcatcatcatctttagcccagttaaagcactatctacagctaaaattaaccttgatattattggactattatgtccaaaagatacatca

SEQ ID NO: 13081 - DNA, 12779 bp, Human
tcactgtttccccttccctctcgatgtactcgttaagaagtggtaccctgccccactgctacctaggaatctgatgactaccctgtttccccaaactggctctaggagtatcttttattccttcaacgaacattagctgggcgtctccggcgtgattggcgctgtgctgagaacacagtggcgacagagacaaacctagtccctaccttcatggaacacacggtcatagacatcataaaacagcacacagataagagtcggataacaaattagaccacacgtgacatgaaggaacacggaccgacaaaagcatttaacaggcggatttctggatggagggcagggaaggagggcttcgcagaggaagtgacgttggtgccgagacccgaaggatgaaatgggagttagccaagccgaatgggtaaaaggatgttgcaggcagaagggacagcctgtgcaaaatccccgaagcgggaaagcgcatggcaagtttaaggaaccgaaaggccagggcggctgttagaggtgggggaaaaagcaaagaggccgagtcgaagcaagcgaggtctgcggggcggtggcgcccggggggccacgttggaactttgcctcgagggcactagggagccaaggaagggtcctgagcaagggaagaaacatgggtcgcgaaagccactgttcccctctccccacggcgatgccctccccgcccgagcccctgcttctttaggagcctcctcctttcgtctccgggcccaaacgccgcctcccgctcaccgcagctctggcctccgttcccctcgcgccccctcagcagtgcctcttcctacactccgccgccgccgccgccgccatcttccgttcgtcgccgggaacggtgcgcacgcgccacacacccagggccgccgggaaatggagtccagagcacagcccgaccccgcccatgcctcgtcccgtgcgagcggcattctgcccgcctccatactacggcgagcagacccttcatttccggctctgggtccggctaggccttctgggaaatgtagtcccttcggaggcaccgggcggaaagggagctagagcattctgggaaatggagttctcagtggtgctgagtccctggacggctggctggtcttggagagtgcggagttcgggcagcgaagctcctgggtcttggaggggaggtggtctgttgccctagtggggtctgcggagaggccccgatcccctccatctttgttcttgaccctttcaacagtctgaagcatttctttttcttttcttttctttctttctttttttttggaaacggagtcccgctctctctcccaggctggactgcagtggcgcgatctcggctcactgcaacctccgcttcctaggttcaaacgattctcctgcctcagcctcccgaatagctgggataacaggcacgcaccatcacgcctagctagttgttgtatttttaatagagatggggtttcaccctgttggccaggctggtctcaaactcctgacctcaagtgattcgtccgcccgcctcggcctcctgcagtgctggaattacaggcgtgagccaccgcgcccggccaagttaagcatttctagccgtcggaagcctcagtcttcctgtctgtccaatggggatgtgatttcggggaccttttacgggtccttgtagtcgcatagtggccctagcgttctgattcccctttcttccgccacggtcatgcagggctctggctcttcgtcctctcctgccgagatgatgaagccccctgaggtagaaaggctccagagttctgacctcggggcccttggtatctgcagcgtcgctgcgggcagctccctcactcctgaatcacccccagctgtcgcgtcctggggctgcggcccccggcgcctgaggtctgtctcctggcgatcccgcagggggcgccccagtccgagcgcgccgccctcggggaggcgggaggggagcccggggcgggcgagggcgggggtgtcccggctataaagcgtggccgcctcccgcggcgctcgggacagccgtaccccgggcggtcggacgggcgggcgccggtgggagctcgggccgtgcccgctgagagatccagagcgctccgttcccccggggccggagcgggggcgggtgggggcgtaagcccgggggatgctgggctcagtgaagatggaggcccatgacctggccgagtggagctactacccggaggcgggcgaggtgtgtcctcggggatggcggagcgggaagttgggggcaggtatcggggtgtgggctcacatggagcagggactggttgtgggttcaaatggaggcaaaggcgtctacttgggcagccgaggaactgggaacacggagaccaggtgtggaagtcggggaccggggacgaggcatggatgggagcgctgtttgggcagcctcgccgcggccagggcttaaaaatggaagtcaggaaaatttagccaagggtcgggtcacaccttaaacttgggagccgggtgttggagccccaaaaagcaagggatttatatgtacaaaccaaagataggaatcagagttccagggtaggggacagactagggggtttcaggatgtgaggttcaaagttggagggaaagaaagactaaaagatggaggaggagtcaccattaaggggaagactgaggtgggagctcagggccagcacacagtgttaaagaaccggggttcggggctaaggatcagctggtaatctaaggtagggtcagacatagggattggtgctcaggggtcagagatgggggtgctcagagatgaagcttcgtttttggagtctgaaataacaggtggcttagagttgggcatctgggagcagaagatgtagccatcagcattggcaggagaggggccgatctccacccccccatccctacccatgaccctccgcagggactccccaagtcggaagatggagagttttagattgtgcaccttcccctgctccccgccagtccagcaacctccagctattgctaaaattcccatccagtctcacctcagacaaggcttccctggagtggggggtggcggcatattctaatcccctcacctggacagacagaaagtccttcctcaagtctgacccccattcgtcttgctgcaacgacccctacaccttagctacctcactctgtaatcaacgttgtgaggttgttggggctgggggttgggttcttggtctgagaattatgggggtctggacacttggacttctaacctggaaggggactgtgggcttgaggtggggtgtggggcaggaatggctaggttctccaaggagtcaagatctggtgactgcgggggccccagtgtgcctgagtcttgggtctggggctcgaaactgtagggtgggactcctggatccccaggccttcagggctgggcaaggtgcctgggaagggccagtcctgggtttggggaggtgtgaggtgcacgtggggtggggcagggccaacagggaaagggactgggagtgttgagaggtggaggcagggtggctggaggtatcagttgtgagatgcggaaggcagagacccaggtgggaaatggagggttccaggtagtgggggtgatcccagctggacctctgcagaactcagtctggggacctgatttaagggaaccacctacagaccaattgtacaaaccaactacagttgttttgggggcacatcttaagtaaatgatgggggtctaggcaggaggagttgatatttggggcacagtctgaatagatccaagtttaggggacaatttgtatggaaattgtgtcagaaattgaaggaaagccggcacagtggctcacacttgtaatcccagcactttgggaggtcgaagtgggaggatctcttgagcccaggagtttgaggccagcctgggcaacatagggagaccttgtctttaaaaaaaaaatttttttttaattagtcaggcatgcctgtagtctaagctacttggttgggaggctgaggtgggaggatcacttgaggctgggagttcgagctgccgggagctgtgatcgtatcacggcactccagcctgggtgacagaatgagaccctatctcaaaaaataataatagtagagggacagtctggaggtaatcagcatttcagggcatattttgggagagtcagtatttggaggaatggaaatggttgggtgatactgtctgaggctctccccagccttcccatcagataagcccacctcttccccttgggtcagaacaatggggagagaaatacctacactcagccagcaactgagagctgagagggtccccaaaccacttcttgcccatagcaccctcccgcttggggtgacgttaacactcagggcagcttgctgtctggaaagaacttggaaagttaccatcctgggatatccctgttggcctcaggttcttgcagatcagctggtccagctgctcccctgttttagaggtggttaactctgaagccccgcacgcagaacactggggtcctgggttgggtctgggactagaaacttggcttctggcttcacactgccttcctctgctccctgtcacacccttctccagagacaataaggaaatgaaagaggagaaattccagtctcctggtgtgggggtgcgggtcccccaagggcttccccccaatctcagccccaccctgtcaggggagatccggctcagacccggacaccaggggttcatcccagccccggggcgtgggaaagcctagggtggattagggcagctggagtgcttgaggtcggacctcaaggaggacttccaggtgggtggggagccagaaaggagggccctggggtccctgtctgtcttactctgcaataccagagagcctgactgggttgcagaaatggggggtggaggtatagggggatttggaaactctgtggacccctctaatccatcaccttctcacctcatcccttttctttttctggggaggggacccgaagccaccaaccagcgggagagcctgcatgggggaagggagtaactgtggctgcaatttcactgtaagacttggggtgagggggaatggatttgttgaagggagggagatagatagatagatagatagatagatagatagatagatagatgcatggatggatggatagatagattgataggaagatggtggctcgtcatggtagctcatgactgtaatcccagcactttgggaggccgaagagggtggatcacttgaggtcaggagttcaagaccaggctggccaacatggtgaaaccccatctctactaaaaatacaaaacttagctgggcatggtggtgcatgcctataatcccagttacttgggaggctgagacaggagaattgcttgaacccaggaggcggaggttgcagtgagccgagatggagccactgcactccagcctgggtgacagagtgagactctatctcaaaaaaaaaaaaaaaaaaaagacaagaagatgggctgaaggaggaagaaaggtgggagttggggttgggaggggagtggggtagagtcggatagtgagagagagtgcccaggaagggagaaagagatggaaggatggagagagagacaggggccgagatggaggggaaagaaagatgggagaggactcgggaggggtcgagggtgggcaggaagagcaaaagaggttagggtggagacagaagggaaaacaatgcgggggtggggagggagatgggagaggggaatatgggtactagtactgagacgggtaacacaacggcaaaaatagccaacagagattcaaagagacatgatgaaagagttccttggagagacatgaaaaggaaagagcagaggatttctcgactggaactcagacttagggttgagttggttgcctccactctctgattccctaagccaccctggccagactcgtttctccggaccttgtgacctgcagaagcttacagtggtagggccagacatggtggctcatggctataatcccaacactttgggaggccgaggcaggaggatcacctgaggtcaggagttcgagactagcctgaccaacatggtgaaaccctgtctttactaaaaatacaaaaactagctgagtgttgtggtgcgtgcccgtaatcccagctgctcgggaggctgaggcaggagaatcgcttgaacctgggaggcagaagttgcagtgagctgagattgcaccactgcactccagcctgggcgatacagtgagactctcttaaaaaaaaaaaaaaaaaaaagcttacagtggcaggagactaggcggtatccagttaactcacatttggtggctctagccagtgctgtatatagcagcattcccccacccacgcagtgccatgagaccccaggcctcggaggaggcagtggggaaaggtccaggtggagaatggggcagagaggatgggagacagtggttgagaagggataagtagatacaaagaaagaaacaaccttccagcatgcctatgttttcctggcgtgttctgttcactgttgtgttcctgctagactgttggcaccacgagggcaggcatttctgtctgtcttagtcactgcttttattttattttatgattattattttttgagatggagtcttgctctgttgcccaggctggaggcagtggcacgatcttggctcaccacaacctctgcctcctgggttcaagcaattctcctgcctcagcctccctagtagctgggattgcaggcatgtgccaccatgcccggctaattttgtatttttagtggagacggggtttctccctgttggtcaggctggtctcgaactcccgacctcaagcgatccgcacccccaccccccccacctcagcctcccaaagtgctgggattacaggcgtgagccaccgcaactggcctagtcactgcgtttatagcgtgacccggaacaggtctggagccagactgcctggttgcagaatcccagttctgcccccattcttgctgtgtgaccccagcaacctctctgggcctcagctagctcagctgtaaaatgggcatcatcataacacctcctcccatagtatggttgtcaagattaaaggagaccattcttgtgaagtgcttggagcagctaactgataaatattggttgaatgaatgaaagaatatacagagggttacttaggaggcactgcaagatctaccgtgttccattgacctaggatgcaccttttccccccatttgaacatttccaaaaatgggatgcattttacagtcaacagtgtcctatgattttaactgagtgtttttcccatttgtattaatatataaagtaatgctgcagcttccagagaagtcttagatttgaagatatatagtaaatggataatattattaggttgaaaagtgatttctgatattcaaacacttttatgtataaatacagtaatttatttttatttatttattttttttttttgagacagagtcttgctctgtcgcccaggctggagggcagtggtgcaatctcggctcactgcaacctccaccttctgggtgcaagcaattctcctgcctcagcctcctgaatagctgggactacaggcgcccgccaccatacctggctattttttgtgtttttagtagagacagggttttgccatgttggccaggctggtctcgaactcctgacctcaagtgatccacctgcctcggcctcccaaagtgctgggattacaggtgtgagccactgtgcccagcctaaatgcagtaattttataagctaaaagattgaagagagctacacatatatgttagatatgttagattattacagagttataataacttttttttttttttttgagacagaatctcactgtcgcccaggctggagtgcagtggcatgatctcagctcactgcaagctccaccttccgggttcacgccattctcctgcctcagcctcccaagtagctgggactacaggcgttcgccaccacacccggctaattttgtttttgtatttttagtagagacagggtttcaccgtgttagccaagatggtctcgatctcctgaccttgtgatccacctgcctcggcctcccaaagtgctgggattacaggtgtgagccaccgtgcccggcctataataactctttatgattactaaaattgagaactgctgatttacctaataaaccagcagttattaaatgttttggtctcaggaccaccccccttcttttttttttttttttgagatggagtcttgctctgttgtcctggctggagtgtgcagtggcatgatctcagctcaccgcagcctcagactcctgggctcaagcgatcctcctgcctcaacctcccgagtagctgggattacagtcctgtgccacgatgccggctgatttttgtatttttggtagataacagggttttgccacgttgccaggctggtcttgaacttctgacctcaagtgattcaccctccttggctcccaaagttctgggattactttgggaggctgaggcaggaggattactcgaggccaggagtttgaaaacagcctgggcaacatggtgaatccccgtctctactaaaaatacaaaaaaattagctgggtgtgcggtgcatgcctataatcccagctacttgggaggctgaggcaggaggatcacttgagccccagagtttgaggctacagtgagctgcgattgcaccactgcacttcagcctgagtgacagagtgagaccctgtagaaaaaaaaaattatttaggagtccaaacagtttctgttgatgtgggttatgtctatctacgtttacagtatttacaattaaaactgagaaatattacaaacatgtattcatttaaaaatagcaatcatttgttagtgtaaaagatttttattaaaaaaaccaaatttcaaaaaatttagtcaaaagagcgacactgtttttttccattttcgcaaatcaagtctggcccagtggaagacagctggattctcctggttgcttcttcattctctctgttggaatatcaacaccccctggaaaactccactgtacacttcatgagaaagagagtgaaaagggctaataataacttaggattgcgggtgtggtggctcatgcctgtaatctcagcactttgggaggccgaggcgggcagatcacgaggtcaggagttcaagaccagcccggccaacatggagaaaccctgtctctactaaaaatacaaaaaaaaaaaaaaaaaagctggcgtggtggcacacacctgtaatcccagctgctctggaggctgatgcaggagaattggttgagcccaggaggcggaggttgcattgaggtgagatcacgccactgcactccagcctgggcgacagagcaagactctgcctcgaaaaaaaaaatagcattattttgaaaatagttttgacttcgtggacatcctcaaagggtttcagagactgccctgggagtcccgaaccctggagaatcacttaaaggatgatgttgagtgtatgggagcatggtgggtgggaaagcagggggcagaaagggcgtgtccagggagtgaggagagaccttgagagactgctttctacagatagaggtaatgatggaagggatttgtagagaaggcaagatggacagacagacggacactcagtgggtcctgggatcctttgctgaccagcagagtggagccccactgacccctcctttcatctttcccctaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcctagcaggggttgggaacatggtggtgggtatggctggagctcacaccacgaagctcttggggcctgatccttctggtgacacttcacttgtcccattggttaacatctgggtgggtctattacttactgtgatgactgctgtctcagtgggcatggtgttgatccacggggtactgtgataaccaccatggatacattttggtggcccactgggtactgtgaggactgctacattgatggatgttattggctaatccactgcatggtttgatggccaccatctcggttggccctttgggtgtgatggtgatagcatttcagtgacatcttctttggccccccccattaggtgctgtgcccacttcttttttggtgtacttggcacagtaggtgccaagttggccaccattctgtgtaacaccttttttggcccattgggtgctttgatggacatcatactgggtaggtgacaacgtcagtgggccaccatgtgccatgatggctgctgcagccccgtgttggccatgtcgtcaccattctctctggcatgggttgggtaggggatggaggtgagaatactccttggttttctctgaagcccaccctttcccccaactctggtccaggagaaaccagaaaaggctggttagggtgtggggaatttctactgaagtctgattctttcccgggaagcggggtactggctgtgtttaatcattaaaggtaccgtgtccgcctcttactgaatgtctcttttccttggccagtgggccctgtggggcttgaacacctgaatttctgctcctctgtcccttctgcttcctgcccctaagagctggctgcctctgggggaggagttgggggaggcatcgacctgacctttggctctttgctgtccctgaccccaaggacagtttgctcacagatagcagcccccgcagcagtggggccagagcagcagggggaggtggctctgcagtgaccaaggccatctccccacccccacttctcagacatacacacagacctctacctctgaggctctgcaagcctaatggccgaataatctttggctaagctggggaggaggaaaaaggacagatgaggtgtcaattcaatgactggagatcgtgcacatgttggagtttatctgcgtgtgtgtgtgtgtgtgtgtgtgtgtgtgtgtcctctgtgtgtcataggatagcactatgcctattggggtcctcatggtctaccgcagggtgttgtctgttgtcagtatcccttgattgtgtaggtttttgtgtctgttcataccctgggtatatgcttacttgccctgggtggctgggaatatcagactcttgtgtatgtttttttttgtttttttgagacagggtctcgctctgttgcccaggctggagtgtgtggcacaatcttggctcacggcaacctccacctcctgggttcaagtaattctcttgcctcagcctcctgagtagctaggattacaggtgcccgccacgacacctggctaatttttgtatttttagtagagacagggtttcaccatgttgaccaagctggtctcaaattcctgacctcaagtgatccgcccacctcaggctcccaaagtgctgggtttacaggcgtgagccactgtgccctgccttttgtgtatgtctttattgtgttgtgtgtgtggttctctgtgtacacttatccctgggtctctctgggtctcacactgtgttacgtgtgtgtctatatgccattctctacctaactcactgcctcagagagtgcgtgtgtggaacgagatgcatatggcagggctggctgttcttgtgtgttctatgtgtgtctctgtgagtccgtgtatgtctgcatgcttaaaagaaaacatgtagtctgggtgtggcggcttatgcctgtaaccccagcactttgggaggtcgaggtgggcggatcacttgaggtcaggagttcgagaccagcctggccaacatggcgaagttggcc

SEQ ID NO: 13082 - DNA, 12366 bp, Human
cggctccagctgaccgtctgtgctttgaaatgaaatctgaactccttaatcagccctcagacttgccataaccagcctggctgttgtagaggctctgtcccctcctcccaccaatgccagccaaagggatctatttgtatgtcccagaatgtgtcagcactctcttgtcccttgtcttgggacaggctgttctctccctgaaatgccctcatcctctcccttcactgtctcaacaaattcagtgctccctagcctccattctcaagtccttccttcacaacctgtgccatagctgtgctgcaccagcggcctcgcttttctttaaataactcattttccataaataaattgatttttcaaagaaaagttgatatcataatcataaataggaaaccagtatgagtagccctgaaaataaagttgctataaaaataaatataagaaaaatacaagttaataacttttgataaaattgtcagcagaccctctgaggctaactgaggggaagggatgggaaggcagattaagaagtgttagcaacctgttaacacccttgacatattcagaggcttgaaagaaaatgggaagaataactttctctttcggtgtaatttaatgctgtctctgttctccctaaaatcacctgcattttactgcaaccacccatttattactcaacggcgctagatgctgccagtaaaccaatggaccagataagcacagcctctgcccctacagactctcagtcggctggaggaaaaacataagcaacctgggaatggctataaaatgtcattgcttaagaaaatagtttgtggccgggcgtggtggctcacgcctgtaatagcaacattttgggaggccgatgcgggcggatcacctgaggtcaagagttcgagaccagcctggtcaaaagatgagttcgagactagactggccacctcttcagtagagctggtgaagccccgtttctactaaaaatacaaaaattaaccggacgtggtggcatgcgcctgtagtcccagctactcctgaggctgaggcaccagaatcgcttgaacctgcctgggagggggaggttgcagtgagccaagatcacgccactgcacttccgcctgggcgacagagcgacactcagtctcaaaaaaactagtttgtgttttggagcctctcacttctccagcgtccccgatacgcccggggattgcagagaacccacacctattcgtagattatgagagtaggagcaaattaatgatttatagtcttttcaaatttttttttttaacagaaaaagagtagggagttgaaagtaatgctgtttttttccaggcactcccggggacccagcgcggcgaagcccgccaggatcgcgggcgacctgtggcagctctggttcccccgcccgggcccggctcgggttacgctctgggcggggactccgcagcggctccctagttagggggcgccccggtgggttccagctttaggggtcgcaggagcggctctggcatcacctcggagctgacgaagcgggaagagccccgcaccagtgctgcccctacagagctctcggcggggggtggaggtgaggttacacctcgtccctacccccgccttcccctccgccgcagggatccgggacccgcccccgcggagaggacggggggctgcggggaggggctgtgcggggagcgggcgggttccgcaggcccctaggtgggcgggcccgagccagagtcgagtccctgaggcgggtgggggaaggagagacgggtggcgcgaccctctgtccccgcctcgggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacaggtgagtgggcccgggtgcgttgcaagtggccgggggcgttgcagacccgctccctgaaggcgctccgaggctcagagaagaccggatcgaactacaattcccatcagccgactccctcggccgccggaaccggggtgatgggggttgtagtccgctccggagggggtggcctgggaggcgggagggcctgcggaggcgggtgcgtcctcggggtgaccttcccaccgatccccacagctaccacctggtcgggatcagcttcttcatcctggggctgggcaccctccttccctggaacttcttcatcaccgccatcccggtgagactcctggcggcgtggcagcctcgtggccacagccagcacccctccctccagccctttggatgaagcttagcgggcgcttcctcaccgcgcacctgtgacccctcgttgagctcattatgggctgaagctcggagaggggaatgcttcccccgtggctaggaaagtagaacttcagcaatgcccacatctcagaggggcaaggccaccagcccacagggtctggaatgagcaaaggcgctgccacccctctctgtgtgtcgttattcctgagtcagtcaccccaaaagtcggttatcgaacgtttgattttctttgaaataccatgaatttcattcattcactcattcattcaacaaactttttttttttttttttttttgagacagagtctggctctttcgcccaggctggagtgcagtggcgccatctcggctcactgcaagctccgcctcccgggttcacgccattctcctgcctcaccctcccgagtagctgggactacaggcgcccgccgccacgcgcggctatttttttttgtatttttagtagagacggggtttcaccgtgttagccaggatggtctcgatctcctgacctcgtgatcctcccgcctcggcctcccaaagtgctgggattacaggcgtgagccaccgtgcccagcctcattcaacaaacttttaatgtgcatctactgtggagcaggcactggggacacaggaggaaacagcagggaggctcttcagggaaggcagaaatgtggggtttgcattgtctttgggaccgggttattcatctgtattcactgcaacaactttgcaaatgcttcttgggtactggctctgtgctgggccctggaaacccagagatgaatcagcccctgggcttgagagcaagagggggccaaagagctattaataatgtaacatgatgcgtgacattccaggcttgcagcagagtgcagtgggtccccaggggagggagaaagttccttctgcttcatggaagaggagatttgtaaattgggagtagggtaggcaaagtgcatgtggaggggtgtggtcagtagggcattccaggccgaggcgacagccatgccaaaggcaggcaggcaagagacgatcagcctgtttagagggagatccacagccagggctgcctggagcttagcaggatggagcagaagatggggcacaaagggagactaggatctgattctgaagagctgttccatttggggctttgccctgcaggcaatagggaggcatgaatcggggtgttgaggagtgaggaggttaagcagaggagtggcaggctatgtgctctagagagaatgcagttgttcagcacctaggccaaagcctggctgacagtaggcgctcaataaatacccgtggaatgaatgaatgtagcagctgctgcaggagtggggatgggggctggaaccagggcactgaagaggaggggccgtccaaggctggatcgaggctcttgctgggggctcttaatgcttaggctgtgtcccagacttcagccatttaactcagcacacattcatggagctccgactgtgtgccggctgctgggaacagaacaaggacaaggcagacaagtccccacagacattagaaagcaatcacaagtgagggggaaggcagcgggggaaggctgagaggtgctgaccctccaccacctccccacctggcagtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtggtgagaggcctgccctggctcctgcgccctctgccgaggcagcttcattgaggccctcccctgcgccccctgccccccagccctactgcccagccccaggtgtcgagcctccttccccagccccctctggcctgggccccactgatgcactctgcctgcttctgagcagcgtcccggagacggtgcgcattctgggcagcctgctggccatactgctgctctttgccctgacagcagcgctggtcaaggtggacatgagccccggacccttcttctccatcaccatggcctccgtctgcttcatcaactgtgagcacctccaccccctctccagccagcctatgcagggcttcagcctggcctcatcattgaaagggcccagcatatccgagaagggcagacagcatcatggtcgctcatatccctggtgaagaaactgaggcccacagggaggggaagagtcacttgtccggtgacctaggagcaggcctcctggtcaacagccccacagaccaatggctgcacctcagaagaggactgaatagcgggtgttgcccccgagtgctcagagtccctagggaagctcacacctgcgcaaccttgtccagagtcccctgtgtatcctgccggcacctcctccagggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtgagtgcacttgggtggctggagggctggggtggcctctgaggtttggggaagagagagggcatgtgagagcaagacacatgggttctgggtgaagatggaggtaagcaggtgatatggaaatggggattgggtctggggctagggagtggggctcatgggccctgcagtgaggagtaataaccaagtgaggactgggttaactcagggacaggggcaggattcctggggctaatactggcatgtggcagcaggttgaagttgaaggataaggggatgggtttgggattcagatagtcttgggtttgaatctgcttcaccgcttaccagctaggggtgttggacaaggcttgtcacctctctgtgctagcttccccaccgacgtgattggtatagctccctgctcagattgtaatgagcatgcaatgagagaaggctactggcacatagtacgtgctcaacaaaaatgacacatggggaaagtgagagaagtgcagggctgctctggggccctgtacaagattcccatttgtcagtgaagggaggagcggaagaggctgggagtgggtctgagaagtacacaatgggaagtgggacaagagttggaagccccgtgggagccggcgggaccaggtgcctctcttctgcagctgaagttcctccgcaggtggcgtggacgccgagacctctgccctggggtactttatcacgccctgtgtgggcatcctcatgtccatcgtgtgttacctgagcctgcctcacctggtgagcctgctgttgggctcgaggccccacctcaaagcatcttggatagagtcctgagcctgaagccctgagagaggccaggggaggtggaggagacctggtctcagccctgacccccagagaagacactgaggggccccagcctccaggccaatggtatggggagggatccagacacctcaggcaagccaggcaggcccaacactttcctgtccttctgcagaagtttgcccgctactacctggccaataaatcatcccaggcccaagctcaggagctggagaccaaagctgagctcctccagtctggtaagccctgagaccctcctggggaggtgggagatgcagaggaagctagagccacctcccctgggaagctgttccatctgttcccagccagagcccacccctagtagccttgtgcaaacaggaagatcatgaagggaagttggtaggattaaagtcatccctgctgttgtttgggcctcagtttccacctctataaaatggggaggcgacagaggttccatgcatgcaaactttggatccgaagacctctgaattggaatactagtttcacaacatcccagctgtgtggcctgagacaaaccacttagccactgcacccctctgaacctcaatgtgtcatttgtaaagcaatggtaatgagataatccatctaaggtgcttcgctcatcacccgacccatgcacgcgcttcctggtagctatgcatatttccatcatgaattcccttcgcctgcagcctcagcttaggctggaggaagatcacctttttttgttttggggtgagggggttgttgttattttgagtcaggatctcactctgtcacctaggctgcactgcagtgctatcacaactcaactgcagcctcgacctcctgggctcaagtgagccacctcagtctcccgagtagctgggactataggtgcaggctgccatgcccggctaatttttttatttttgtagaaatggggattcaccatgttgcccaggctggtctcgaactcctgggctcaagcaatatgcccgcctcggccttccaaaatgttgggattacaggcgtgagccaccatgctgagctgaggatcacttgttttaactgctgggaatctcccttcgttgggcctggctgtcgggaaacctgggtcacaagcatgacccttccccgtcccccctcaccccagatgagaacgggattcccagtagtccccagaaagtagctctgaccctggatcttgacctggagaaggagccggaatcagagccagatgagccccagaagccaggaaaaccttcagtcttcactgtcttccagaaggtttggcttggatacagcccccaaccaccatctttggggaagaatggggctcacattgactccaaggtcatagggtcacagtgggtcagggacacagctgggccaggccccaagtgtcctgctcccacatggggcttgggcaagagggtggggccctgggactgccctgcctgctcacacccctgcctctggctcccagatctggctgacagcgctgtgccttgtgttggtcttcacagtcaccctgtccgtcttccccgccatcacagccatggtgaccagctccaccagtcctgggaagtggagtgagtgtcagggtggagaagacggcagggcagggggtacaaaggggagaggacgggagaggggagttggagaccagtatgagctgcagccgtttccctcccaggtcagttcttcaaccccatctgctgcttcctcctcttcaacatcatggactggctgggacggagcctgacctcttacttcctgtgggtaagcacaccagggctgggtgatccgatgttttaggaagcagtttgggatccgagggcttgaaagagcatggaggtgattttctggtagtccaaatggcctggtaatgcaaccactggccaagcagcagggagcacttgggccctggaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtactgtatctttaaatgaaatcttccaaagagacaatacataacgcaggtgaaagaggagctggtctcatccaagtcaggacaggagctgatctacagcttccaatcccactcagaaaccccatctgcccccaagggggtctgtggaaccaccagtgggtgctctgaggaaccgagtacgtaaactgtagatgcggtggagagcacaagctggagcctgggagaggcagaggtgagccccaggccagtccctgatttctgggtggacttggcccaggccccagtgctgggtcctccctcactggctcacaaggtaggtcaggtcagaggaggtcagggggtgacagatgggtctatcctatgggtgggccaggcgtggtggctcacacctataatcctagcactctggggctggacgcggtggctcacacctgtaatcccagcactctgggaggccgaggcgggtggatcacgaggtcaggagttcgagaccagcctggccaacatggtgaaaccccgtctctactaaaaagataacaattagcaggtgtggtggtgcacacctgtaatcccagggaggcagaggctgcagtgagccgagatcgcaccactgctctccagcctgggagacagagcgagactctgtctcaaaaacaaacaaacaaaaaaaaccctaaaatccgagcactttgggaggccaaggcaagaggatcgcttgagctcaggagttcaaaaccagcctgggcaacacagtgagactttgtctgtacacacacacacacacacacaaatttttaatgaagaaaatagaggccgggtatggtggctcacgcctgtaatcccagcactttgggaggctgaggcaggtggatcactcgaggtcagaagttcgagaccagcctggccaacatgatgaaacctggctctactaaaaatacaaaaattatctgggcatggtggtggcgggcgcctatagtcccagctactcaggaggctgaagcaggaggatttcttgaacccaggaggtggaggttgcagtgagctgagatcagggccactgcactccagcctgggcaacagagcgagactccatctaaaaaaaaaaaaaaaaaaagtactctatgggtgtcctgagatgccctggagcagagacctggctccagggaccatgctgacttcagcctctaccacagccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggtccggggcaatggggtggggtggggggctgggagtagggaggtgggttcagtctttgggaagggaccgcctgcaatggagggacggcccatcctgcttctggccagcccaaccctagctgtctgcaggccttgctggcgccccctactgggccaagccttaactgcaggggagagaactgggctagggaggtacccgcccaaccaagtagcccaggcactggttctggggccgcctcaatgtgcctcagtttccccatctgtaaaaaaaaatgggttgaactgtcatccctcagggcccatctaactgtaaaattctcagttgaaggagagctaaggttttgaccaaaaacaaggtcatgggctatttcctcaaggggcaatggagtggagaatccagagagaatgaagctggcagggcagacaggctgagagcactgtggaaagggcaggctgtggaatctggaatcccatcatgttagactcagaggccctgagagacatccttatccagcagcctcatttacagaccaggaaactgaggcccagaaagaaggggccagttatggtgacagaggggttgggtcagagcccagactggatgggcagagggcagtggagctgggtccagatttagacccagcattttctaagagctcctgttcccgggtgttctaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgcggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcagggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagccccgctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgtatgatgcgttcaccaagtctttatttccgaagtgctgttggctctattggcctcagtgaactgggtggggtcggaaagattgtacccccttgacaggtgggatgactgaggccctgagaggggtagggattggtgggcatctctgtgctgggtcctctggaccacatgatagctggggggtactgacctgcaaggaatcctgagctcctgggcagagcacctagttggatggacaactattgctctcccactccatgagcccctgggctctcaccagcatcctctgcctccccaggatagctcctccttggaaatctggccttagagaggcagtcagtgtgggcagggctttggcgaccccaccaattctacacacggatggaggaaaggcctgcttcaccacacacctatactaccctgcccgtcccagagaaaagcaagggttttctgcccacctgcctttgtgaacattcactgagcacctattagatattaggtgctcaggcagcacagggtacctgctcagaagccaggggctttttggcatcaacgaggaagacaggcaagatatgaccttggttgctgaaataagccacagggcagaccccaaggaaggattcattcctttgagcactgttcacagacagctgccccgagccaggccctgcctggtctggagactttgaaacaaaggagacacagtccccgctcccaaggccacaggaagccaaatataacttgtgatacgtcttgtgagggccctgcagaagcatgtcgagggagccactgattccacctgagaagtcagggcagccattccagaggaggtatttccccagctgggccctgagggatgaatatgagtttgctagtctgaggtggaggaggagcagaagcagagaagccacagaggagttgatcccagcagtccagcggggaggtgatggggcctagacagtggcttagagaggacgactgatacaggagatatgagggagactgcctctatggaggccagctaacctcgtggataagtgcatgcatgctgagccagagtcctaggtcaaatccaggcccttttctttatgacctgcctgagctagagtcctggagtgaggttggaactaaagtaccacctctgatgatattagggaaacggttgttggagtcttggagtctcttgcaagaccaataggcctacctgtgctctctgggactgttggaggcaggaccccaacacttgctgagtctccttctcctctaccttcagaggagagtacaactgttgt

SEQ ID NO: 13083 - DNA, 13145 bp, Human
  misc_feature (1)...(13145): n = A,T,C or G
tcccacagcatggtgctaacgaacagccactctgatttggcatctcctttggccaagttatagagtagagagagtttccagggctggggatggtagtcccacctccccactttgtctgtggctattctcagaggatatttctcccttgaggcactcctgatggttgtattcttgtgattacagcactttgggaggccaaggcaggcggatcacttgagctcaagagtttgagaccagcctggccaacatggtgaaaccctgtctttactaaaaatacaaaaattagccaagtgtagtggtgggtgcctgtagtcccaactacttgggaggctgaggcaggagaatcgcttaaacctgggaggcggaggttgtagtgagccaagatcatgccactgcactctagcctatgtgacagagcaagactccgtctcaaaaaaaatacagatcttgtgtgaactaacagaataagaactcacttgttaccgtgaggacagcaccaagtcattcatgagggatccacccctatgacccaaacacctcccaccaggccccacctccaacattggtgatcacattttaacatgagatttgagactgagtaacaagtgttaggattaaaggcatgagccaccgcgcccggccatcttctttacctctccactgtgtcagttttatttttctcttcttctctagacactttgttcctcaagatagggggcagagtgggaaaatgaccatagtcagaatctatgggaaggacccacccaaaaggaaaaggcttcttgtgcccaggctgcagatccaaaccccagggaaggactctcattggttcagtctccattctgttccaggtggagcataatgattggtccagcctgactcgtttgcccatctcttaaccatcaacatggtggggaggggacacgcaggagactgtcagctcctatcctaaacgggggagggggcaggggtgatcattttctgagctcctataaacaaagtttcagttctttttcctcctatggctggaacactggaataaggaaagaggtcgtctgtctggagaggctggttggggagtatggtctccccagcccagccaagctcaggtccctgcatacagcaggcgcctaattgatgcttatagcacgaatgactgaatgaataccccgttcccacaggctgtcctgggatggtcctaatttcacagaccctgagcggatcaagaatgaagcgggcccaggggtcccgcccaccggctgagtgcgtcttaggacgcagagacaagaccacggagggcggaacctctgagcgttaggtggcaccttggagaccccgccacctccaaaggcccagttaggggcggagcttctaaaccctagcattttggattgaaccatcgtccgtcggttaaaggggagagccgagaaagcccttctgcatttgtcgccagcctttttaccacctcctggccacagaaacgacgtatttgcttctctaacggcgacgccgtttcccccttcgcctcgttactcctcaaagccccacgcggccacagagttcagacttacccaccaccaccttgcagtggctcgccccagtttgacgcattgcagggaaggtcggaccaatgggcgccaagctctcatttccgccatgggccaggcccaatagtgacgcggctcacagagggacgcgtcacgcaccgccgagctgtgcccctccgccgaagaaagtgaagtgggcccgggaggcggggcgcgcggcgagggaaagtagtccggcgacgggagcgagcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggatctggaactgctgcagctgctgtcgccgccggaggaaccttgatccccgtgctccggacaccccgggcctcgccatggtgagtgaggctggggggtcgccgaggctgcgggctctgaggcgggcttaacggggcaggacccctgagggggcgacagagcccagagtggggggcgtccgggcccggcgagagcctcgggacccttttctacccgcgttgtcgggggctgttgaacccagagcgggacgtctggatcaccagaggtttccagaagcgactttagcaccaaatgggatgtttaagtccacaaatgggtatctgagcccctaaaggggacatttgaaccccggatggaggatcgggaccctcagtgggacccctcaaaaggattttggacccaggatggggcgttgggtttcaggatggaggtgtttggaccccaggggacgaaataagaaagatgggctggggaggggagctattcgggccctgatgaaggcgtttggtcctgagaggatgcggggaacgggggacgaagggaggctgggctgctcctggatggggtggtggagggtagctgggcccgggcggggaggggcgacccctgggctcctgtggagcagaggagagggtcaaggatgggcggtcacttctacagatgagactcccgagggtgggggagggtgggggagggtggtctccagagcccagcactgcagaggaggaggagggtgaggtgcaagcttatgggaggaagagcctggggtgggtggcagcggagattagaagatactcttgaaggcttccgggacggagaaggatcagggtcgtggaggtggtgaaaagggatggtgagagtggggctcgccagtagtcgggggacagggacccttggggttaatttggaagtagctagaaaaggttccgaggttactagtgggttaagactgttgctctagaaagacagaatttttttaacggggtgggagtgttgtgtttgggtccaagagaagatggatttccaaggtgaggggtgggggaggacttgggcttgggtggttgggaggtgaggtggaaggagaaaatgaatggcagtcaggggggcctaggtttgggggtggatgtgggtagcaccctgccagtctccagggacaggccaggacaaagacggctcagtgtggatggggagtgggctgcagggcccggaggaagcttttctaccgtcctccttcctcaggaagaacgcggctgggtggaagacaccggggcagtgggagcaggtgggcggagctgttcgggcccctattgcgcactgaagcctcatgaaatggggatgggagatcaaagtttggggtgcctcgaatgagccagctttttcaagcctagaagcctcactctgtcgctgcccttttcaggccaagagcactgccttttcccagcaggagcgccggttttctcatgatccccagccccacgcaccatgctgcacctcgtcacttgtgccaaatgacagtgcagtacagtgtggcgtcagtgacaatcagatgcctattcccgtgccctcggggtgggggctgcagagcttgatcagagagtgcctctggggagaccccttgatcggcctgagggccacttgttccattcagggccctcgctgagcgtgtctgttaattcacagggctttgagagaaaaccagcagactagttctttcctactccctgccacccacaacacccacagccccaccaggctgagcctgggaaccgtgtgcagccatcctccctggcaaggctggggagaacaggcagccgctgctgtgtatcagatctcatacttgctgacacagacctgatggctcctcttgccgctaccccattttcccccagcagaacctggctaaaaggggccctgaagcactagcaggccccctacctccagaataggacccaagctttggccacaactagtttctctttctgtttgtaatcagcaaggtagaggtgggacaagtcactggtaactggccttggactttggcctgagctctgtggctcctccttggcccgggtgaggggccctggccttggtttctgatctcatctaacactgctctctggcattggctgggggctggggcaaggcagagaaatcacaccctcttccctcccccacctcatggttttttttcttgtccagccccttgctggagcctaagatgagggataaggaagcaggagaccagctgagttattttggaaacagtttttgttgaaagtttagtcttcaggtctagaaagggaagaaaccttgagcaaggatcaatgatatcttcttaggcggtcggttttctgggcggcaaccttgcttgagatctgtacctttccttgaccaagcagggaagtgggtctccaacatgggagggagagcatctgacaggccctccatgcagagccacgcctatttgcagcaaccctgtgacagaactgaacatggcagtgcctcatctgcatcttccagtcttttggtggagactggcaaacggtggccttcagagccgctcggggcagtctgcagcctgtcacagcctcctcgcccccacccccagccccttacagtgctgcccaaaggtccggggagctggacttcttgcagggcggaacagtgggctgggaaggccctgacctggctcgctttttccattctaggccaggggaaagaatgaaaagcagatgggatggcagccacctccccacactgctgccctcctctctgttctttccctgaccctccctgggcattgcctggtctcggtaaccagaagcccatcctcccttctcactttccctaagcctcttcctcaggtgtcaggacctaagggatggctccaggcttttttgtccatggtgggaggtggggggcaggtggatcaagaggctcatgggcctggggctaccaggttggcatttagaagcccaaccaccctgtcttttttgaaggcaatgcagaagaatcttcatttggcctccccacctcccctttacactttggacttttccagaatgtgcatgtgtgccgttttctcccttcctctttccccctccctaagccctctcccctctgtgatcatcattttgattacccctcccattctgcctatttggggcttgcaagttcttcttccgttaggtttttttttttttttttctaacttttttagatcagtgattgttaatatttgggacggggatgggggtaggggaggcaggcagtggtttgttcctagcttctggaacctctccgtagaatactgcaaattcacataatagtctgcttctatttctgaggctctcagactcgagactagaacatgctatagacttggagcccctttccctgattgtgaaaggaaggggaacagacccaccatggtcccgggatggtggtgccttcttcacagcatcaacaaaaaccagggaaaatgtgtcttttggctgctaaagctaaatgttgggattcagcctccccaaccccccagccccgctcctgccccataggatcactatgcctggctgatgcccagcacaccagtgcaggagaagccagtccccgcatctcctccccacccccaaaccccgcatgcagcaagggctgcctgccacccactggccagtccccagagtgcccaagctggaaagggttaaaaactgcagtgcaagccagcttcagtcctctgctgctgcccgctgcagccctctccctgacgtttgtcccttctgcccaaaagaaacaaaacagaatggccctgtgccctcactgtgcgcagggggtggagcgcctgcctccagcctgaccagagttctttaggtgcttgagcaactcgggccgccggttaggagaatttttgccacttgggtggactctgcctgagccaaccgcctccaaataggtgacacagaaactagcagagatagccccagacatcgtccctctgccctacccaaggactggcctgcttcagtttggagccttctagagcttcttgatgaggcctccagggcaatcgttcccttcactcggcctctggggctctcactgatgagatgcaaacctgtgccaggcctcaccagcgctgctggtttggggctggggcaggcttttctcccgcccctgtggctcccacatgctgagttgagattggaagcccgtgggtctgggcagcttcatcgggccgtgcgtccagcaggcctgagtgtccagcccaccctggtacccagctttctgaatcaccagactttatcatcaggcgctggctctgcctcagaccctgactctggcatgctcctccctggcccggcgggaatggcacgtggagctggcctcactggggccgagggcctgggctgagtgaggaagatgcgtccgtgctgtccggcctggtgactgactttccccttcatgcttttacaggctgaccagctgactgaggagcagattgcaggtgagtctgctatccccctcatcttagctcaggaaagcctccacatccccagccaaatcttagccactgaggagtgacatctgatgggtgaacctgtgtatcccttgtgtcacctaacactatgccttgtgcctagaatgctgataaatgtgtgtaagagcacaccagtgccccaatgacacgaagccccatggccctgagacaggcctttaccagacaccaaaggctgtgttcctctcctgggcctgggtcatctaggggcttgatatcagtggctgcaggacgagcccaactctctctcccagcttcagccaggttggcttagaaggtgagctccctgcctccctgtggggcctgcagagctcctgtcccactttaggagccgcccaggagctggctcgtcactcccacctctgcgcttgcctgcgctttgcacttcctttcgcatgtgcctgcgcctgcctgttctgctggcggaagtgcctccccagtgctttgcatgggcagctccttcccgtcccttagctcagatgtcccctcggggaggccttccctgacccccatctcaagtacacagccttcctttactctccttcacatcactttattttcttcataacctttctcgctgtctgaaattattttcttatgtcttcacctgttgtatctcctgttactagatgtgagttccattgagtttgggacttggttttgttggtccctgctatagccttaatgcctgcctagaacgtagtaggtcctccgcaaacttttgctggctaaacaaacatctctctctcagcaagctagaagaaatccctggatcccatctaattcatttttctaacccctccaaaaccccagaagggtcagctacaggaactattgtgtaattacagatccgtgcctgcctacccgcccatactgagctgcccgaggacagagagcaactcttggtttatctccatagccaggggccagcacacagtagaccagagtagcgatccagagaatgggcctctgctccccaccagctacccagcccccagctctgctgtcaggttcaaccggctgtgtaacaagtactaaaggcccagcttctgcggtgggaggcaggaacggacttgccttctctcctttctcccctcaacccgcatcacagagtcacctttgcagcttcaaaattttggccctgggtggctatggagacccctgaggaaagccagaagatggcctggtttagtgatcatgagctcggggtgccccatgacccactcactacctgccctccccaagaacaacaaggcctcagcacagggaggtgccagcctccccaaagagactcttgccatgtccccagggcccagaggctcagggccacagcttcccagctgtgcatgtccctcccaatgcacctgccacccatctcccaactctggccttgtgcaacataaacggtctgcttttcaccctgtccccattagcaaactgtccaccgcctcaccccagcccacaccctctgggaataggctgccggacatctgtttttggagggcttgggggtagaggagcaccaggtgccaaaatgggcccagtgggagggcaagagccatgtgcttttctccctgcccctgatgcggccccagctgtggccttcccactcagcactgctagctcctcatcctcctggcttggcagccgtcccctcgctttccatccccccatccaccccacgcactgtccgtcagccatgttctgctgccgaccacccccacgctcaccacacgcagtggctcagctcctttggaagctggtagcacccacggcaaggaacagggctgccagtcagaagggagtggatgcctgcatttcctcttcaggccggccagaggcattctgcagcctcccctcctcgtcccagccagccaaccctggctaacacactcagacaaagaatcctttcggctctcattcactccatgactttggttcatttcatcatttcagggagaagtcaaagccagggaccaaacagaaatgtagaatcatctaaggacagctgtcagaccattttccccactgtcttcactggctggccagaaaaatagcttcacctagcacagtgttgatgttcaataactgttgaatgaaggttggaagggctttgccctgagcactgaggagagagagctggttgcgtgggacttgaagtctgtctcagtttctttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagttggggacagtgatgagatccctgggacagaaccccactgaagcagagctgcaggatatgatcaatgaggtggatgcagatggtgagccccacagagcgcgtgggcagccctgctcctggtcaccccgagtgactgcagggagcctctctcagggtgatggatgagcccgtgtctctcagggcccaggccaagagcattctccatcctttccccaccttccagggaacgggaccattgacttcccggagttcctgaccatgatggccagaaagatgaaggacacagacagtgaggaggagatccgagaggcgttccgtgtctttgacaaggtaagcagccctctccaggggcggctctgagactgacgccagccttcaggcagacaggcggaactggagccacggagctaccacttccaggaggtccgggtcccggtgccagcctcattgccaacctgctctgccacctcaggcagcctccctcactgtgctcactgctgagggatggtgatgacagccacccctctcactgcctctctccccaccgggagaagtgcccagtgaaaggctttatccccaacccccaggatgggaatggctacatcagcgccgcagagctgcgtcacgtaatgacgaacctgggggagaagctgaccgatgaggaggtggatgagatgatcagggaggctgacatcgatggagatggccaggtcaattatgaaggtgagtcaaggccaggcttgatctctggaacaagaagagaatcgcagcttcaggaacaagcccccagatccctcttgttggggagggccgctcgccacttagcctgcccgcctgacctcctctctctctgcttcactccacagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13084 - DNA, 49309 bp, Human; identical to SEQ ID NO: 12680
  misc_feature (1)...(49309): n = A,T,C or G

SEQ ID NO: 13085 - DNA, 4769 bp, Human
gccaccgtgttccagcctgggtgacagagaaaccccatttctaaaaaagagaaagaaaaagggataggtacaatggctcatgcctgtaatcccagcactctgggaggccgaggcgggtggatcacttgaggtcaggagttcgacaccagccttaccagcatggtgaaaccgcatctatactaaaaatacaaaaattggccgggtgtggtagcatatgcctgtaatcccagctattccagaggctgagacaggagaattgcttgaacccaggaagcggaggttgcagtgagcccagatcgtgccactgtactctagcctgggtgacagagcaagactcagtcttggcggaaaaaaagaatgaaaaaatttaaaaaactaaaaaagaactgtaggctgggcgtggtggcttacacttgtaatccaaacgctttgggaggccaaggcaaacggatcacttgatgtcaggagttggagaccagcctggccaacatggtgaaaccccgtctctactaaaaatacaaaaattagacaggcatggtggtgcatgcttgtatttccagttactcaggaggctgaggcaggagaatcgctcgaacccggaagacagaggttgcggtgagccaaaattgcgccatcgcactccagcctgggcgagagaacaagaccttgtcttggaaaaaaaaaaagaattgtagaccatttgcttgtgttctttctccggggatcagatctcaccctctttctgccgtacttcctcatctcctacgtgtggatgatgatattgtgccctgtgcatgttcttcgtcaccaaaagtgcctctctcatagagcaggtgagaactcagtgaggagatgcagggacatgaggtctgacttagggcagagccctaaggtaacacatttgatctactgtaggtccttaatggtgtctgcagagcacctccctgcactgactcagccttagcaaagggcagaggctttgctgtgttccctgctgggcccagaactgtttaggtgctcaagaaagccttctaggctgggctcagtggctcacacctgtactcccagcaccctggggaggccgagatgggaggatcgcttgagcccaggagttccagaccagcctgggcaacaaaacaagtctcccatctctacaaaagaataaaaattagcagctgggcatggtggctcacgcctgtaattccagcactttgggaggccaaggcaggcaaatcacttgaggttaggagttcaagaccagcctggccaacatggtgaaaccccatctctactaaaaatacaaaaatcaggtggggcacagtggctcaagcctgtaatcctagcactttgggaggccaaggtgggcggatcacgaggtcagaagttcgagaccagcctggccagcatggtgaaaccccatctctactaaaaatacaaaatattagccgggcatggtggcaggtgcttgtgattccagctccttgggaggctgaggcagaagaattgctagaaccctggaggcagaggttgcagtgagccgagaacacgccactgcactccagcctgggtgacagagcgagactccatctcaaaaaatacgaaaacaaaaatcagccgggtggtggcgggtgcctgtaatcccagctactggggaggctgaggcaggagaattgcttgaacctgggaggtgggggttgcagtgagccaagattgcaccactgcactccagcctgggcaacagagtgagattccatctcaaaaaagaaaaaaataataattaaaatgttaaaatcaggagtagaatcacagaatgttggaaagtgaggcccaagaagggggctgtgtccaagtccatgcatgggaaacttgactgggacaccgagctcacacagagcaggatctcagtcccccccaccagagtggggcgtgaccacaggaacagccgcctccagtcagcctgccacatgacaccccctcaatgttccaggtctctggacactatgggcacacgactcctcccagctctgtttcttgtcctcctggtattgggatttggtgagtgtgggcttccggggagggaagccttggggaggggaatgagctccaagcatcttcccagcccaggcccttcttacctctgcctctgccctctcctcttcttccttcctcctttccccctgctgcagccccacgggctctcctgacacactctccccctgcagaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggtagcacctgcccctggagaaatggggtctggcccataccaccgactgcatccaggacccagaagttcaggccccagcccctcctccctcagacccaggagtccaggcctcagcccctcctccctcagacccaggagtccaggcccccagcccgtcctccctcagacccaggagtccaggcccccagcccctcctccctcagacccaggagtccaggcccccagaccctcctccctcagacccaggagtccaggcccccagcccctcctccctctaaccatctgtgctttctccccagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacagcaattagagactaatctttattgaagtccggctttctctcttttatttttttattttttgagacagggtttcactctgtcacccaggctggacagcagtggtgcaatctcggctcactgcaccctccgcctcccaggttccagcgattctgtgtgcctcagcctctggagtagctgggattatgggcatgtgccactgtgcacggctaatgtttgtatttttagtagggttttgccagttggctaggctggtctcaaacttctgacctcaagtgatccacccgcctcagcctcccaaagtactggggtgacaggcatgagccaccgcgccatgccaaaatccagccttctcatttgtaaaataacaaatcatagacacagctagtccacagtggcctctgacagtctccagttgttaacggtgaatggtgtccaggtttttggcgtcctgaacaaagaactggacaaaacgcacaaacaaagcaaggaaggaatgaagggatttattgaaaacgaacatacactaaacagtgtgggagcgggcccaagcatatgggttcaaaagccctgttacagaatttttgggagtttaaattccccctagaggattccccttccactggttacttctggtacaccctatgtaaatggagaggatgaagaaaagttacaaagtcatttatggcctaccggagaggatgtttcctgttatagctgaagtgaattggccttatgttccctgcctccctattttcctgccttacagttgctggactgacacattttttattttatttattttgttttgagataaggtcttgctctgtcgcccaggctgaagtgcagtggtgagatcttggcttactgtagccttgaccttttgggctcaagagatcctcccatctcagcctcccaagtagttgggactagggatgcccactgccacacctggctaattttttgtatttttagtagagacggggtttcgtcaagttgcctaggctagtctccaattcctgggctcaagcgatctgcccaccttgcccttccaaagtgttgggattacgggtgtgaaccaccgcaccaggcctgggctgacactttaaacgtgccattgcaatcagtgtataatggtcccgtggcagagggagaatggtgcccaagtcagtacttcttggctgggacccaagaagacaaacctctagggccggcgtggtggctcacgcctgtaatcccagcactttggttggctgaggtgggcagatcatctgaggtcaggagttcaagaccagcctggccaacatggtgaaaccttgtctctaataaaaacacaaaaattagctaggggtggcccgcgcctgtaatcccagttacctggaggctgaggcaggagaattgcttgtaccctggaggcggagatagtgccactgcactccagcctgggcagcagagtgagactccgtctctaaaaaaaaaaaagaaaaacttattaaaaaaaaattgcaagcaaaaagcacagaaggcagaaggtgcaaataagcagaggctccatggtctgaaggaggccagtgctgggaccatgaatgaagggggctgggggccaagattcctgtatcctgagggagtccagggtggtactgctccccaagtcccatgggtggggctattggtctctggggatccact

SEQ ID NO: 13086 - DNA, 17740 bp, Human
aaacagaagactctgacaaatacagctgggaagaccatgaaaagagggttctaatggttgtacacctgaaaaccaaaagtaccatgaaagacggtgaaaaccacaaccttgagcaaaggccattgcaactgaacacaaaacatactctgcaaggacctctgaacaactgcgtgtccaacctcagactaacaccactttcatgattgatctttggagccaaggctaattatttcaaagcaattagataatcctcattttttccttgaaaagttttgtcttcctttatttccccaaatatacacatagtttactgtggcatgcatattcccattgcagtgctctattcccagagaaatatttttcttgtagggaccctctctctgttatttaggttgacagtcactaaggatttactatttcaacaatactagcactgcatgtcatccagtatacactgggaaaataaagtgccgcaagtgcatatccaggagactttgtggccaccagattatgaggaatgcatgtatttaattatttatttttgggacagagtctgtctctgtcgcccaggctatagtgcagtggcaccatcttggctcactgcattctccacctcccaggttcaagggattctcaggcctcccaagcagcggggactataggtacgtgccatcatgcctcgctaatttttggatttttagcagagacagggtttcaccatgttggccaggctggtctcaaacccctaagctcaagtgatctacctgcctcggcctcccaaagtgctgggattacaggtgtgagacaccatgcccggcccatgcattattattaatgttgaagtagataatttaacaaacatcaatgaagtataagatttttcactcatagttgcaaaatatcatgccaattgccttctatgagctgtcataagccacagcctagagattcaattccatttcaagattcaaccaaagccaactcatcaacaagaacatgtaaaagacagaaaaacccactaccggcaggctgaaacagatgctgtgacgtggccctggcctgtcatggcgtgtcacagcatggcacaggcctatatcatgttccctagattgctgactaccaactagttacagctgactccaatcaggtcgggatttgaccatctctgcactgaacctgcaattgcaacttttaaaattgaaacgctgcttctcacctctcctccctagactctatttcacagaggaaaccatcacagggaaagcaagcccttgttttttcttccttctttgctttgctttctttctctccttccttctttctttccttcctccctccctccctccctccctccttccttccttccttccttccttccttctttcctttcttccttcctgccttcccttctttctttcttttttttgagacagggtctcactgtctgtcgcccaggctggagtgcagtggcatgatctaggctcattgcaacctccgcctcccaggttcaagtgattctcctttctcagcctcccaagtagctgggattgcagatacgtgcccccacgcccggctaatttttgtatttttagtagaggcagggtttcactatgttggccagacttctttccctccctcctccaactcttcttttcttccttgctgtctccctccctaccttccaacttttggctgtgttgaatttgttgactcatcctgaacaagcagaaactccaatgatactgtcacctaagagagaactttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaaggtaaatatgcaaatctttgcacacccttcttctctggaggggcgtttgggtgttttctctttctgcattcagccaggaaagcctggaggtcgggcaggggttggagaggtaagattcagccctggagccaggacttaggttgctttcttttctcagagctgattcaggctgcaaagctccaaggctggctttcccagcagtgatgagagcttctctagcaagtatcaaatttcaagcagctgttggacttaaaactgttttccagggcagtttctctctctggttctaggacacttaattgggctcaacgtttcccccaagtcttggctgtgggtttgttgtgggctgggtggttgaggagaggatgcagagcccgaagtccttggcacccctttgcagatcacggtgtgagacttgggctagcagcatccctatgacctggaaacttgctagaaatgcaaactggccaggtgtggtggcttatccctgtaatcccagcactttgggaaatccagacgggagggttgcttgagcccaggagttggagaccagcctgggcaacatggcaagaatccatttctacaaaaaataaataaattttctgggcatggtggcacgcacctgtagtcccagccacttgggaggctgaggtggagattgagtgttgagcctgaggggtcaaggctgcaatgagcagtgattgtgccactgcactccagtctgggcaacagagtgagatccaagaaagcaagaaagagagaaagagagagagagaaagaaagagagacagagagaaacaaaatgcagagtctcaggctccaacccaggctacctaatgggcatctgcactttaacaagatccctacgtggttcctgtacacattgaaatctgcaacatgctggggctgcagagagcctgggctgggagtcgtgagcaccacccggctgtgttaacgacagctggcaaaatgtggtaaggcacatccaggactcagtgaggcaggttcccgagcctctgttaggctaagtttcaagttgttccatcaccacctccctctgccttctttgccatttccatccatgatagcactaccctaactagtgatgagaagcagtctttggagttcctcttctctcctgtccctcatggctaatgtccctgctgagacttctgcctctggctctctttccttctgtgcaccctgatttttcttctcttctgtcccaagctagaggttaggaccctctgctgcagcactgggtcatcctcaggatacattcttggtgtatctggaggaacagatcacttccagcttgattcatgcagagcgtctcttgcttgaatagcaagatttgcccaaaatcagaccttcaatcctgtataaacagaataaataatcacttccagatctccagggaatctactcaccctgggtgagtttaccagacagtttcataattttggaattgaatgaaagaattatgaagggagctgtcttcaacacgtggggatgatagactaaaggattatgaacttagcagtggaggtgaagaagggtgtagcgtagcggttgggggcacagggctgcttctgggtgcctggcagcagctcgtttcttgtccaggtggtagggtagctgtgcatctctgttttgtgtactgttcaatgtttgttatctcacaattgaagaggtttaaaagaccattttgtgagagatcaagttttaagtgcttttttgcccccatcattggcttggctaggttagaacaaaatgtgataattctatttcccttcttttctttttttctttcttttcttttctttccttcccttctttctctccctctctgtcattcccctccctctctctttctttttacaggagtggaaaacaaactctattcctataaggttttctatttctcttttttttctgaaacgatcattgtataatgatggcctctactgaaccttactgtgtgtcaggtaatgtgcaaaaagcttaatattcattgcagcatctcatcaccacaaaggcctcatgaggctggtgctatttttttttccattttgcatacaaggtttacagagattgaatcacctgcttagacccacacacccagtaagtgatcgaatccagattgatggtgtaatgaccattatccagatccttatcaccatttggggaaattgtctgaaaatcccttggggttatttagagtcaagctttcatctgggtcttcagaaagttgtagtggagcggtctgcacccccacacacctgaagacatttcaggactaacctggatgaaaagggaactgacttttagctaggataggacataaggacataatcataaaataattcactttccttcttttcttttgaaaagttttgtaaagtgtgtatcctcccagagatcccctggcaaaggagaccccagtgaggccttggtttggagaaactgggccttgtggggcagcctgttgaaggtggcctggggataagagaatatgatggttgctgagagtggtgtaattccagctactcgggaggtgggagggttgcttgaacctgggagtgtgaggccagcctgggcaacacggcagggccccatctcttaaaaaaaacacatatgtgatgagcttttcttttgcctttcagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaaggtgcaatggtgcatttggtgggaggccttcacttcaaggcaggcagaagtatctgggtcgggttggcagcaagaactctgtcagccttttctacatgtaccccttttcatctctgccttgataacatccgtgaatacaacactatccatactccaagccattattgatatttgaacatgtcgtggctgccccacctgcctgtaggttggttttcccatagtgggcttggttccatggaaccctgcactgccctgggcctccctgttccccatcagagggatctaccatctgcccagaggcaatcagaggccaagggtgcaggcgggtcttgatctgaagcctccctttcagcactgtgatctcagtgactgtgcccctgagactctcagccagggggaattttagaaaatggtaggggcatttttctattgtcacatatgaatttctttattcattctagtaaaaggtgagggatacaatgttataaaaaagaagaagatgttgggtgtgagagggctgagaatcactggatctatattatacataacttgctgaaaaaaaataacactagttctaggtacttggaaaatgcatacatctggtaggacaaatagacctcactgtgtagcagccaagtctggataaagcctttgtaaaattatcacttggggccttataggcttgataagggacctatcagataggtcagataaaggaccatctgctcccaaaggcctaagaatgcttgacatttaaaagctacacacaattcctgctctcagagagcctacagctgaggaagagactgagacaggtaaacaaatttcaaatctgtggccacatttacttcaatgatctgagacacgtatagagtactaggacagttgaaaaagtcaattgcttttaacacttaagacatgtcattgaggtgctgagccctggtgatgttccacactgtgtcgtggatcttaatcagctttgttacaaatggcttgtggtgggttagatgaggatgcaaatcaaaaagcagggacaatgagtacaatgtggcccttccttttcccagtattaatagctcattgctacactctttgcagttgtggcccactttctttgagagaccccttgtgaggaaagcctttgagaagaccctcaaggacctgaagctgagctatctggacgtctatcttattcactggccacagggattcaaggtttaagacactctctttctcagcctctagtttctgagcaggtgccagaaaatagtagctgcaccagggctgtggggtggtgtggactggggcaggaggccttgcatttcataattgggaatggcaggtggtcaggaagagaccttggagaagaaacacactggcctggaagggaggttgaggccatgtgtgctgctgaggtggccacatgcctgggttttcttgcagttatgtctgagagaagacatgatttctggcagcccagacaagttgcaactgccatatcacctttgtcttgattccacgccccagggttgccctcccaggaaatctcttgggttactcttgcataactatattccagggcataattatcttattaagcaaagtacacctgggagtggcatcttggagaaaagcccaagtatggtgatgctggaaggaagccagtagtgatccaggcacccattgcctggggctctgctcttacctgctcctgaggggtgggagagacaaatttccagctctctcccctcctgaccaactggagtgatgatggcctgccacccctaattccacgcctcttctagaggctgcaaggatagaagttggccaatatcttctccagaaaaccacagcttggatatctaatccttatccagtaatattgaaatgaaagtttgcccttggttgtatatgggatctaggtgtatgaggttaatgtccatggtgataatgaacttctggaatgtactagcagcaaatcttaaagtcaagccagtcgtttctaaaatattagtatgctacagtagatacagagattttaattaaactcacattcctaaagtatgtactccagaacttgaaaaagtggtatgcagatgtggtatttagcaagagtcaggatcctgaaaccttgttgaacagaaccaagtgtcctgatgcagattccagtaaacttttcattctgtgttcacagtctggggatgaccttttccccaaagatgataaaggtaatgccatcggtggaaaagcaacgttcttggatgcctgggaggtaggttcccagcttcctctaagtgtgctgggagagaaatcttcagttatccatgagattcgcatggatatgaatgaggccatgtgcctgatgctttctaatttcatcattgtgattttctagctcttctaatatcttcctcatcacctttggcttttgggtacatctgatactatttatatttcaaggctaatagtcttcaaataagactggaaatacaatgtaccccactttggggaatacacatgctgttctcaaaccagggcgaggcatttggaacaggaggtttgggcctgggtgtgctcatagcagctgagtaacctagggtcagttttgtaactcatgtagggctcagttttctcttcttaaaaagaagttgtataatacatactaccaatatatatcttccagtgtgtgataaagattaagatggtttacatgccaggaacattagtcataaagcccatttaaccctaggagacagggttaacatccccatttataaataatgacatttgaaacctagattgtttgatgacttgcccaggtcttgtcacaatgtgtgtggcagagctgggattagacccagactcatctgaatcacaagtccaaccaccaaagccatcagcatggtgcttggcaggcagtgaagacacatccagaaatcagggagcctgagtgctctgcttctcagatctaaccatgacctgtttcacgtcattcacattcaaaatgaatgaagggatgaacattttctctggtcattttttattatttatacccttttgcaaatgctagtagagaatgaagtggaggaataagttataaatgaacagtggcttatgactccaagagttaatcgtgttattttggtagctgtctgtgtaggtgtgcatgtagttgcgagtttgtattgtgttttacaagcaaaaatatattatgtttcaactttctgaaatgcttataattgacatgattcaatgaaatgtagctttttctgtgtattgtttgttcaaaagcattaatccacaagcacagctttttgttgtttttattgtcttagacactctcactctgtcacccaggctggagtgcagtggcacaatcttggctcactgcaacgtccctctaccaagtaaaagccattctcctgcctcagcctcctgagtcgctgggactagaggtgcatgccaccacgcctggctaatttttgtatttttagtagagatggggtttcaccatgttggccagtctggtctcgaagtcctgacctcaagggatccacctgtcttggcctcccaaagtgctcagattacaggtgtgagccaccacacctggctatttgcattacatatgataagatttttttatcttaactcttatgatgccatgaagtatggcaagtatgtcaatgtagcctgcttctcgcagtgctgttttttgaatgaatacaagaacgactgctaaataaaacatttgaaaggcatgaaaagatagcagtgatcaagatcagaggctctgatttgaaatgagcaggcttgaatatgtaagcgttggatgtttatgtagacccacaaccagttcagtagaaacctcactgaccacattgaagcagagaggaggaaaaatgtataaagaagtcaagttctaatacaggaaaactaacctgacctatgtgcacaaaaacttttaaattatctaattgccccatctgaaattttgggaaacctaatgatttcacagcttctaaattctactgcccaatttggataacatcatatatcctagtggttctcaacgtggctatgcattagaatcacctgaggagtttaaaaatcccaacgtctaggctacaactcagagaaaatctgtaagaaactctggggggtgaaatccaggcactggtaatttttttttttaatttagagagagtctctctctgttgcccaggctggagtacaatggcatcatcatagtttagtgcagcctcggactcctgggctgaagcaatcctcccaagtagctggaatcaaaggcacatgccgccacatccagctaattaaaaaaatttctttttgtagagacagggtcttgctatgttgcccaggatggtctccaacacctggcctcaagcaatcctcctgtctcagcctctggtaatatatatcagaaacatatatattattagtaggtattataagactttttttaagaagagaaagctaaggcctacaagagttaaaaaacttaccctaggttactcaaacctaggcccaaaacccctgttccaatcctcctgtcacctcccaaagtgctgagattacagtcatgagccactgcatccagccagtattttttaaagctccctggtgattccaaattgcagccaaagttgagaagggctggataaagtgttccctgaacatgtcgtgcttatccctgcctctgagctttgctcctgccttcctgtgtcatatgctcatgttttttccctcttttctgtctttttttttttttttttttttttcttttgaggcccagcttatactctacctgaaggactcccctgacaactgcgggctgtatgtatctcttctttctctgccctttctgactctgtctatgccgctgtgatgttatctgaggcagcctcagtgtcatgattgatggctccatagaagggaactctagcactttaattggactataagaatcccagaaaaagggagcacattgtatacatttacatcctgacaacttctgggcaggatctggaacatgtaatagatggctactaaatacatattgcactggaggctgctgctaacatgtatggtatctttgggcaagtttggaaaatgcccaatataggctaaaaattatacaaagattcccttccttgcgtgtccatgcagtttctgtaccaggaagcatggctggatatgcaaacagtgggtcaggcttcagtcccacacaactccatggccgggtgcccctatcagggtgtaatctgaatgcatgaccttcctgcaaaccaaagcatgcttagtgtgggagagagggactcaggacccacaagtgaggcttctccgtatgctgcagcctcttcctgactaacacagcttgcccaggtttgggtgtgcaatgcacacacacaacagcagctccctgctatcatttggattcattaaaaattaaatcatctcataagcttacaaatgttgatttttatttactttttatttttttgcattacaaaactttcatatttcccctgtgtacagaagtttaattttttatgtgtttcttcacgtgtaaggtgagagtggcaagaacataaaatctttacctgttactcctagtttttcttgcgctggggaggggcagtagggctggaaccagtcactgatgggcacccaggccctggactaaaatttcctgtgaatgcttcggctaaccctgttacggtggatcctttagcaatttctgccccagggaggactaaggcaagccagggtccctgtagtccctctagagctgcccataaggtattcctttctatgataggccatggaggagctggtggatgaggggctggtgaaagcccttggggtctccaatttcagccacttccagatcgagaagctcttgaacaaacctggactgaaatataaaccagtgactaaccaggtaaattctattcagtttaagggtaagggtcctgccctattacttcttaaacattgcgggaggaatgttcaatgctatgccctgagtctcatctcaggggtcagtgatcaggacactttggggaggtgtgaggctgatctcacgggtgatttagcaagtatctcagtgggcaggtgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgttggtatgggtccataagttactggaaagaaaaatgtgtgtaaggtaacacgtttggtacacacaaatgggatggcagtgggaaaaaatgggaattaaacaacaacaacaacaccaagggcgacatgcttgaccctctgggaatatttccagttcagccacccaagggtgaaccaggctttgcaaaatgctgaggcttcagagcccggggaaaggacccaagcttccaggtcctcctgcctgtctcccagatggagaggctctgatgatcagtcttgagaccctcattggagtggtgtccttctgtacatggtagccatggtgattattcacatcagcatctttctgcccctagggccaagccagaagacccttccctgctggaggatcccaagattaaggagattgctgcaaagcacaaaaaaaccgcagcccaggtgccatatttttatttttcttgttatccaacaactcattcttccagtctcgtgtttcatatcctgtgttgtcctcaacaaactccttaaaggggaagaatataggagctgaagccctctaaagtgtttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtctttggagctgagtggaagcctgatgtcccctttccgcataggttctgatccgtttccatatccagaggaatgtgattgtcatccccaagtctgtgacaccagcacgcattgttgagaacattcaggtaagtttccggctggtcggccctggtattcctcagtggagtgggggacaggcagaccttctcactaggcttctcacctcatcgctgcattgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctgggccacacacaagaacagactgtcctggcctccctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccgtggacagaatgggaaaaactcctgtggccagtttgtgctgtgaatgtgagctccctccctgctagaatggccggcagtctccagccacagctagaatggccttactgatgatgtattggaactcctacctttccaggtctttgactttaaattgagtgatgaggagatggcaaccatactcagcttcaacagaaactggagggcctgtaacgtgttgcagtaagtggcatggagttaactagaagcattgccaggagtttttctaaactaatagagggttagttggaaggattggaaggctgctgggactacttgtgtcttcaaatactattttggggcaattttgaaagttaaaattggggtacctgggaatcactgtgagggacacatctctaattgctgctcattgtctgaacttctggatgtagagctagaatcataacagaaggtgggttgtcaataggcgggaggcagaacattcatttattcattcattcaatcaatatctcacggtcatctatgtgccaggcattttctaggtgcttaggttatcatactgtacaaagttgctgcctccataggcttagggagggagggaagaagagacaacagaaataaatcaactcaaaatatagatgtcagacagcaacaaatgctagacagaaaaataaagtagggcaaagtggataggaagcggtgggtggtagtgggactgatcctttatacagggtgtgtaaagggaggctttgctgtgagggatataccatatgcatatttgggggaagagcattcttggcggtgataacagcaggtgcaaagtccctgaggtgggattgtgtttagaacattcaagcaagaaggccagggaggctggattaaatcatctccaaatgcctcttaaaggaggtggtgctaactttacttaaaatcttagataagtggtgaaaaaaagctttcactctggctgggcaggcattctaaatcatctctttacaagcaatactttctgaataatgtatctaattaaatgtatcaaaaagagttgtctggcatttattactgccagatctgtaattcaatgaggatttgaatctctttcaatgtttctatagccaaaaacgatttttcaccttttaaaaatgatttcggctgggcgtggtggcccacggctgtgatcccagcactttgggaggccaaggtgggctgatcaagaggtcaggagatcaagaccatcctggctaacatggtgaaaccccgtctctaccaaaaattagctgggcgtggtggtgggcacctgtagtcccagctaattaggaggctgaggcaggagaatggtgtgaacccgggaggtagagcttgcagtgagctgagattgcgccactgcactccatcctgggtgacagcgcgagactctgtctcagaaaaaaaaaaaaggtttcagtatctcaagcgctgcttgcatgtcatgatattccatatctatcctgcccaccctaagtatcataggagcctttcctcatcttacaatggcttacttttattggagcttaacaaagtagtagctacttagagcaaaaaggaagggtgaacgtaaagtgggactcacccccaaactaaactgcttaccttcctatgagcatcatttctggcaatgggtagcaatggaggcaatgggttggtgggctctgcagtaaatccacctggcctcaaatccaactttaacactggtttattagctgtgtgacattgggcaaatttcctagtttttccaagttggtttcttcacttataaagtaggatgataatactaatcgcagctaacatccattgaaccttagcttagaatgtgccagggtcctgcgcccttttccggtggtattatctcatttaatactcagaacaatccccaagctgtcaattctgctgttgtttcctacttcatgatgttgtgagagtggattgggacaagacttgtctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtccaccagggaagaataccttctcaaccagagttgttgttttgatggaactcagtttctctgtttttgttttttgttctttcctgcagatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaccaacatgtattgagactgtactatgtgccaacacaatttgaagtgttttcctgtgggtgaagtcattgaatcctcagaataatccctttggggtaggtattcttaacatcttattattcacatttgctggaagaggaaatggaggtagaggggagggaggaggaacttgctcaaggccacccaggtagtaagtgactgaaccaagtttcaaagggaggcaggctctggggtagctcacagcgatcgatggtcatcctctttctcctgagccttttcctgccacctttccttcttgcctgtctccactcattccctgtcttgctctcacagcttgccttcaacaccattgtgccaaagagtcaatggcagagcctgcaaactccacaaagatgctagtgttcattgagagaggtgcggcattttcttgggaagtagaggtgtggcatttccttgggaagtagggtggaaaaacaataaagatacttactattgccattaatctggaacatttctgtttgtcctataataattgcttcttatgaaatattccaactatatagaaatgtacagaaaataaactaatgagcatctggccgcccaccttataatgttaacaagtgctggccgagtgtagtggtgcgcacctgtagtcccagctactccgaaggctgaggtgggagggtcgcttgaacctgggaggtggaggttgcagtgagccaagattgcaccactgcacaccagcctgggtgagagagagagactctgtctcaaaacaaaaaacaaagagcgaatgctaacattttgccatattggctccaaacctttaaaaaaaaattaaagaaattaggggttaccaatatagtcgaggaccactttgtgcctctccccatccccattccactgacccccctctccagaggcaaatgcttatcctaaattggtgagtcccctcatcctctgtttggggttggggggtacacctacattcccaagcttccttgctatgttaggaattcctctgggtttgctcagtgagaggtacagttaggagcttgacgggctggagaagggaagaccaggcgtttctctctccctctctccctgtctattgaccttgagcggcatctccagtagaagacacgtttctctgtgggctcaactttttccaggcagcctccaccttgattctatctcctaccagacaaagcttctgggatgaggaagcagcactctttctttgtccttcttccttaggagaagggatctcttcctgctgctgctaaactagttgcctcatctcctttcaatagcccagctcttccatcacgtgtatctgatcacctatcataaccacgtatttgaataaaacatgcaattttcaaaaatcttagcatagtttcttttcttctggctggccctttgactggtatacttcccatccacatttttattatatatgtatttttattatatatgtacacatccatacacaatctcacagactgggtgcttttaaaatgtatataaaatgtatacaactgatgcacaggaagcaatttcaacccagagcccagtgatatctccttagtgagcattttgtgaacattttcttctttgtgtcactgtgattatgacttgcttgataaaaagctttggttataggataaaatgattcggtttctattatgtggttttttgtttgtttgtttcacttgaacttaaccaaacagaggtaaatttaaaaagctaatgtggagaaatgctgtgttttaaaaagcaacttcttacttattctgttttctgtctttgtggagaaggagtcttgctctgttgcccaggctggagtggagtgcagtggcatgatcatagctcactgcaaccttgaattcctgggctcaagtgattctcctgcctcagcctcctgagtagctgggactacaggcacaggcatgatgtcctgctaattattttttgtagagacaggatcttgcgatgtt

SEQ ID NO: 13087 - DNA, 22375 bp, Human
gggctctgaagcttgaactttgttagattcatgactattctgcccctgggcacaggcagtcatctggcaaaacactgcctagataccttttgttcccttctctgttctgccaccctgatgcctcttctaggctaaggacagagacattgggcttcctccttgggaattctcagctctgtgggatgctttaatctgggtcctgagcccaggctcttctggttccctggcacttccctgctgcacatgcacagcaacctggtacttaacaagaaaggaaaatcatcatcctaactgctgtagcctttcaacttcagtcatgcaccacctaatgatgtttcagtcaagcatggatcgtgtaaatgatggtggccctgtaagatggtaatggagcatatatagacatctgatatgtggcacttgacattggcattgcagatcgagtaggggaaatgactgatattcagtaattgtgctgggatacttggctttccatatgaaaaaacataagtaacaatatgtataccatctaggtttgtgtaagtacattctatgttgtttgcacgacaaaatcacctaatgatgcatttgccaggacatattcccttcattaagcaacacatgacgatacttgcaaatcacctcaatttgatttctttccttaagtcctctgtttgccttccattgaaatataaagccttattttaaagactgttttcccttcagaatctctaggaattactaaagaaaggtagaaactagatctagattccaatcaattttgccattgattgttattttactgtgggtgactcacagtttaagtgggagagaaaatctccagttaatggaagttgccaagagtggcagaagaccaggctgtagtgctcgtataatctttacaacccagtgtgcaaaacactggaggagagatggagaggccgggcgtgtaaaccaagcatgtgtcagtgcagatgtgtccaccacaaggagagagagaggcgggctgagcagccatgtcagcagattctccgaggatggagtgggcccagcagatcttcaggccagcagcttaaatgtaaggagttcagcatagcttgagagttgctggtctccctttactagattctccccctgctaagacgtagctggtgtgtgtaggatatctggagggctggggaggaggaggtggggcctctttatcagtgtggttcctctcactcctgcctaccagatctgtttgtacaggcagcatccctcagctgcttgcatttgatagcttattttgcatctggatttattcctgctgaaaactctatcttgaggtaggtgcaagattatttaggtacgtaccatatttggtgttaatgtctctttaaagcacttttaatttgtctgaatgttgaactgatgtgttttgcataccttagattttcttgtgtgttgtagcctgtggcattgaagagctagttgccaccagccagtgatacatatcagatatatgcagtggtgcattgaaataacatgtttaataacttctataataagaatgtgagactggtaaatacttctttttccaccacaggaaaacaaagtgaaaaggatgccttcagtgtagagtcagctgctgggagctgggagttcccagccactagtcattctttcagacgtctgtaactcattctattaaatcctttctactgtaagcataaattgcctttgtatctggcagaaacacagcatgccattagaatgaagtgttttgttattttatgtcatgcaattaacatgctatccaaacatcagaaaatttaagtcaactagattccctgtaatgaattattaatatctatagaatatgcctgtatgtgtcacagtgtatgagttatcacatttctgactgttcaaagggatttcagtttcttttagaaattgggtgttgtaaagcgatgtttctattcctagattgtcagttgaatataacttagacttgttgttcttgtctttctagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtaccagctttatataccacttattagaggttgccaagtgtgatatctaggccttaatctagaaattaagctaatgaggccctatttacacaatagactcctctatccccctttgtcacttcagatttaagaattgtcttgttctataaatcagatctcttgtgtgttttctgttcctgttacccgaagcagcagttttcagactttagcaagcatcagagtcacctggagaggttggtgtatcacagattgtgggtcccaccctcagagtttcggaatcagtaggtctggggcgcaccctgagaatctgcatttcttagaagttttaggtgatgctgatactgctgattggggttccacactttgagaagcactagtctaaaggactgtatggcttgttgtagtgaaatgaaaggaagctaggaaaggaaggaattgttgaaatggccttgaaagtaaattagagtttttcaagtcaagtaaattatctagacttcagttttgctcacgttcttccaactttaaacaatgattgctgttcctagacgtaggtttcctgagcagttcttttgtttcaaacttcttttcagaacaggcttagtcattgactggaagaaagttagggggaaggaaactaaaaggatagttggtttatttatcttgactctaaaaatttggaaatcagcagcagccataattttaactactttatgtcatgttctacatgtatactaaaacatactgtattgttacctttttaagtaacatgaaccaaatgaactcttgaggattcaggttcaccggttttgagcatcagtgattgcactgtgacaccttctggatttctcactgttctgtggatttctcgtttccctctctgcctccactcatcccagatggttgtgctttttgcgtgatatgccctgtctggtgttttcctgcctttcatcactgtcagcagttagcttactggtaataaatagaagaaatttctccaccattcgttttcattctgctttaattttctataagaggctgtgacaaataaaaaggctgaccttgtatgtgaaataagtagaaatagattattagttaaaaatgaagtaatctttagcatgtgattattttcccctaatttttataacatgaccaagaactaaatcattacttgtatagctgacatccattagtcatgcagagacctaaaatctacagactattagatactaaaattttattggctagacatggcacttgatatgtgtgtgtgtgtgtgtttgtgtgtgtgcacgtgcgcatgtgcgtgggcacatgtgtatcttatttactcaactatataaaaggttctattcttgttcagaataattagatctttaacttcattattagtgatatataacttcatcattaatggaccatagtattttattgtttgaagaagagttgaggcttctactagacaacaacaaactgaaattcagaatttcagagtttctgccagaggtgtattctattcaaccgtgccaactcctttttcagagctgggtctcagatttattgtggccaggctcccttctctcaagaaaacaccactatctcctttaggatcatctttctccaccttcttagcttggaagtcccccttttaaaaaagtttcctactgtttaataccattgactcttcacctatcttcaaatttattatagatctctttaaaacgattctacagcccaaccacagctcattgtacacatcccctcctgctagtgcattgatgatttaactattttttactgttctttttgagggaaatcggaaagtttaacaaatgatggtaaagaagactataaccatggtgggggcaaagagagaattacatgtagaggttgtgtttagacatagcaaaacttacttttctacatttgagggaggctttgaaactattagcaatttatttaattaatttaatcaaatggtgtacctgctttggaaaacaatctggcagttcctcagaagggctaaacatagagttaccatatgatccagcaatcccacgcctacccatatagctatattagcttcccagtgctgccgtaagaaaacaaccaaactgggtgggttaaaacaacagaaatgtgttttctaggggctggaagtcccaaatcaaggtgtgagcagggctgtgctctctctgatgactctaggagacaattcttccttgccttggctagcttcggtgtttgtcggcaatctttgatgttctgtggcttgcagaagcatcactccttggcattctccttgtgtgtgtgtttcttatccacatttccccttttataaggccaccaataatattagcctgccgcctcccaccagtgacctccattttaatgggattattctctgttaaacactgtatttccaaatagggtcacattatgaggagtttgggacttcagcctgtctttttgaggggatcacagttcaaaccatcacaatgcccaagaggaatgaaagcacatgtccacacaacaacttgtacctaaacctgcagagcagcattattcacaatagacaaaagatggaaacaacccaagtgttcatcaacttataaatggggtctatctatacaatggaatattatttggcaatgaaagggaaggtgatgctgatacatgctaccatatgggtgaacattgaaataactctgttatgtgaaagaagccagccacaagggatcacatattagaggatttcatttatatgaaatacccagaataggcaaatctttagaaacagaaggtagagtggttgttgcctagagggtagggaggatggaagattttgcaagtgatttgctgatgggtacagagtttcttgttggggtgataaaaatattctaaaattgattgtagtgagggttgcacaactctgaatatgctaagagccattgagttgtacactttgtgtgggtgaattgtatgtgaattatatctcattaaagctggaaaaataatcaatggaattgaaaggttaaaggatttgtcattggcctagaaaacagtggggggtggcaaacatacggaagtgataacaaaactgaaatgcatggctgtggagtgtagaatactggggaaaatcaaagtgcacatatacaccatggaatactatgcagccataaaaaatgatgagttcatatcctttgtagggacatggatgaaattggaaaccatcattctcagtaaactatcgcaagaacaaaaaaacaaacaccgcatattctcactcataggtgggaattgaacaatgagatcacatggacacaggaaggggaatatcacactctggggactgtggtggggttgggggaggggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaataaaataaaataaaataaaaataaatgaaaaaaaaaaaaaaaaaaaaaaaagtgcagctttgaccactggggcagaagtggacttacagggctcattgggaaataagcaggcattggtcttcaggcagcttccagtccttcatctaaagggctttttattttattttattttttatttttatttttttaagttggaagtatgaaactgaatgaccttttcttttcttttagagattaatgacattttcttttcttttcttttcttttcttttttagacaaagtctcgctgtgttgcccaggctggaatgcagtggttcgatcttggcccactgcaaccttcgcctcctgagttcaagcgattctcatgcctcagccttctgagtagctaggattataggtgtgtaccaccacacctggctaatttttgtaattttttagtagagatggggttttgccacgtttgccaggcaggtctcgaactcctggcctcaagcgatctacccacctcaacctcccaaagtctgggattacggcatgagccactgcgcacctggccattaatgacattttaaagtagccttacattataactcctatccctattaccataaacaggctttatagaaaatgtttttatttgggggataattgatgtaaaacagtggggttggtgtagaaagaagtaaattgtaggaaatgacttcagtaggaagtatgtgaacacagaaaaagacatgggctgccagagagggaggtatctatgagagaggtagagaataaaaatgatggggttgatgaccaaggaggatggcagatagagggaaaaaatggcagaaaagccagaacatgcagttaggataagaccatagcctagaaaactaatggaatggatgtgaggatccggatttgtccacaggaaaatagaaggatggtttgtaatcttgattctcacccattctggatatgatgactttgttcctttttggcctatagtacctcctggtggtactccaattaacactaatggagttcttagatgttgctgtagttctctactgtgacttaactcccacacctaacatggaagaaattatgtcatgtgcatgaaataggctggattggatttcaggatcactgcataagttattgtctctaaatgtcaatctgtgttagtaaagtttctcttacagtgtctattgaaaaataaggtcccaagtattctttttcacaactgcaagaattaagcataagtgactttctcaagatcagaagacatagtatgtcatcatatttttttcacatcatttctgttaatttagtgagattttagccctttcaaaattgattgtagatgtattcactcaccagaataggcatgttaatctaatgttagtcctcttgtattgcatgtctaactttccacagctcaagttacagggtttgtgtgcttcttggtaacttaccaacctaaaagaaagcatttcattggatttagatgctaacttttcaagactcaaaaaattaagtgaatctcccctactgtttaggggggaaataaaggttttcttttataggaaggactgctttgccagttcatgtgtatgtgtttatggtggtacaaaatataagttaccatcttaattgccaatttatgcttactatcaagttacatgatcatacatgcccattttgtggttaatgcctgttgtccgaatgtaattattaatagcatctccttttactttcaaaagtgccccagtctggatgataaattatgtggttacctcactataaaaatattgagctgggtgtggggtcacgcacctgtagtctcaactactagggaagcggaggcaggaggattgcttgtgcctaggcttgagatcagcctggacaacatagtgagaccccattttagaaaaataaaaacgtaaaaatgaagacgttagctttcactactgttaagaattgaatctagaaatgggcataaccagggttttatatttcctgtaagcacaaaagttgctaaatttctttgcatttattataaaagtaaaaacacttgtggctgcagattcatctggttccaagccgtgctttctagagatgtttatgtaaacttctcccatataaaatgggctctttcaagggactggagtaatttttccctattttgtctctaaactgcttgacaagctaaaaaagttttacctactggggcggagtgtggtaacggatagcatcaatgacagcatactgtcctatcagaaaaatactttcttattgtttgaaaactagggtgggaagaatcatgaccccagttaaataactaattagaatattggtctatgctgaaatctcaaattgctttaagatctttctactaagagtatgctagtattactcatctcctcttaggtctagtcttagaggtgtcatccatatacctcaacagtaaagagtgttggttctgaagatgttagttgtttctcagatatttgatattatgacactgtaggcagtcatatcctgactgatgctttctccatttgtggaaaagaagacaggtgctgttggaggaaactgaaatctaaagagactctagattccttggccgtgatcatggtaattagttggcatcaagaactctactcaaaactcagttcactgaggctccacacacagttatcacctgggctttaaaacttttttctaaaaggtagcctttcccttgacctattctttgtttggaatactgtgttttaagaagctgagtcaagaacatccatggcaggtaaactataaaaaggtaatttaatgcaactaattgagtcttaaattattactgctgttataacattgtggtctgaatggcacactctagcatagctatacgggatgacctttattcagtgcatactgcatgccaagcacagttttaggcattttacgtacacatgttgttttatgtaggaactagaacatggctctgaactcactggaaagctatggttcaatactgcgttttactttgctgtttagtatatcctggtcatattttttatttcatttgatcaatcattgatcactaagctgttttgcttaaagaaactgctttagtaaaaagaagcaaactattgatacacccatcatcatggatgaacctcagctgcattttgccaagtgaaagaaattgggctaaaaaagctgtgtattgtatgattccatttatgtgccatttgggaaaatatagaactatcgggaaataacagattggtggggtaagagtaggctgctgggggcacaaggaaattttaaggggttgatagagctgttttatatcctgattggttattacactactgtatgcagttgtcaaaactcatagaactgtatgctaaaaagggtgacttttgctatatgtaaattatacctgaaaaaagacttgctttatccagtgaactcaccattgccttaattgggaccttaccttttgttcacaaaggtaatagactacattagtcaattaggagaattaagtgaagggttgaaggtttgctatatgcacctatctgtgcctttgaaaactaacctggagggcatttgttatgctttctcaaggcttcaggagccatctggttctgactttagcacctaaaccatggtcattatagggaactgccttttaaagtccttcttcatgagaagttatgtttgagaatcttgctaatgttataggttgaaagctcctctaataaaggttttttttatttttttatttttttatcccagactatctctgcttattatcatcaatttctttagccttaattgggccttccatcccctcctttttctcttgtaacaacctagtctaggagcgggtcaacaaggacctcctggagtcagcgcagatgaatggtacactgagaggcaagtgatactgattcggagctagataacactcttgtataagaattgcaaacactgaaaccacatgtcagtgcctaagacaggcttcctggctgatggggatgacctctcccctgtcaaatgacttatttatataatatctctgctcataaatcatatatgcttttgagattgctttacttttaatctgatgatagttaatgctttcggaagaagtcaaaacaagacatacagaatattatatagtaaaaaaatgcctacttaagggactgctttactggcttttagaagtaccattattatgctaataagtccaggttaaaaagcagggcccacctctgactggttcagacacacttctcacaaagcaccaccgtgaaaacatctaacgcagacctaagtatctgaaagcatcctgtactgtagcgttccagacaggcgtgtgtttcattctctgtggttggcatagtcacttcctgtttgtttcctgctggcgcacgtccaaggaaaagccaggtaccaaactgaaacactggatgtagtctgcatcttgccagaggaaatggattgtttagtctgggtttaagcacaggacgaggcagtttcaagtttggagtaagagtgacacacaagacactcatgcaagacagacttgatccctgaagacctgtgtgcagctgcatacatagcaaggcacagaagtgctgagataaaattagagactcagggaggaaaggtcagctgggactagctgtggggacggggactgatgagttggttacctttggcattttagtgtgatattttcagaagcagccaattcaggcctcgcttctgtgaggcaagtagttgcctattggtgtggttaagctttcttttataataattgatttatagaaccctttattttttaaacattataggctattttaactataaaattaaacgtagaatggattcttctctctgccttactctaaattagtggctgttattttatcgtgttattcaaatcaccctagcatatctttacatatatagtattcagatcttaaagaattaaaattaaaaatagatcatttatgaaactctgaatctctagtttcagctcttattggccataaaggaatacagaactcttatcacagattgtcggtggggtttgaattgtgacttacttgaccaggagaggaaagtgaggaatgaatgggtggcaccttattaaatgaatgagttgactggagttgtttcccttttttttctaattccaaagagtatacactaccgaattggggtttcttctttccttctcatcctgtagcgaatctttctgtctctctgaccatctcttctggttttctaaaattcaaagattttgaacactttggagaaaatcaaagaacatctaaagccatttaatttgaattgtttattttattggcactagatgtaaacagctttttgttcaaggctaagattcttttaattctcctttttttttcttggtaaggtcataggagagcacagtgtttaatcaaggcttcaacaataaaagactagatttaatttgaaaacccagagagttcgaatttattcaattcaggtttgcacctagggttcactaaatcaggtcttgttcatggtacaagggatatagcacctatatgtgaatgagacacacaaggtccttttgtggagcttttaacctctttctgaaatttgtctgtactgtacctctgacaaagtccttagggtgttttcatatataggctttatgttttaggatttttaaattaacattttgttcttttttttttttttttgagatggagtctcgctctgttgcccaggctggagtgcagtggtgcaatctgggctcactgcaagctccacctcccaggttcacgccattctcccacctcagcctcccaagtagctgggactacaggtacccgccaccacgcccggctaattttgtttttgtatttttattagagacggggtttcactgtgttagccaggatggcctcgatctcctgacctcgtgattgcctgcctcggcctcccaaagtgctgggattatgggcatgagccaccacacccagcctaacattttattccttatagcctttagttatatgtaaaaagtagattcacataataaatacagctgtaattacttagtggatcatattactgaataatttctggaccctagcagccaaaccataaaagtgttacttacagttgaataaacatttactaaatcttgcagtgggtaaagcactgtgttgtaacagcatgggtgatacagaaatggatcaaacattgttcctgctctcaaggaatttataatcctggtgggaaaagtgagcatttgcacaagcacctctaccaggaggtgctttagtagatgtacagtgtacataacagtttgtctttggttcctgttcctgctatggtgacttaggggagggggttggtaggtgcaaatttgacttcctgaagttattcctctatgcagaaaataaagttgtttgactttctccccaattttggccttgagctacttcctggacttattaccccaaactttcattatttcttccttaaaatatcccattatttaaattgactgcagttagctcctaggtgcttctacatgaagattcgatacttaaaggcagactttaagtatttaacacagacttaaagactttaacacagacttaaagacttcaacacagacttaaaggcaatggtggacccttaaagacaagggtagctgtgaagggaaacaccactgagttctcaccctgcacctgctcctctccaccctactgtagaacacagtgccttgcccattgcaagaatttagtgaatgtttgttcaactgtaagtaacactattatggtttggctgctagggtccagaaattatttagtaatatggtccactaagtaatgacaactgtatttaactccacaccactgtggagaggggtaggtacagggtgagaactcagcagtgtttcccttttcagccaaccctggaacaatatggatttgaactgcataggttcacttatacatggattttttcccaaaacaacttggatcaaaaatactacacttgctagatgtgaaatctgtatatacataaggctgataggactaattcagtttggtttaatatagttcagatgcattattctggccttaggagctctgcctgcttaactttcttaggatgatgaatgtaacttatgccaaaattgagtaatgagtaatggcttcactgtggtttttcctaatttgctgttttaaaattttagttggccgggcgcggtggctcacacctgtaatctcagcactttgggaggccgaggcgggcagatcacgaggtcaggagatagagaccatcctggctaacatggtgaaaccccatctctactaaaaatacaaaaaagtagccgggtgtggtggcgggcacctgtagtcccaactactctggaggctgaggcaggagaatggcgtgaacccaggaggcggagcttgcagtgagctgagatcgcgccactgcactccagcctgggcgacagagcgagactccatctcaaaaagaaaataataataataaaataaaataaaacaaaattttagtcacttaagtctcattgactgattattaaccagtctaagtattttaaatatttgtaagtaattagtctgctgtgtgaatggcttgagtagtcattaaagtggaatgttgattttatttatttattggaaacatttctatttttgttgaactctccttcctttgtagttgaaatattacggcggcctttgtttatttggctctttaatttggtcccacacaaaagggaccaaacttgagagtgctgctattaaacaggggacctgttggatccggttagatctgaggccatggtcaaacaagtgaatcccatgtatacccaagccccttgctgaagacctggaactcgtttctaaagtcacagacaacaacccctaaacatggcccatcataatcgcagtgtgttagctggggatcagacaaacttattcattccctttaccagtcgtgggaacactggatggcatcagcagatgtccatttaggacccagcctttcacgagggcagagcattcatataaacattcttctctctcctcctcagtagtcgtggaaataaccatggataagtcacctgaccagggtttaaatcctggggatttggtagtttaaaaaggtccatttttactgccttaatagtcctgtgagtagagcaggtttttatttaaccactctggatctgtttccttttttttttttttttttttttaaattgagacagagtcttgctgtgtcacccaggctggagtgcaatggcacaatctcggttcactgcaacctccacctcccaggatcaagcaattctcctgcctcagcctcccaagtagctgggattacaggcgtccaccaccacgcctggctaatttttgtatttttagtagagacagggtttcaccatgttgcccaggctggtcttgaactcctgacctcaagtgatccacccacctcagcctcccaaagtgctgagattagaggcatgagccactgcgcccagccctgtttactattttttaacatctttattgcgttataattcacatactatgcaattcgccatttaaagtatacaattaaatggcttttagtgtattcacaaaattgtaaatccattaccacaatcaatgttggaacattttcactaccctaaaaagaaacccagtgccccttagctgttatcacccccccagttcctcccctattccacccagccctgggcaacaactaatctactttgtgtcactatagattcacctgttgtggacatttcatgtaaatggacttatgcagtaagtggtcctttgtgactggcttcttttatttagtagcatcatgctttcaagattcatccaagaaccttgttgtggtttggttcagtacttcattccttttcattgccaaataatattctattgtatggatataccacatttaatttatctgttcattagttaatggacatttgtgttgtgttcactttttgactattatgagtaatgctgctatgaaggtttgtgtacaagttttgtatagactcatatttcacttctcttgggtatatgcttagtagtggaattgctgggtcatatggtagatctgtgtttaacaaaaggaattgccagactgttttcgaaagaggctatagccttttgcatacctgattttacagtgtattatgattccagtttctccacatccttattcacacttgtttataatctgactttttattgttgccatcctagagggtacaaagtagtatctcattgtggttttgatttgcatttccttgatagctagtaatattaagcctatttttatgtacttattgaccttttgtatatctttggagaaatggctgtttaaaccttttgcccatttttaaatttgatcatttgtctttttattattggagacagttcttatatctgataaggaacttgtatctagactatatatgatatacaaatttttctcccattctctgggttgcctttttatgttcttaatagtgtcctttgaagcacaaacatttttaatttttatatacccagtttatttttttcttgtgtatgcttttggtgtcatatctgagaaaccattaattaactcaaggtgatgaagactttactcctatggctttttttctaaaaatttttacaattttagctcttgactctaagtctttgattcattttgagttaatttttatataaagtatgagtcaggggtccaacttcattctttcacatatggatatacagttatcccagtactatttgttgaaaagattattgtttctgcatttcattgtcttggcacacttgttggaaatcaattgataaaaaatatgagggtttattttgggttcccaattctatttcattgatctgtgtgtatcttgattactatagctttgtagtaagttttgaaatcaggaactatgagtcccttggtttatttcttctttttcaagattgttttggctattctgagtaccttagatttccatatgaactttaagatcagtttgtcaatttatacaaaaaagtccattgagatttttgataggattgtattgaatctgtatgttaatttaggaaatattgccctcttaacagtgttatgtcttctaatccataaatacatatttaggttttctttcatttgaacactgtgttgtagtagtcagagtatagttttgtacttcttaggttaaatttatttttagcattttattctttttgatgttattataaatagaattgtttgcttaatctttcatgttgcttattgctactgtattaaaaacccaatttccttttctgtattgttcttatatctgcagccttgctgagtttattagttctaacaggtttttggtgggatcataccatctgcaaatagagatagttttacttcttcctttccaatctgggtgccttttatttcattgtcttgcctagttgccctagctaggatcttaaatacaatgttgaatagaagtagaatgttcagtcattctacaataaagtcctaggttcaagaacttaagattaatagttggtgacactgcaaaggcacacatctatgagtggtgaatccaagatgctgatagatatatacactcatagtttctacttctggtaagctttagtcaaacatggtcacttttgttatcttttaacaaattaattttttatagtgaaaatttagattatttggagaaatctataaaatccatttttctctccaatttagtgagcaatatgcttacagactctggaaacagataaagcatggtccttgcacagtagatgaatgtaaacagtactcagtgtactcatgctcttgtgtctctaaggtgcctctgcttttcttaaccattaagaataaaatacaggaatgttggtgctagagggacttattttataaatgaaaaaatagttcattggaggtaaaatcttggccaaggtcactcacacatgttcttccacagagtactaggaatataaagggccctcagttactagttagtgaatgagttaggtttggagacctccagagcttcccctggatttgggagtgagcactgttggatttgaaaggctcagtggtcacctgactccaaacaacaggctgttgacttcccctcctgctctttccaagggatgtttgtggtggctgttgtgcggctagctgacatttctggcctgttgaagccagaaggtgtttagaatctagagtagtcatctccctgctaaacagctagaggtctggtctgagtagatttgttctcagcagctgtagtttgtgatggtaatcttctctaaggttgcagtgtgagggtggggcttggcagggcaaaggagtatcttagtagccttcccattaaatctgctacctagaagggaattcctaatagagaaagaagagacacttattgtgctaccctttgttcatgtatgttctcttttaagccaccccttttatcccacaaccctttaaaatgctggcaaaggaagagtgtgtgtttcttttctttctttctttcttttttaattgacaggagaattggaggtccagagaagttacttgcctaaaattctgtattacattgaaggggtactggcagggcaggtgatgggacagtacacttacttggaagagactgtgtcttctgagttaagatcctttccatttttcatagttgtttgagtatggatagtttgtgtataagagttattagggagctcttctaggccttgacgtgaaattctaataaagagccaccccagcagtaagcatccagtgctacgattctgtgactgtttggctggtgctcacagttaggatcaatggctaattaaaatgaaaaggtgcattgattactaaccaataacaacttattctgccactctcaagtaaagacaaacccttggactcccctgaacttgtttcacctaggtcctttctgttaatatagaacaggaagcatatagttagaatttagaagtctatgtgattaataaaggagtgtttttaaagtagataatttgaatactttcagttgtcttttagcttgctgaacttcatctctttctcatgccttccctttgctcactttgaactcagaaacttgagaggagttacattatacagtgggtacagacccctaggtttgaatccaggctctgtcatttactctctgtgtgataattgtttacttaacctctctgtgccagaacttgttacatggagaaataatatgtcatcatattgcaatgatgattaaatgagttaatacatacaaaatgcttaaaagagtacctggcatgaaatatgaactcagaacatgttagctgtttattgttaaaagtacttataaagaatattattactaccactgctactacaactacagctcttctggtccaagttgaattacctgtaattcagttgtactttaaaaagggctaaaggtggcttgtgttttatatataccttccttttttagcagctggaatgttcagggatcataggagagcgagccctgttcacaggcatgctgtaaaatcccttcctgattcccttgactgtgctttctaagcacctgggaaagcattcctgttggactggatctagctcagggtattgcaagctcacttagtgtgggaaaaccaaacacattttaagcaaatgaactagatttagagattagcgaaaagtcctaattttagtaccagcctgggtacaacacataaaaggagaaatacagccaatgctcctggttcactttctgatttttcgagattacctgattccttggaaaactagtaacacaaatgtgggcatagagaaaataattttccttcctttcggatttagataggaaacaggaacagattgtcccaaaaggtatctactgtcctgatgtagcacttgctgtgaatctctaagccttttttcttgtaatttctggaaagttcctggcttccaggaattatagctggaatccctcagtacctgcatgtttcaggcacacagttaaatgggattaaagtgcagttatataattaaacagaacttcctcctgagttgtgttttaacacctggtctcttcctgtcctgatcaacaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaagtgtctccgtgtgtttggtgaattttaggtaggcttctaaactagtctttgactcatactttcctgtaacactcaaagaaagaattgcacttatttcaacacaacagatactcatgattttctatatgttgaagcatgaagcagggaaggtagaatacagtgcatgtaacttcattcacataagcagagggaatggtatattggggcttgtgacataaatttgttcattaactaactgatggcaaaagattatggtatgtagcacggagcagtcagggtaggccatggacacgattgcatatctgtcttaatgatactcttttgcactatgttttagatgctgtgggtacgtaagtcatcatttctttaagccgttgactctgtttcaaagcaggtcacatatatttcgatgataaagtcatgtaaaacatttgtagctataatacctgttatagatattttccatttttttcatggtttttcattggattagtttatttttatccactttatagtacaattggcatttgaagaatactaactttaaagtatttttgctactgctttgtctccatttgattattaacgcaagacttttaacgattagccaaagaagatggttgaaaagaagaacctgctctgcctgcagctggccacatctgtgatgcataaggacatggaatgtggatgctttacatttattaattacctactattggtttctctagtgtagccccttcgttttagtggtgttgattaaccaagtaatactctagaattcaaatatcagggtcaagaatgcaactaccagatgatgttcgtagaattccaaacctatggctaggctgccatagtgatattcacaccatttttgaatatcatcatctctggaactggcctctgagttttccagcccaaggggtgaccatgtcttaatgtacttcaagatcctagagttggattcttccattgtcctgcatcaaggtatcttcttccagggaaccttctggcagcatgatgtgcttctgcacacaaagcaactgtcatatccagtcactttagaatctcacaggcttcccaagaaaaggatgatttttgctaatacagtactctgtgatacaatttggtcttactgtttttgagatcttggctgaaaaaatatgaacagaagagcctttttttttttttttttgagacggagtctcacacttttgcttaggctggagtgcagtggcacgacctcggctcactgcaagctccacctcccgggttcatgccattctcctgcctcagcctcccgagtagctgagactacaggtgcccgccaccacacctggctaattttttgtatttttagtagagatggggtttcaccatgttagccaggatggtctcaatctcccaacctcgtgatccacccccctcggcctcccaaagtgctgggattacaggcgtgagccaccgtgcccggccaagacatttttttaaatgtcacttaaaattagttaacaactccagcacttcaaccttaggatcacctagtgaacctgttttctttgcattgttaacagtttatccagaatttctgatgcaggaatcttgaaggctgcttattctctatcccagtcttggcatccttctattctgaggctgggacagaaattagggatttattttctcctataaaaaaaaaagagggaatgacaatgaccagcccagccatggtggcccctgcctgtaatcccagcactctgggaggctgaggcaggaggattgctcgagctgagaaattcgagagcagcctaggcaacatagcaagactttgtctctactgaagaaaaaaaagacagcctatctaggaattaggtccttggaggaggcagcctatcctgctgccagtttacgctttccctggagccagctatgcatgtctcctctgcccaggctgagatgattgtcccatgtgggtcagtgtggcaagataaaggcaatagcaa

SEQ ID NO: 13088 - DNA, 193689 bp, Human; identical to SEQ ID NO: 12350

SEQ ID NO: 13089 - DNA, 89689 bp, Human
  misc_feature (1)...(89689): n = A,T,C or G
gtgttttgtgcttccaggagggcaaatagggtaggaagcatcactggaattctcacaacactggagttctgtcctgtataggtcataatactcttaagtgatgttattctgacttaaagggccagcatctaaaactgtcaaactgtaattctctgctacagaatccattttcttcttcttttaggactagccctctttgcttattgaggagtaataaaaataatgtccccttatattagcatagcacgttctaattcaaaaagtgcaatgacatgatatctcatttgatctcctttctgtgatggaggcaagcccggtatttttatcccatcctttgggctactgattctcaaagtatagttcccagacctgcagcattaacaacacccagaaactctctagaaaagcaaattctgaccccaccccagacttactgaatcaggtccggggtctggcagggggccaataattcgcatttctaacaagttccctggtgatgctgatgttggtgctgctggtcccagaccacacttgaatgaaaaccactactgtagataaaaatgaaagatgtagaagcccagggacttgtcctaagaggactcctgcctagatccttttcttactacacctgctgcatccctggtccctacgcgcccgcccccaccacctcgcccttcgcaaaaaaaaaaaaaaaaaaaaaaaaaaaaaattccttcaaatcccagctgcattattttagaattttgtgaatgtgaatacctgtaaaatgaggataacaataggatctacctctttgggttctcacaaagattaaacaagaactaggtaaagtacttagcaccgtgcttgtgcttaataaatgccagggatcatcatgattttttattaatattaaaagtgacaattcacaatgaataccttggtaagttctttggatgtgtgtcttcagaatgctcctcttaaaatgtgaatgtccctagataatgtagacattaaagcacctgatcgttaacattccatctctgattgccatgagcatttggctgagagcagggtacttcggaaatgggacccacgactggtaaagtaggaaccaagagaaaatagagcagtgcatggaacagtgtattgaaaggcacacaacagcaagacttcttgaggaaactttgaatagctggggaaggggaagagtggctgacagaggaagcaactgcgaaagggcagccaggagtaggaggcaggctgttaaagacaatctacctccttcaaagttccccctagggcagccccaggggagggctccagggctacaccaggccacgaggggatctgccagggttcacgttgcatgaagtccaggggtcgaacactcaggtgcccatagtgaatgcccggaggggccctccactggcaattagcacaatgaatttgggctcaaaagtggctttgtcttcagggtgactcctatttggcaaatatcctgactacagcacatcatgcactagctcatcccagggacatggtcctttattagtggaggtctgctatgttgtttctcaaggcgtcctaggcccctcaggaagcggttttatgttatctgggtggcgcagcccgggtcccgtgcccagagaggacggagacctttgcaactgaattaaacagaagaaacaaaagcagcaagttcgggcccgtgggtacggagggctagccaatggggcccggccgcttcccggcggagtggtactatgatgacagtagccaaccagcgcgctctatgcaaatgagatactgtatcccgcaccagccgcttcagtgtcgtctggttgttatagtgataaactgaggccttgcctcttggcttctgggagagagagagagagagaggggcggggggtaacctctttacttcccctagggaagacagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactggtaagtaaagacaaaggatggaaatgtatgcgtggctatggcataaaagagttccttatgcgcccgcagccagcgaggaaaacgatgcttagaggattttcatgtaaatgagaagagcgctaccgcctaatccttctcagctgtttatacttagcttctataccgggcgctgctctcagtttacaaagcgttattgtattggctgggtaggaaacgggctgcttgggatatgctgtgtttttgtgcttcgggaggaggggagggcctttttccttttaggtgtgttcttgtctgaaggtaaaaaaatcctacagtgcaattttaaaatggtattctctttaccaagctcgggaagagtcccttgttaagttttaaattctagctaaggaatgcttcgttcctcaactgattttggtgcctaatgccaatttggggggaaaaaaatggaaacatggaagcaaaacttccccatccgtttgaaaatgttcaaaataaataaataaataaatacataggagtccctcaatgatttagttagaaataatacgcatttaaaacgaattgtaaaacatttccagagtgtgctgtgagggtttctcttcaggtagtggaaacctggggagctacatttatttagaaaggggttgcatgcctttaagaatgaaagtgtggaaacggggtactgagagcgtccttccgcctccgtaactgcaccgtaactgctctcccaaatttggtcgtctctctatccctggtcatgatcttttaggtagatgtgaaacttcgttcccaaccacctcagcatgtgtcctcaaggaatcaaaaacacgcatgggtggtgggttttctgtggtccgaagtcttgtggaacttggggagacctctctttgagtcccccaatccaaaagacacactagttaaagctatcctttcctttagcgatttccctcaagttaaaaggtggaatattttgattggctgtggagtttgaccctgggaagagttttttaaaaaaggattttgtgatgtagcattttctgtgaacctgcaaaattagggctcgcagatgagaaggccaacccatcataaaactgttatttcttaataagagttaataagggttcaaaggaggcttagaacaacttcctaaaaagcacaaatacagaggaagttatattagagccctgtgggctttttttccctatgcttctatttttaaaaatgttttctcttagggcagtttaatagtaactgtgccctagcactttagccacttactgaatgacatacacagtgcagtgtctatgttctcatgagatacaaaccatcccaataagtttgttactaagggattcctttgagtcactaaacaacttatggtttagcataaaggaaaatgaccactaaaagcatattacaagattatcatatgcacatatacatatatacacataaatagagagagagactcactctgttttccaggctggcctcaaacttgaactcctggactcaagtgatcctcctgcctcagcctcccaagtagctgggattacaggcttgtgccacagcactggaccaatatatatatgtgtgtatatatatatatgtatatacacacatatatacatatatacacacatatgtatatatatttgtgcccatgcttacccaaaaatatattttttaaagtaaccacaatcttcaaatttgcatcacataccttcctgacagaggtaaagggcagaggagagaaaggcggcatccagctccagtttgtgcatcatttcagtctcttttgcctactatttttccttccatttttacctcttagctattctgcttcttgattgcttctgcctgagggagatgggcagagaaaattaagggaaagaagaaagttcaagttactttcttgtttttttaagatggagtctcactatgtcctccaggctagagtgcagtggcctgatcttggctcaccacaacctccacctcccaggttcaagcgattctcctgcctcagcctcctgagtagctgggattacaggtgggcagcaccatgcctggctaatatttttttgtatttttggtagagacggggttttgccatgttggccaggctggtctcgaactcctgccctcaggtgatccgcccaccttggcctccaaagtattgggattacaggtgtgacccactgcacctggccaagttactttccactttcactcgtgacagcttattccaggtggtaactcacaagaaccacgcaaagctggcaatgtgctctacaccctcacctcccacccattgtagaaataaggaaactgaggttcagagagggtaagtgacttgcccaagggtcacactgctttgaagggggcagagctgggatttgaacccagagctctacaccggaaaagtggaagatctttcttctataacatactcataagtgagatacattcccttcccatctttttggcagttctggtttcgtgtgtgtgtgtgtgtgtgtgtgtgtgtgtgtgtgtgtgtatcatgcacatgcataggtatgatacagatgtacataagttgaactgttgaagcacctgctttgatttacttatgatacaaaattttccacgttgttcatcattgtcatgggctactgaaatttgactctgtttaaacaggggcttgcaaccaatttataaaacactactaaaattttcaaattgccttctctcttattagctaactttgatcactgtagggttatattctaaatttagatttatactttatagcctaactttcctttgctaatgatcttactttaataactaaggcacatgctaactacttaataaaaaagtttgttgatgaagagagtgagcagcaagtgaaaacatgaaattagcatttctttctctggtttttagtagtttctgttgatcttgtagctttgctagtgtcttcatatttcaaattgtataaattctgcatttctcccagcacccaggcatatagctccaaattgtatgtgggtcactgacaccacagccatcaacagagtgtggctactgagttgcttaactaactatggaaagtgtatgaaatatttgcagggggcctgtttaggattgaagctccacacttggattctccttcagagggcaggctccttctcctagttgctgaaatgaagtggggagctggcatacgtgagtgaataaatagactttaaagcagtctatattttagatccctgtaagtaacaaattgataataatattgcagatatgattgaattatatttcaaggggaagttcttctgccaggaaaacttgtagtttctctacctgccttattcttcattagaggaaaatataagaaaggagacgattaaatagaatgcagtaactctgataaagaaattagaaaagaaataacaaaagcattacctaggttttatgatagagcctatattttaggaatataatcttactactcttaccattttaccatggtgctctgatttgagatgcttctgagaactctttacattgttacaatgtttactcttgattcttgacttgttttcagttctttactattttcctgattaaacatgatgcaaggtgactcatcagcttgactgtcaagatgagaaactgagtggccttgggtgatatgatgtaatagcccttcttggaaatctaactcctgagatacaaggactcctctgagcaaggactgtgtcctcatatcttcccagccctcagattatgcctagaaagatcctctgggctcagcaggtgtcccagaagccctttctaacaaggcccagccaccctgaaagttgtctgcttgagaatttggttaatgaccttggacaagttcttctaggggtgcattctgttgtcagaaggaattgtaattctagactgcaatagtcacttccatgaagatggatatactatggatcaactgagaaggccttggaaataaaaaagggttggttcaacatgccacattagcaggaggagttcatttcgggttttacttcaaagtggagcagtgccaagagactgctgtcttgcagaaggtgcattatgtcagtttggaggtagcatgctcatctgctagtattcaaaaagatgaccagatttccagagacatcaatggcttcctttgctaatattgccatctacttagccacccagaacagcatacattttaaaagtgaaacactcttaatgcgcaatattggcgaaaataaacaaacgtgagcttccttgggtatttactgtggtcaactggaattctgcctaaggttattattaggtatcttcctgctggtctctatccaaatgcaacatccatgtcttgcaaattgatactagtcaggtgtatttagcatggaatcaatcaattagtttcttccattcttttaggtttgttctctcactacccctccaacccaatttgcctaatgctaaacccttatggaagaaataaacctaaatcaaatatgataggtagcttctgtgttttattttgatgatttagcatatagaaatcaaaagagtgcatgtatatgtcctcaatcaggcagtgaggaagatttaaagtatttagcaatgcagagttttggaagataactgagagaaaactgagtctcttaccaatccttaccaacccctaccatccccttacccatgggatccacagtcagccaggtggttaacaacttccagacacagcaatgcaccaggtgctgtggagataaataaaagaagtgaatccaaaccccttgcccctaaaggggcatttccgtttaatagaaggtagtagtttggtttgtggaagcatgccaggatgctgaaatcccttaagagagcttttttgtaagtttgactttaacatattagactttcttaaaagctattttttatccattgaggggaagtacttcccagcagggaggactctgttaacccaatccccaagttaagaaaagtccctgcatttgaagaaaaggttttacttgctcaccccaatacatattttgggacatggaaaggatcaatccatttttgagtggatcttaagcccccattgtgggtcacatactggcctagaactctagaacagctctgcccagtagaaatacagcatgagccacatgtgtaattgaaaattttcaagtggccacagttttaaaggttaaaaaaggtgaaattaattttgtatccaaaatattatgtcagcatgcaatataaaaattattaatgagatcttatattattttcttcatactaagtctgaaatccaatgtgtatattgtgcttgcaatacatctcaattcggactagctaatttcaagtgctcagtgactacatgtggctttacagggagcttagacacttgtccagccctgttaggatcagttctgaggacctacaatgataaatacttttcatgttgcacagttcacgtatacatatatgtagtcataactaaaaccaaacatcacttttccttacttcatgttttgcactcttatactttctatgctatcctatcttattctatttcagttaagagactgttgcagtaatctagatgagagttaataagtttgaaattatagaaggacagtgggaaaggagagaactagatggatatgggaaacactaaagagataaatgccccaagatttgataactaagtctgagcatggggcaggttcagtgaaagatcaaggggccaggcgcagtggcttatgcctgtgatcccagcactttgggaggtgaggcaggtggaccacttgaggtcaggagttcaagaccagcctggccaacctggtgaaaacccatctctactaaaaatacaaaaattagccgggtatggtagtgtgctcctgtaatcccagctacttgggaggctgaggcaggagaatcgcttgaacccgggagacggaggttgcagtgagccgagatcatccctctgcactccagcctgagtgacagagcgagactccatctcaaaaaaacaaaaagatcaaggaaggcacagtttgttttctggctccaactagtgagtgccatcactgagatgggtgtgccagggaagtagagtttgtgagagttatgtctgaggtgccatggggacttccacttggaggtgtctagttcatgtttggttggggaactcaggagagagttctgagctggagatatagatctgggagatagcatggaggagatggaagtgaaattgaggcagtgaaatggatgagagtgaaattgagatagtttctggactgagaaggaagtggatggagatggttacctaggaagagtgcctcaggataatcccactacagggctaattctagaaagtaactgaccctgagccatcctatcaggttcttagagggggaaaatagaggagctgtaattaaagctattagactcctccttctattcatctgtctctacatgaaatctggttaagctaatctactttatcccagaatcttcccaggttggaaccctaagaaagactacttaaagggccaatagaagaaggatcatgaaaagaagacagagaagtatttctcaaataactgggagatcaagggaccaagggcagggtaagtttcatggagggaatgtccaatagaatcaaatgcagtagagagatcaaatgagttaaggaggaaaagtttcctttggatttagaaagaagaggtcagtggtgatgtttcagtgaagtggtgggagcggaggctggatggcagtagattgaggagcctataggtggtagggaagtggaagcttgactgagagaggaagcagatagaatgtacagtacccagaggtggacaaatcagggcttagggttactagagactagcttttccccttccttctttcgttcctttcatcttccctcccttcatctttttttccttttatttctcattcctttcatccatccaagatgtcagatcttttggttggctcattcttttaagatgatagcaacttgtgcctaaatataaatgggaaagagccagtgggagagggaaggggcgatggtgatggggacaactgatgaagggaatgtctcttaggctggacaggttgggctccagtgcacaagtggaaggattggcttcagggagaaaaaaagacacctctcccactgtagtggcaaggaagctggcaaggatggtttgggcaagaacaagttataagaggaagggtactgaaagttgaaggcctctctatctgatagcctgtttttcatctgtgaaggtggaagcaaaatcatggtggcttatttctggctagtacggaactataattctggtatatcctgggtagttgagtccagccccaggatatgtcctctcctgaggcctccaggctgtgggtagggagaagtggaaaggctgagatggttcctgatgagatgcagtgatgagagcaaatggatctgcttcgttgtggcctctgggactccacaccaatgcccatcaagccaagtctagatctggccagggagagctgaactagcccacggtgaaaggacagggggctgtcaagacaaatgtgctaaagcttggtctggacttgctggagcccatagtcttgttccagtgtcagttttgccattgaattattgtgtgcacttaagcaaatcactttcctctctggattccattctgtccccgacaatggattggatagatccttagagtgtgattctagctttcattgccttggaacttggtctactgcagtatgttctgtttgagctcatgctcctatcaaaagtctgggctaccccattcctcaccccctgttggttttatccatttggggtaaaaacaggttgcatgatcttatggtaagacacactggctaaatatgaataacaaatgttcacaagcactttgaagttttacattgatgttgtacaaaccacttctgctgtcttctgttttattcttcagatgctttctcagacaggttgaatgtattccaaatcatatatggaatgttctattcattgtttcgggaaacctgtgttgaatctcttcttaatgtgaacagtagcctcctaatttatctatttcatactacagaagtttgaaacattgggccttctttgaggcatggcagtatgggcttgaactatagaggcctttcttaatcaatgttgtccatctaagcttgctacttggggttaaagtccagcaatgggtcaggctgtagtcccaaaactcttacatctttagctggtgccccacacaaagcttctcagtgaccgttagggaaataaatgcaggaaaataattatcccatcagatcactggggggaagaatgaaaaggaaaaaaaagcaaggaaggtagaaacaaactaagtcattgcaagctaggcctactttcttccaataatctcccaggtaacagcctctaccttgctaggatctgattacccgttgctggcctcagaccatagcattattgttttaacattcctaccttcctctttatcccagcatgaactgggttgtatgggaggctgggaagctgaccttgcttggggataaagagacagtttagcactcaacaatcttgaaggcagacttgaaaacacagtgattagaaaataaagcagtgagccctggtagtgtgcgcctgtgtaatagtgtgcagggccacacggggctagcctattgagcagaattcattttcatataatctcctccctcccgccaaaatctttgacttggtgtttttgttttctactcggtaattcatgcatgctgaacctgacatcaggatgctgagggttatttaaactgtcatttaagaaaaataacaacggtaataggttaatagaaacatcatgaatgatgtgtacagcctattgccaaccaaatgatgttgaaagcccattcctggtacatgcaggcttctgtgtttcatctctggtgtgcctaatattgactgtaggcacagtcacataataataaattctattgtacctccaaattgtttagttataaggtaattgttctatatgggatgcaaggctagtggtctcactcctttttctccatgggcaagtcggggaattgaacaaccattcacagtgcacactgtattgggcactgtgttgaatgctctatatgtattatctcatttaatcaggctgcagacccatgaaataagcattactattcctcatgttataagtaaggaaataaataatcaagtaatttcccaaagatccaaaaagatacatatgtatatttttgagatgaagtcttgctctgtcacccaggctgggtgcagtggcatgatctcagctcactgcaacctccgcctcccaggttcaagtgattcttctgcctcagcctccccagtagctgggattacaggtgcacgccaccacgctcagctaatttatatatatatatatatatatttttttttttttagtagagatggggtttcaccatgttggccaggatggtcttgaagtcctgacctcaagtgaccctcccgcctcggcctcccaaagtgctaggattacaggcgtgagccaccgtgcccggccccaaagatcaaatattaactgattaagctgggagttgaaattaggtttgtctgacttctaaagcccctatttccatgacacatagttcacaaacttcagtgagcagagaattgcctgctcaagctcccaggtgattcggaagcaagatgtgcctagatgcacttttagagatgctttatttagccctcccagtcatatctgctgtgtttgggaacaggagtagaaataaatcagatatctgtgttctttgtagtaaaactagaaattcaatgtaaatattttgacccagcagttgcattcctaagaaatttgtacacatggccaccaaaaaaactagtattaggatgttcttagcagtgttattcataataaccccaaactggaaactacccaaatgcccagcagaagcagaatggattaaaaaaattgtagtacactcacacaatttaatgctgggtagcagtgagattgaagaatctacaaccacctgcaggaatatggatgaatctcacaaatgtaacattgaatgaaagaagccagatacaaactaatatgcgccacatgatttcatttctataaaatataaaataaaataggcaaagctcatctttgatgttagaaatcggtgtagtggtaggagcatgggatggacgctggaagtgttaggttacgtgatatgtggctgtgtgtacttagcttgtgaaagtccattgagctgcacttaggatatgtgtacttttcttttctttgagacagagtctcactctcacccaggctggagtgcaatcgtgcaatcttggctcactgcaacctccgcctcccagttacaagcggttcttctgcctcagcctcttgagtagctgggattacaggcatgtgccaccacacccagctaatttttgtatttttagtagagaccaggtttcaccatgttggccagcctggtcttgaactcctgacctcaggtgatccacctgcctcggcctcccaaagtgctgggattagaggcatgagccactgttcctggctgatatgtgtacttctctataagtctattattctttagtgcaaagtttaaagatattattattcacaataatgaagaaagggaacactctacattgtatttcccatttccaaataattctggtgatctaataaactctaaggaaaggcatcacatcctacttacaattatagctcttggctgctaacagagcttcaaagtgctcagcccttccaggggccagtatatccagccccaaagagagtctagtgagcacttgaacgaaacaccttatgtctaggaccagtccagccctagtcaggtaatctgtgaattaaaatccgtggcccgcaattgtgtactatgcctggcctcacagtcagacaggttgtgggctgaggaaatggatggcattggttaggtagcaagagtacctcagaataaccctgctacagggtgaattctagaaaatagctgacccagagcctttgcatcagggtttgggaaggggaaaaatagaagagctgtaattaaagcttttagaatcctccttttatctgcctattgctacaggaaatctggttaaattaatctactttaccccacagtcttccaggatggaaccctgagtgacaacatttagagatccaatagacaaagagtcaggaaaagaagacagagagtacttctcaaataggtgggagatcagaggtccaagggtaaagcaatcaccttactggtagttacagttttcttgtaaaatatggtttctgttaaagaaatcatccactttgcagaaaatatcatctttggaacatctttcctttagtgactcagaaaaaaagaggttttattattgaaatagaatctagcaaatacctcaagctgagacatgttagaaatatctgtacttctatccaagtatattgcaaacctcccacactgcataatttgttctaatgcttgtttctttcaatcttcaacaatgttttctatatgtcttctaaatatatttgctgacaaaggaatgcattttagtttgacatcagtttttttttctacacattagagcagctagttttactgtagcatgaagaatagatgattttgcaatggtatgagacttttgttttttctctattgagttatggaaactcaaaaaggcttctaaacatttatcgttacatgtaacagtattttgtgacatgctggattgagtatcacatgactcacaacattgaaacattaaacatggaaaaatcatagaggtttatcttcatgttctggatgcttcattttaaaatatgttaattacaataacttcataccatcattagctaatatctcaaggtgatatttaatgttattggtagcagatatttctaatggtcttctgtgagataattttcaattcagctatcttcttgtcagatcagattgggttgtcgtggttggtacctgataatgtggtggctgcagaacttttacagggagtagaagggtcagctctgccattttcttgttgttcacttgtgtttgcattatctttgctttcctatttcattgcaggaaatgtttttgttgttgttgttgttgtttgtttgtttttgagatggagtctcactctgtccccagcctggagtgcggtggcgtgatcttggctcagtacaacctctgcctcccaggtacaagcgattctcttgcctcagcctcccaagtagctgggactacaggcatgcaccatcatgcctggctaatttttgtatttttagtagagacggggtttcaccatgttggtcaggctggtcttgaactcctgacctcgtgatccgcctgcctcagcctctcaaagtgctgggattataggcgtgagccaccgcgcacggcctgcaggaaatgttttaagccacctgctgatttatgtgcattggtttagttaaaactagataatataatccacaaatacctttatctaggctcaggtgaactgcagtatattgcaataagctgaaagcaaatgaaaaaatgtcaggcgatgcaggccacccaactttcacattccctttaggatacctcatgtatttgatgtggacagaaatggggcaccagtgtaaacccatatatcagaattagaaggccaggcgtcatggctcatgcctgtaattccaacacttcgggacactgaggtggaaagatcacttgagcctaggagttccagaccatcctgggcaacatagtaagacactatctctacaaaatttttttttttaattagatgagcatggtggtatgtgcctgtagtcctaggaggctgacgcaagaggatcgcttgtacttaggagttggagggcgcagtgagtggtgatggtgccaccgcacttcaacttgggtgacagagtgagatcctgtctcaaaacaagcaaacaaaaatagatatttttcttggtttttgtaaagctttttttcttattttttgacatgaaaaataaatacagtaagtcctcacataacattatcaagaggttcttgggaactgtaactttaagcaaaatgatgtggaatgaaaccagttttaacataggctaatttatgtaaacaagagttaagttcgtatggcgtatttctggccacaacaacatcaccaaacttctttttaaaattttttattgatatatatactgagacggagtctcgctctgttgcccaggctggagtgcaatggtgtgatctcggctcactgcaacctccatctcctaggttcaagtgattctctcacctcagcctccggagtagctgggattacaggcgcatgtaacgacgcccggctaatttttgtattttttagtagagacggtgttcaccatgttggccaggctggtgtagaactcctgacctcaagtggcctgccctcctcggcctcccaaagtgctgggattacaggtgtgagccaccgtgcctggcctgattacattatatttgtatatacttaatggggtacatgtgaaattttgttacatgcatagaatgtgtaatgatcaagccagggtatttagggtgtccatcaccttgagtatttatcatttctatgtattgagaacatttcaaatcttgttttctagcctttttttttttttttttttttttgagacatagtcttgccctgttgcccaggctggagtgcagtggtatgatcttggctcagtgcaaactccgcctcccaggttcaagtgattctcttgcctcagcctcctgagtagctgggattacaggcacgtgccaccacacccagctcatttttgtatttttagtagagacccggtttcaccatgttggtcaggctggtctcgaactcctgacctcaggtgatccacccaccttggcctcccaaagtgttgggattacaggcgtgagccaccgtgcccggccacttttcaagctattttgaaatatataatacattgttgttaactataatcatcctactctgctatcaaacattagaatttattccttctatctaactgtatgtttgtacccagtaaccaacctctcttcatccctagccccgctcacccacacacacttcccagccactatctcaatgatagtggtatctatcattccactctctacctccatatgatcaacttgtttagctcccacttatgagtgagaacatgcagtatttgtctttctatacctggcttaagtggctctgaaaagagcctttgctttttgaaagtagaagttgttcacttggagctggtgtacttggtgagggccttggtgttgtgagacacagtgtgattggccatctccctaggcagcaggcacaagctgtatggatctccctggaggtgatcgtcgagtacttgtaatgcatcaggaatgatgcacttgaagatattgacaaatgagttcatgatgcccatggccttcgatgagatgccagagttgagatggacctgcttcaataccttgtaaatgtagatagagtagctttccttgtggctatgcttgtgattcttgccatccttctggctcttggtcacaccaccttcttggcacccttctttggagcaggaacagacttggctgattcaggcatgtcaccacaaatcaataactatactgagaaagaagccacttcaacaccaccacacttctaaataaagaccaaaacactgctagtatcattcaacattgaaatacatgtgagctatgtatacatttaagaaagactaataaaaacaagataattatttgccagcttattccagttcagggtaatgggtgactgggacctatcctggcacctcagggcacctggtgggaaccagacctgaacaggacaccatcccatcgcagggcacactcacacacacaacacattcataacactgggacaatttttttttttttttgagacagtcttgctctgtcacccaggctggagtgcagtggtgcaatcccggctcactgcaacctccccctcccgagtagctgggattacaggcatgcgccaccgtgcccagctaatttttgtattttagtagagacagggtttcaccatgttggccaggctggcctcaaactcctgacctcaggtgatccgcccgccttggcctcccaaagtgctggaattacaggcgtgagccactgcgcccagcccacattgggacaatttaaagacactaattaacctgctgtgtacatctttgggatgtgggaggaaaccagagtacccagagaaaacccacacagatatgaggagaatgcgaaaatgcttcacggacagtagccctgacctggaaccaaaatattttttttttctcatccacgttataatgaaaggtcatcgaacaaaatgacattattcaaggatctgaggtataaacacaagtgttgctgtctaatggattgtcttgcccatcccacattagaaaacattggtttaggcattctaaatcttaccattggatccaaccatcagggagaaaaaaactgtattttcagggtgcacgttcgtttggccccttaaagaaaatgcttttctgaaccgctttttggtgctggggttctgccttacatggaaggcactatggagacaaacataaaaaaacaggactttctggctaggcgcggtggctcacgcgtgtaatcccagcactttgggaggccgaggcaggcggatcacgaggtcaggagatcaagaccatcctggccaacatggtgaaaccccgtctctactaaaagtacaaaaaattagccgggcatggtggcgggcacctgtaatcccagctactcaggaggctgaggcaggagaatggcgtgaacccaggaggcagagcttgcagtgagctgagatcgcgccactgcactccagcctgggcaacaatgcaagactccgtctcaaaaacaaacaagcaaacaaacaaaaacaggactttctgtactagggggctgttgttgagtgtatcagtaccgatgttactacagtattacccatcataccctttaaggtggcaccacgggaggaatttctctcagaactcagcatcaggaaaatgctgtgctttttcctcaatagctattttgctttgtgcttaaggacaacattaactttgttttcctctttgctgtgactactgggagcttaaagccatttttgtagtcttacctttttgaaatatagaggactgtgatatgcatttctttgggctcatttcacccctgacctttagaaaacaaacatattttgactgggcgtggtggctcacgcctgtaatcccagcactttgggaggccaaggcgggcggatcacgaggtcaggagatcgagaccatcctgggtgacacggtgaaaccccatctctagcaaaaatacaaaaaattagccgggcgtggtggtgggcacctgtggtcccagctactcgggaggctgaggcaggagaatggcgtgaactcagggggtggaggttgcagtgagctgagatcgcgccactgcactccagcctgggtgacagagcgagactctgtctcaaaacaaaacaaacaaacaaacaaaaaacatcaaaaaacatatttctcctcctcaccccagatcttgcaactattattttaaactttcaaattttatttttaaaatcacctcaagttctttggggaaggaggtggaatatgaatatgatataacattgttattgatgttcactataaacttaaattcaattatctaagaaaaaattatttagaatgtggaatttttatatcttggtaaagattgttttctattgttaatagcatctatgcatttaatgagtctaagaggctattcatggtaagttgcacttccatttcaatggtgttacaatgtgaaaaaatggccaacactgattttaagataatatctattgtaagatccctcctactctcagagatgctaaaatgtggggagaaatgtacattttagaatcaatgaaatgtgactttacttatagtactatgagtcttctagctatttgatattcactcactgctgtgaggttggaaagtggccgcatgagatggagtttggtttataagtggtcagtgttttaaggaagcctgtatctccagggcataataaaaattctgatctctgatcaccaaaagggcagtatgtactaagctgacctagatgtgagcattcaggcactggtttactggtttaaaaaatgaacttattatgtgggaactctaaataaagttggaaaatacgtgttgttttttttttttttttttttttttttttttgagacagggtctcactctttcacccaggctggagtgcagtggcatgcaatcacagcttactgcaggcttgacctccggggaccaagcaatcctcccacctcagcctccagagtagctgggactacaggcgtacaccaccatgcctagctaatttttcatagagagagggtttcgccatgttgcccaggctgctctcgaactcctgaactcaggcgatctgcctgcctctgcctcccaacgagctgggattacaagcgtgagctactgagcccagcctggaaaatgtgtttttaaaagatatttaagataatttttaaactgtgctcttgttttagttttaaccaacttcaagatacttattctcaacaatagaaaaataggcaaaggacagattattctctgaagaaaatacaaatggccaataaacatttgaaaaatgttcaatctttttgtaatcaaaataatgcaaattgaaacagcatgctaccattttttggtctataaaattgacaaaggtaatactcaatgccagtgagatggcagcaagataggtgctttcatacgttgtaatgtgagtataaatgatacagcttttgtaggaggcaatttaccaatacatgttgaaatgttcttcaaatatttatctttaaaatgttcatacccctgatctaagtaattcagtttctaggcatctgttataaggaaataatcagaggttcagaattatgtttagcatgttatttatattagtaaagtataaataatttaatattcaatgatggagaagtatttaaattacggttctttttcagtgaaatgttttacagctatcaaaattagtgaggttgaaaactatttaagtgacatgataagataatcatgatatattgagtgaaaaaaactgtctatccggcaagattccaaacttgttaatatgtatatatgtcataccagaaagcctaaaatgaaatatagaaggagttaactatagttgtctctgggaagtagaaagaattattggtgacttttattttcctctcttaactttcccaaattttctataatatatattatgatgatgataagaaaaagctatgaaagattgacaaatatatttattttattattgagtttaaagtctgtatttgtctttatcaattatcattctcactcctgtgactttaaattcccccattcagcaaatattcttaaggaccttctatatgccaggtactgccctggggaatagggatatagcaatgagtagacagaccaagtccttgctttcttagagcttccctaatagcagggagagacggagcttaaatatacaatgtttcctcatctgatgacctggacctctcttctacctgcatccatgccctgagctgaatgagtgaatctagtctaatggctttatatatcacatactctctcagtttctaaacctgcatctctagcttagtcctttctcccaaacaccagacttatacatccaactgtctacctgacatctccacttggagatctaataggtgtgtcaaaccaaatctgtgagaatggaattgttaatttccccatccttgttgtccctcccacccctagacctactcttccagtgttttacccctcctagggaatggcaatgccatccttccagttcttcaggccagtagctttggaattatcctgattcctctcattctttcacaccctacatccaatctgtttcaagttttatggatccaaaatctatccagaatctgaccacttcttaccacctccgctgcgatcaccctgacccctgcctctgtcttcttttgcctgattattacaccagacacctcagtggttttcttgtttctacctttgacctcttacagtttattctcaacacattagccagatggtcttgttaaagctaagtcagatcattatcatgccttgttcaaaacgctctgatgcccagcactttggaaggctgaagcaggtagatcacctgaggtcaggcgttcgagaccagcatggcgaaaccctgtctctacttaaaatacaaaaattaggcaggtgtggtggcacacgcctgtagtcccagctagttgggaggctgaggcaggagaatctcttgaacccaggaggcggaggttgtagtgagccgagatcgcgccactgcactccaccctgggcaacagagtgagactccctctcaaaaacgaaacaaaacgaaacgctctgatggctcccatctccctagagtgaaagccagtctttacagtgtcctaaaaagctcacacgactgggtgcctctcatctcctttcttctggtctcacctctggctacatcttttcttttttgctcgcttcctccaagcatactggccttctagttattcctggaagaagccaggcatgttcatgcctcatggccttggcccttactgttttctctgccaggaatgctctttctccacatggctcacttgatcctttatatatttacacatacatcaacttctctgactatcctatttacagtgatacccccaacactccctattccctttccttgccttatttttttctataacacttaatcaccctttaactaaaatactacatgttttatgttcttttttgttgcttgtttattatttttaagtgttatgagggcaaaattttttgttttgttttgttccctgttgtatcctcagaagctagaacagtgcctggcacacagcaaggactcaaaaagtgtttgtctgatgttagaaaaatgaattatgggtagataccatgaaagtaatttaaaaattttttaaagctcaaatgagttttaaatattccatatacctgcaaatcatatcatttaacagttaatttctggataatagtttttatttttcaaaatactcctcttttcttaatatagacctccctcccccatccctgctacatttgggagacctgagccttgattaaattttctgcatctctgaatttaaaggagaggagatatttctttaaatttatttttgcattatgaacattgcatgaatgcattctcattttaaaaataaaacaaaatgacagacatatatggaataaacaatgaaatctcttcatctcttctctcaaaatattatctccttcccaagaggtaaccccaattaacaattcaatgtgtatcattcaagtccagtgctgtccagtagaactttctgtgatgatagaaatgttctatatctgcattgcccagtatagtacccagtagtcacatgggttattgagcacctgaaatgtggctaatgtgaatgacaaactacttttaattttatttaattttaattaattataatttgaatttaaatagccccatgtgactaatggctaccatattagcacagttctaaactatttctttttcttttcttttttctgtttttttgagacagagtttcactcttgtcacccaggctggagtgcagtggcgtgatctcagctcactgcaacctccgcctcccaagttcaagcaattctcctgcctcagccttccaagtagctgggattacaggtgtgtgccatcagacccggctaatttttgtatttttagtagaaatagggtttcaccatgttggccaggctggtcttgaactcctgacctcaggcgatccacctgccttggcctcccaaagtgctgggattacaggcatgagccaccgcgcctgtccctaaactatttctacacaattacctctctcttttcttctttttctctctcttcccccttctctctctttttactataaatgacatcatactagatagcatgtatacatacatattatacatattgctttgtgacttgctttttgcattcaacaaaatgtcttagatataattccctgtcagtacatacgtatctgtcttgctgttttcaatggtgcctgttacttataacatgtacattccatacataactaaatgaaaaaaatggatatttcttggtgctgaaccacatactgggcctcttttttcttctctccagtgacatttattggtgatgactttgcaccagctgcctgatttaagagtctacataatcagtgacacagtctaagaatccagtgattcgtgtgtgttgggcccatggttaactatattatctatttttttctgtcctctctatcttcaaaagacaaaatattctgactccacaataaataaggttttaaaaatatgttcagaaacaagtaaatataaacctaacagtatgaggctgctggattagattttgtgatgtctttttgtaattctgaatttgtggttctaaagctgatgagtttcacagcaaaaggcctacctggaagaagtagattctttctgaagtcctgttcttatctttttttgcatatcctgattaaaatgttctgtctttgtaaaattcttttctaccagagacattcttgagatggttataactttagttactctgggtaattcacttttcaattgatttctatgcttctaacatacctcatcagcattttctagctaatgtttgagcctgacaaactgttatagacacggtattaaccaaggctctgtcaagacacagatggctcactctaaaggtgaaattgaaagagagtttaataaaggtaatacttacaaaggtatgggcagggtttaaggaaacctcaaggaatagtatagtatccttggcctagaaacaatgggggattgccatcccccaggctggtaggggcaaggggtgagtgtggttaccagaacctcacacagacagctctataaagaggaccccctcacagaagctgtgaattttggtaaaaggacagaaccaacacactgcttcctagcagagaggaagccagggagacaaataccctgagctcactcttgtcctgacctccactgttttgcacgcttcccaaccaactggaagcaggaggcagagatcccattggtgcagtccattggggaagccatacagaaaagagtagaggaaaagcatagagaagggtagaaagagagtggattctggagaggcaaaagggaagatatttattacccacacattcttttagttaatcctcacaacagcttatcctcctttcataaacaaggatactaaggcttgagaggttaagaaccagcaatttgctaaaaatcaaatgtaaaaataggaaagggatattaaataatggaggtaggatttgaactcaggcctgtctgacgggattgccccactggagttaagaatagcttagcttggccgggcgcggtggctcatgcctgtaatcccagcactttgggaggccaaggcgggcggatcacgaggtcaggagatcaagaccatcctggttaacacagtgaaaccctgtctctactaaaaatacaaaaaattagccgggtgtggtggcgggcacctgtagtcccagctacttgggaggctgaggcaggagaatggcatgaacccgggaagtggagcttgcagtgagcagattgcgccactgcactccagcctgggcgacagagcgagactctgtctcaaaaaaaaaaaaaaaaaaaaaagtatagcttagcttaaacaagcaactctgcagttggcctatcaccatcagcagtactgtgctaagttctgattggttgattagcttgttgtctgattggtccagttgtcagtcagcgatgtacattgcataagtgcaggttctagcaaccatttttttgcacttaagtaatatttgcattgtccattgtccagtacctaatagcttttgttttaagtaaatatttgacaatgtccaactgaagagattctatacatgaaatgctcaacatataatgtcttctttaaaagcctgatgaaatgtggctttggtatgattctatggcatagtttatataaccagaacttatgtgacaaatgggtaacatattcaccttgtaatgactgagtattttgaaatcttcaattaggtagaaagaagttttattgcaacctagctccaagtctgtggtctggcaaggcccttgcatatgtgaggtccagggcactgggccagggcttcttaaccctttatgatccttgctgtcttctgctaaacacgttgtgcacatgtaccctagaatttaaagttatatatatatatatatatatatatatatatatatatatatatatgtaaatctcatgtgccaaccaaaccccaaatttggaatatggctctctagaagggcatagtctgtcttctgtgatcttcacaagttcagaagcttagtttctatgattttcatgctcaaaagagtagtggttttccccaaatctgacgttattgaaaactgaacatgaacatgaacatgccctttcaaacgaataccttctcccattctaaaacggtcattcttcactttagaagattgctgctgcaaagccaattctgttcctgcctttcttatctctctcctccatttctctatcctccaaacccctagcatcatattaaacatgtatcatgtgctaataaacactacaaaatgtgatctggctgatttaaagtctaacctgaggcttgcaaataactacaagcaagtcatttgacctacttcattaagtctggccaaaaatatggttacatgcttttatttcttcagttaattgtttgagttaccccttctctatcaggaaatcatgtatccccttttcgaggtttttccatccctatagtctaaaaatcctgagggtttcctcagctcacagggagccaaaaaggtaactgagtttgagggatctaccactgctgttgcttcttgctgtcacttggtgtcaccttgaagactggttcagtgaagataatatctacctcacagaggtgttgtacaaattaaatgagcaaatacatttaaagtgcttagtatatcgatggatacatggcactaagtaggtactcaaagatttagctattaccttatgttatcaggccttagttttatgtagggtctacaccagaggatccctggaagcatctcagctttggcaaatggtgaagttagttcagttcctgcccctcccagaagcctctatcttactcacattgtcctgaagttgatctgcctctagtatatggaagagacagaacctaaggagcatagaattttttataaagcaaatgatttgttctggctcagagaaggagtttttttttaattgtaatctggtgtgtttggactgaaaaaacattgtctcaggtcaccgggctggttggtagtagctgggccttaaccaaagtcttcctgaatgcagagcttgatcaactcaagaagtaccctgctgtgctttagaaagcaatgttctggacagcaaggctgtggctcatttattttttcattctccccattctgagcacattgctttatacataacaagaaatagctcttctccatatcaactgctgttaaagatagtcacctgtgcacacatgcaaacacaaacacattcgcacatttaggaattctctctgccttccatctctttgtttctccttctttcctacttctaggccataataattaagaacaaaatgcacggtgcatataaaccttttcttcccctttgagtaactattgttgctttacaacgttccctatctctgttttaattaccagatttcacaccatcaagaacacaccattcttggaaaatggcaacaccttatctcctctttaataaactttgtgagtagcacatacaagatctccaaatagtaatttattttaggtcatgtgaaaaaggttcattgcccacatatattaaaaggtaatgaatcattaatgtaagctaatcccacttgccaatccatttatccatttgggttgtgtgctaaaagtccattcataagtcaatttgcagccaggtgtggtggtgcatacctgtagtcccagctacttgggaggctgaggcaggagaattacttgaacccaggagacggatgtggcagtgaggtgagatcgcaccactgcactccaacctgggagaaagagtgagactccatctcaaaataaataaataaataaaaaataaataaaaatgagtcaatttgcttgtttctgtgggtaactatattatctattattatatcatattatatataatagtgaataataatagcagtaataatagctacagtttattaagtaccaggtatgttacacatattatctctgcttttcacaacagccttgcaaaatgaatagcccattttatagatgaaactgaggttcaaataagttaaggaacttgcttttaagcacacaaagtcaaaaatatttcctgcctcaagtatagctcctcctgaagtggtagtggtgggtcactcatgactttcctcaccacatctgttgggccccagggtgggcgcctgaccgaacgccagccaatcctggttaaggcctgatttgaaaagatgaacttggccaatcagattctcccttaggaatttgaattgggaaacatggaaagagtcaataagttggtaggagtctagggctgaaaggcacaatggaaagttgttaaatgagtgttgtgaagagaggctgaggaggccatgatgggccggcctattagagctgaagctgtggggcagtggaaagcaagcagcggctttaatgcagtggaaggaaatggagtcagtgggggtgggacagaaaggatcatgtgcagagagcagccaagttggtgcagagcaccttctctggggccacattctgcccctttcctgcttttccacagtttcagttccagggtagtcttaaaagaaatcctccatcctttgagctaatgttagtgagtgtctgttagtgagtgtcagttcctttcaaccagaagagccaaattaaagtacatggctagtaagtgctggagaggggatctgaacccggggtttgtggatacagagtttttgttcttgtcactgcacccctttgctacattacaaatgccactgtggtctaccacagcctatgaggtcgccataatgtatctgaaaaagaacgaatagtgaacccaagtttcctgaatccttgtcccaagtcttggtttgcttccagagccctgaaggagaaggtgagggctaagaaaatctcagataactgggaggcctccagacaacattgagcttctagggtggaagggactgcaatggggagaggggatggggacaggggagggatcggttctcgtcagtgcagagaatgggggctccccaagggcagggattattggtcttatccctacttctatccccagattccaagatagtgcctgccacttatttgaatgagtgagtgaatggataaataaatggcagaagtgagtcatagcccctgtccaaatgtatggatcattcttcagtctagtgtccccaggttaaggaacacatcttaacctgtctccatctctaagaaacaattgatacagcacagtgaataatgtttaccatgactgatccactttagctttaaaaatcacaaagatgatgtagtggtgactgcaatcacggcacagttcaaagactacaaatggacaactctggattgcatttgccttgtttacaaaaacaccgcttgctttgtctggagagagtgaggttttcattttaagaggctgactaaaaaatgcagggccactttctgggcaggcttccaagtgactacatctttctcacagcgttccccagagccccagcccaagctgcctggggcagggcctctagccgctagtcgctgttgaagctaccacaggagaagtcatctgcagcctgcccaaattgctgtgcttttaagccttcccaaggcacagataacagctttggcctttgcattgaaagagacatcagagtttgtcattggccaagctggtgtgtgtgaaatataggagatggcgtgccacgcttctgagtatggcactctttccagccaagtctcctgggtgtgggtgagtctaaatgtttgaagactgccctcggttgtgaaatgttcgaagctgggcattgtgactttccaagggcatgacttggcgtatttcttaactctaatgagcctcagtttcctttttgtgaaatagggatagtattatcctatgctctagaaggatagaagtatctattcatcacggggtgctgcgaagcctaaaagagataacagcagagtatctcatctagtacctggcatactatagacactgaagagcttttgttatttctgaagcatcagtaaaaaacaaaccaaaaggtttcagtgatgatgccctatttttatgtctaacagtacagtatttctctgagactcagtggatatatttgacttcttaatcatacctgtgtagccaacaggaataaaacttcagaggaagttagtgccaaaggaaagtttgtcagactgtattccctttctttttctcccttctagaccctgactgcacctgccccatttgctgatgaaaccaactgccagtgtcaagcaccccatgaaaaactgaccattgctcaggcccgcttaggaacaccaggtgaggctgtacttctttgtcttaaatgggccctgtcttgacattttaaagtatcagaaaggggccgggcgtggtggctcatgcctgtgatcccagcactttgggaggctgaggtgggtggatcaccttgaggtcaggagtttgagaccagcctggccaacatggtgaaaccccatctctactaaaaatacaaaattagccaggtgtggtggtgcacgcctgtagtaccagctacttactttgggaggctgaggtgggaggactgcttgaacccgggaggtggagattgcagtgagccgagattgcgccactgcactccagcctgggcaacagagcaagactccatctcaaaaaaaaaaaaagtatcagaaaggcccatcattatttgtgcagcacttgctttcaagcagagagttgaacttagagattataacgcagtgcaagggtaaagaagggtaaacactagcagtgataaaccagaccaaccaaaggagccaagaaaaagatgcatcagaatacagggagtttgagccccagctttgtcacttgttagttctacagccttgggcaagtcactagaaagatctgaatctgtttccttaaaacagggataacaatacctacctcacaaggtttctgtgataactagattcatcaaaagtaccaaagcatttttaaaaccatgaaggcatatacaaacctaagctactataattattgccattcttaaaagtatgcattttttaaaaaaagtttctagtgtgccttaaaaagagtgggttgtgctatagaagtttgttcattcattcatccctttagcattatgccagaggatggatagggaagagatttggaaagaattataaggtaccatctgtttttcaagagacaagacaactagatgtgaaataaaaaacattagtagcatgtgtgcaggtgcttaggggttaaaacctgcaacacagatgataactgattcttagagaatggcagattcatttggcctgagtgatcatgcaagacttccgggagggagcagaacagacattttaggagaactaagatttggactgtgtgggcagaagatgcaaaggtattgcagacaggtggaagaggaatagtgaagacagaaatagacagctgtgtaggagtgagtgttgttttagttgattgggatggggtgaaaaataagactagttgaacaggtaaactttaagccatttaacatggcataactcggccgggcgcggtggctcatgcctgtaatcccagcactttgggaggctgaggcaggcaaatcacttgaggtcaggagttccagaccagcctggccaacatggtgaaatcccgtctctactaaaaatacaaaaattagccaggcgtggtggcaggcacctgtaatcccagctactcgggaggctgaggtgagagaatcatttgaatccagaaggtggaggttgcagtgagccgagatcacaccattgcactccagcctgggtgacagagtgagtctctgtctcaaaaaaaaaaaaaataataataatataaaataaaataacatggcataactctatggtttctagttgccattgcagaaaacaaaaaaaaaaaaaaacaaacaaaccaaacttaagagaatccatggaatgaagaacagtttgcttaacaataataatggatacttattaagtacttactatgtattaagatctttatatgtatcatgtcatttcactatcacaactctatgtgattagtagttttagtatttcacagatgaggaaatgaaggtttagagaagttgtgaatctgcacaaggtcattcactactaagtggcagtggttcacactggagcctgcattagaatctactagagggcttcttaaaacccagatggctgggttccactcctagagtttctgattcagtccaactggggtggggcccaagaagttacatctctaacaagtttccaggtgatgctactgctccagggatcacactgggagaaccattggtaagtggtaaagttgggatttggtctcaaacctattggtcttagagcttgacctctcaaccatgacactgtgcttcctataagaatagccttcaatagagtgaagtgaggagcagagtaggcagagttaggaagctttcatgtgagctgcttttgaaaaaggcaaaacaaggttggggaggtagcacagagcagccaaagctgttgttcccaggctttagtgtacaaagaatcacctggtatgcttgttaaacaagcagatttcctgtttcattcccttcttcccaaatctgggatggggcccaggcaagccatctgcattttaaacagatagtcagggtgattctaaagttagtggtctggagaccacacacagaaataccaacccagcaatatatccaagggatgccaaataaaagtccaggtggctgaccgggcgtggtggctcatgcctgtaatcccagcactttgggaggctgaggcgggcagatcacctgaggtcaggagttagagaccagcctggccaacatggtgaaaccttgtctctactaaaaatacaaaaaattagccaggcgtggtggcgcatgcctgtaatcccagctactcaggaggctgaggcaggagaaacgcttgaacccaggaggcagaggttgcagtgagccgagatcgcaccactgcactccagcctaggcgacagcgcaagactctgtttttttaaaaaaaaaaaaaaaaaaaaaaaagtccaggtggttatgaagaaaacagacttgacctaaagttaaagggtgagcatcaggcccaaactgaaagggcctctacctttctagggaaaggaaagggaagtagaacttactatatatctgtatatatctgctcgatgtgatgctctgtactctttgcaaagaccatgtgagatgactattattgtatcctttctaaagaggagacaaaggagacttgcagaactgaaaagtaacttgtcaagtgtcctagttgactgggtagagctggaatttgaccccaagtccattttgcctcaaacccctgctttgcctactgcaacgatctgccttatgaatcatggtccacagcaggccatggagctaagtgaaaacatgctcagacagtagctgtgatcttctgtagtggcaggactatgccatgctcactgctgtttcatcagcatctagagaaatacttgttgcatacgctgcggtcaataaatattttgtgagtgaatgaatgaaagtttggaggcaggcgggtcacctgaagtcaggagtttgagaccaccttggccaacatgatgaaaccctgtttctactaaaagtacaaaattagccaggtgtggtggtgcatgtctgtagtcccagctacttgggaggctgaggcaggagaatttcttgaacctgggaggcagaggttgcagtgagctgagatcgagccgctgcactccagcctgggcgacaagaatgaaacttcacctcaaaaaaaaaaaaagtgtgggacaagagaagtagttcttcctctggaaatagaagcagagagagtttgttctggtattttgagctggtatcaagctaactgggtgaaattgggcacctgtacattgcctgctgccaagcagtttaagcagtaataagatggtggtgtattttgaaataatacaggtcattagagggggaatgagatggaacaaagatgaactcctgatctttagaagagaaattctgcccactaacctgaggtgatgaccctgggaaattatctaagaaaatccgtgatgttgatgagtacctagccagggtacttgtgttagaaatttctttatttagaacttcaaatatcaggccgagggcggtggctcatgcctgtaatcccagcactttgggaggccgaggcgagtggatcacttgaggtcaggagttcaagaccagcctggccaacatggtgaaaccctatctctactaaaaatgcaaaaattagccaggcgtggtggcgtgttcccaggtgatgctgctgctgctactagtcctgggaccacactttgagaaccacagcataagagcaactgtcggcagtggttagaaggagtggtagggagattatccaatatcataattgttggagcattgtactgttagcagaaaagctcggagaatttttaagaatcttgctgtttgattaccatttaagaaaacaagaaaaacgttacttttttgaagggtttgttcaagagtttcaagaagggtttggtcaagaagggtttggtttcaagagtttcaagaagggtttggtttcaagggtagtaagcaatttacctgtttgtggcactgtcttgagcgtgccctcaaaaaagacaaaacatagcagaatttggtatttgataatgctcttcaagattatagttttttgtttgtttttcttttgtatttttagtggagctggtttcgccatgttggccaggctggtcttgaactcctggactcaagtgatctgcccatctcagcctccctaagtattgggattacaggcatgagccactgtgcctggcctagattatagctataactggactctcttaccatctcctacactagccatattttatgacataatataattgcctaaaatgtgttttacaaatttagaactgcccaaacaggggctgggggtacaaattctagaagaggtaatgacaaactctgcccatagctcttagctttttgaccttgtttgtgaggtcacaagggtgatgaaacttcaagagaaagaacagaataaatcaaaaaagcaatcagaatcggcacctttggtcttagctagtccagctgtggagctgtgcacatacacagtgttgtatgtattctgatgcatggagaataaatcctgtcttgacataaaggaaaagtccaggagattgtttcataggttccttttcattaaaactgcctttcttttctctctttctttctttctctctttctttctttttttttttgacaggttgttgctctgtcacccaggctggagtgcagtgttgcaatcacagctcactgcagtcttaacctcccaggcccaagcaatcctcccaattcagcctcccaagtagcttggaccacaggcatgtgccaccatgcctggctattttttgtattttttgtagagatggggtttcactatgctgcccaggctggtctcaaactcctgggctcgagccatctatccaccttagcttcccaaagtgctgggattacaggcatgagccaccgtacccagccctaaactgacttttcttaaagggaatctcggttctgattttctactttccttttcaaaaaggaagtttgtattatctgtttccacagtgtgtagaatttccctgactacatttttcaagagccgccttaatgaatctgccttattcatgtatcatctgtgatgtaatttacttaataatttttctttacatatactcactgttctaaaactttaatgtattttaaaaagcaaacatcaatcactatcatttacagaaaatagtatcattagctagtagcaatggctaatgataagcagaaggtaactacaaagtttatataaaactacataaattatataaaataaatatgtaactataagattttaaaagcttaacttgtgccactttttttgcacatcagttatacaaaaaacagtactagttgccataattactgggtgtttaataatagtttctgttttgttttaaagacaagaattcatatcagcatgtagttttctagcaggtaccaacaaggtagaagaaagagtggtgagtttgatttgcactcaaacatcatcgtaaattggttgtatgacattgggtaagatgcttaacttcactgagcctccatttgcccatccatgaaatgataagtctactttcacctggctccctcatagggttgatgcaaagattaagtgaaatacatgtgttttgtgaattgtgtgtatttctaaggtactgtttaaatgccttaaaatagccacaatccaagccttgttaatagccataatcaaagatgatcaatcactattttattgttgcttgaatctgaagcaaataccaaaaaacgcctaacataccccacagtagtgtgaatttaaacgtaacgtggttggtgattacctcctgtttggctgtatggcaggtgtgtgtttaactttttaaacaactgccaaactgctttccaaagcgattgtaccactttaaattcctatctgcagtttatgagcattccagttgctctgcattctcaccatcacttggtatggccaattaaaaaacattttttagccattctagtgtgtatgaagtgttatctcattgtggttttcgtttgtatttccctaatgactaatgttattgaggatcttctcttgtgtttatttgccatccttgtatttattttctttagtgaaatgtctgttcgatatttttgctttatttaactgggtggtgggttgttcatcttactgaggtttgagagttctttatatattctagatacaagtcctatattttgcaaatattttctcccagtctatgactcaccttttcatttttgtaaaaatgtcttttgaagagcaaacgtcatgagtctcacaggctgcatttaaggtgtcaccccaggctcagttctcatctggaggttaactgttgttagatctgcttccaagctcactcaggttgttagcagaatttatttccttgtgactgtaagatcaaggggtgagcttcttaccagttgtcggccagaggccaccctcagctcctagaggccacctgcaggtccttgccatgtggccctctccataggccctttcacaacatggcagcttgcttcttcaaagccaccagtgcagaaagacagtaagtctgctagcaagatggaccctttttgtttctttttgtggttgttgtttttgtttttttttgacaaagtttcattcttgttgcccaggctggaatgcagtggtgtgatctcggctcactgcaacctctgcctcccgggttcaagagattctcctgcctcagcctcccaagtagctgggattataagcgtccgccaccacgccaggctaattttttgtatttttagtagatacggagtttcagcatgttggccaggctggtctcaaacttctgacctcaggtaatccacccacctcggcctcccaaagtcctgggattacaagtgtgagccaccacgcctggccaagatggagtcttataatgtaacataatcatgggaataatgtctaccacctttcccatattctactgattagaagcaagttacaggtcccacacgcacttcaaggggtgggaattacacaaaggcatgggcaccaggaggcagagatcattaggagccaccttaacgtctctccacgatagccatgcaatagttgtactctgacatctttttttgttttcaattggctcctggtcattgccaaacctccagcttcacaggtcagtggtatctcacatagatgctctggaatctcacatagatgctctggagagtccccagatgcctaaaagcatatccagaaaaatctcaaacaaaagattaaaacagatcaacatacaaactaaaaagccatactctgtttttttttaaagctttattatagagtatttcaaacacacacagaagtagaacaatataatgaaccttcctgtgcctgtcactcatacctaacaaccactaacccatggccagtcttgcaccatgcacacctctgtctactctgtcctcttgaatgatttgaaacaaaatcccagacttcctagaattctgtgtatatgtctgaaaaataagagctctggttttattaaacataaccactgtatcatgatcttacctgaaaaaacaataattccttgatatcaccaaatattcagtgttccaatttctaattatcttatgtcatcatttatatatagcttgtttgaacccaataatgtccatactttacagtaggttgatatgtttttaaaatctctttcaatctgcagatccccctttcatttctctttttctttctctctctctcttttttgccttgaagtttatttgttgaagagatgaaagatcagggtccttttttggcagggaggggagtcctggagaatttcccacagtctggaaattgctgacacaccacaatttttaaaagtgagcttattgcaaaatcaactttgtaaatactcttcagatttactaaatggcctttttctcagtaattacgtcttctttctttacttttctttcctccctgcttcctgaattcatttctcttgatcacctctgaatcaataacaaaaagttttacaaaactgccatctgctttcccctggggtttatatcttaaaacaaattttcctcaattgaattcacattgaataagaacattgaaagcaaggctccctcattagacagtttgttatttcaaagcattttctatttactgtgccttatttagaatacagtataatcctatgaaggcaattctgtttgttcaaatttgtgtataattggaaataattgcaattccctatctgacataaagtctctcaactttttttattagagaaatttaatttattagaaacattgtatcatctgaatctattaatgtaacatttctttatgttccaaattaatgaggttgcattgcatcaagaaataatcacaattttaaatctaagtcttaaagatcatttaacagaagttggcattgatttcttttttaaatttatttttataacatcaatgtaatacatgcatatatatatatatataatttgagacacggtctatctctgccacccaggctggagtgcagtggcgcaatcagctcattgcagcctctgcctcctgagttcaagtgattctactgcctcagcctcccgagtagctagtattgcaggcgcctaccaccatatctggctaatttttgtatttttagtagaaacagggtttcaccatgttggccaggctggtctggagctcctgacctcaagtgatccacccctgcctcagcctcccaaagtgcatggattacaggcttgagccaccacgcccgactatttttaaaagtcagtagtactcccagcttataaagaaaactagcggtccctttctccaccttcttcacccctgattcttattccctgtaggcactcaacacttgacagtcaactttccataatgttgttgacatctctcatccattgtcattgcctttcttgttttctctgcccttgggaggattatatctttttaacttaacttttaactttaacttttaactcttaactctgtaacttttaactcttagtaattgttgtggtgtttctgggagaaagtagagataatgtgtatgttcagttcaccatatttaactgatggtctttgtatttccttttaaagaacattattagctcacgcctgtaatcccagcactttgagaggctgaggtgggcagatcacaaggtcaggagtttaagaccagcctggccaccatggtgaaaccctgtctctactaaaaatacaaaaattagctggatgtggtgctgagtgcctgtaatcccagctacttgggaggctgaggcaggagaattgcttgaacccgggaggtggaggttgcagtgagccgagattgcgccactgcactccagcctgggcgacagagcaagactctgtctcaaaaagaaaaaaaaaaagaaaacaaaacaaaaaacactattgtggccacatatgtctctttccttctcactgcaagaataaaatgtctctatgttgtttgtagccgtggagatgaggtgacaagggtgcttagaatgagagcactttgatatgagaaactacttctttctcctgtcatccatttttgaatcttcttggattttcacattctagttcctttgttgagagtctagaaaggtgtcaaggttggcaaaatacatagaattttctatataaatgtaggaggcatcttccagagtatcatgatggggatataacagagctgcaacttccttcctccaaccagttaaaaagaataattttgtgacttgctttgtctaccaaattgatggaagtctatacccaatttctctctctgacttgaaggggatgggtctttggcctggctgagcaatagtgttatcctggtctcctggttcctggaggtgctgtactgaagtgtgtccctcttcctcttggaacagcactttttagagcactagatgccactgtctgtgtgacctcttcacttttgacctttctccctaggaaggactatagtgttggttgttcatcttcagccctgagcaccacttctacatgcaacattacatcctgactctcctccctttgaggcgtatgtccctaatctcttattataccaaagaggttagggagtggccttgcagtggtatgctagtaaaggtttaacagctggtcctctagcgggaaataagccctgatttgtagcatttgccaacttctgtcgtggaagcactctatcgtggctgacttcaggctaccaacgtgacctggagttgggaagaaaggttgtaaggtgagccatgtgaacagattccagtacatcgttgcctttgagaacagggacttggggtcttcattcaggactgccacacccaaggatgaagccatttgccttttccattgagctcctcagttactcctgcctacgtgttccagctgggctgactctgccggctcaggcacctagactccactctgggtcaagagaactcctcagtgctctgtttttgtctcttctgttggctaaaatagtgtgttccctggtttgatcttaagtttgttatgtttttgctctgctttgatgtcttcagaagaacccctttaaaatcaatttcgtgcactgatatgaaactgatggtatgtagagattgtgtcttatccagaaagtttcttacgactgatagaaggtaactgggattcctcattctgcagttctgttaacagtgttttctttctcccacagctgacaggcctgtcagagtatacgccgatggaatatttgacctcttccactcaggtcatgcaagagcccttatgcaagcaaaaacactgtttcccaacagctacttgttggtaggaggtaagaagtgcattttctttttgtctagaaaactcttttattgtatgctttctgaaaagagcccctttcagagttccatcagtaaaaatctcacattgttaatgcttccaattcagcccatactggctcgcttgttcactgcctgaaatttaaaatgatgtttgaaaaaccataggggaagttacatcatgggattgtataaccctgatcctcagagagagatggactgatagtaccaccaagggtaaatgcttcatgttttccattaatgcctttctattagtgtttaaggcttgatccaaattatgttcctaaaattttctagagggataagagaagcaatattattctgatttcaaatctcaaagaactaaagggagttaggatgatgaagaacaaacaaggtcatcgtctatttcttttgtgtgacctgcagcacttaagacaatgttgtgctaacactagtggcttgtaacagccccacttagttgaatttgtagcagtgtgttaaagacatggagatttatataccgaggtaatcttggttcacaacgaagggaccaatttactcgctaagtctatggaaagagaaggatcgttagatgtggactgaaattttcctcctccaggaggcctatttctttttggctaaaagggatagtacctgactaggaagacctgtatttcacttgtgcagcttcaggaaggagcatattcattcagagtaatcagtttttgtggcatataaactaggcaccatcaagtcttacacctctactgggggaaaaaagtactggtaagagactacataactgttttttaaagaattttgttaccttctgcaattaaaaaccactttgtttgtttgtttgtttgtttgagacggaatctcactctgtcgcccaactggagtgcagtggtgcaatcttgactcactgcaacctctgcctcctgggttcaagtgattctcccgcctcagcctcctgcatagctgggattacaggcatgtaccaccacgcccagctaattttttttgtatttttagtagagatggggttttgccgtgttgtccaggctggtcttgaactcctgacctcaggtgatccacccacctcagcctcccaaagtgctggcattacaggcgtgagccactgtgcccagccaaaaaccacttgttggacatttaagaggaactcttctgcaggttttgccaagggtggtgaccacaggaccattgaatggagttctttccagaaggaggaaatggtggaaggcaatggttactgggcaagtcatgcagagggaacccaaaacaggcagagaacccaacccttgcttacttccctttagcctgaaaaccattccttgagagagcactaccacctggagtctggtcctaggctactggggccctggagagacctctgcagtgtttgggctttggtcatttgggtggcctaagtttggaggtggttaggtgtgggtcacagttaacaggaacactagctgtggccctgggttatcacatccaaagtaagataaaaggaaatgtgtagttttcagtacgttcttgtaaattggaggaggcagtcagttaatatcagcagctctctaggtcattaggcaacaatggtttcactgactcactgatttcttcatctgacaactttcttttttttttttttttttttgagatggagtcttgctctgtcacccaggctggagcacaatggcatgatctcggctcactgcaacctccgcctcccaggttcaagtgattctcctgcctcagcctcccaagtagctgggattataggcgcgtgccaccatgccgggctaatttttgtatttttagtagagacggggtttcaccatgttggtcaggctggtcttcaactcctgacctcatgatccacccgcctcagcctcccaaagtgctggattacaggcacatgccaccatgcccggctacttttttgtatttttagtagagacagcatttcaccatgttggccaggtctcgaactcctggcctcaggtgatccacccacctcagcctcccaaagtgttaggattacaggcgtgagccaccgctcccggccccttcatctaacaactctttattgaactcttactatgtgccaggcatttttctgtacactggggatgcagccatgaacaaaacagactgtctatgtcctcagagaacttgcagtctgagggagaggcagtcattgcccactaaacaagtaaatatgtagtagtggtactatgaagaaatataggaaaagagaaaagagtgactgggcggaggaaggagggatgttttaggtataaaggtcagggaagacctctctgaggaggtgacatttgtgcagagacctgaatgaaataaaagcactcaaaagccagaacatccagtcttccttgtgcaggattctcaccagtcaagacaacagtgtgaggcaagcagagaagacatggtgacatgttagttttttgatttgtgtatcttaaggaggctttccataaaagcacagatgattcagtactcagggaaattaatatgggcagaagtttggagccaagaaataaagcagaagagaaggagaaaaatttcaataagaaatcctggactttttagcagctatagcaaagggggccacacagtcattctatcactctcaaactctagaagctgaattgtaccatcaggaagaactagtttttcctgcctgagttctgagataactgtttcagagggtcactgtgtaaggggcattgagtaatccaaagaacgatgtcctctatagtaggtttacacagaatttcagatattcccttaatggctattacatgggttgtggaagtcaagggcatattgaactacttggatgaccatgagactgtatcctttggtaagtgacaaggactggagtacaggaagaaaataaaacaatacagcatcaagctataaagaaatagtatgtagacttctgggaacagtgacagagtaagagtgaaagctgggcatggtggtgcatgcctgtagtgccagctacccaggagactgaggcaagaggatcacctggacccaggagttcaagggtatagtgagctatgatcgtacctctgcatagctattgcattccagcctgcacaacacagtgagacttcatctctaaaacaaacaagaaaaacaccaaccatgggcaacacaaacaataataaataatttcagtgtgttcttttctctgtagatttcttattcttatcatctcatttaaaataatcgaattgtaatactatgaaatatcttctaaccactctgctaataaaattcagtgacatcctggctgggcgcagtggctcacacctgtaatcccagcactttgggaggctgagttgggtgaatcatctgaggtcaggagttcgagaccagcctggccaatgtggtgaaaccctgtctctactaaaaatacaacaaaaaattagcctggcatggtgctgcacgcctgtagtcccagctacttgggaggctgaggcaggaggattgcttgaacctgggaggcggaggttgcagtgagccgagatcatgccactgcactccagtctggaccacagagtgagattctgtctcaaaaaaaaaaaaaattcagtgacatcctgtatttcatatgtctccattaatttaatatttgatcccaagtctgttaaatggaatctctaacctcctgtgtataggcagactgctatgggggcatggtataagagctcaaatcccaagagtggcattgctgtctgggtgtgatttcccaaatggtgaatgcctcttggtaaaattgtaaacaaaacaaagtgcaatcttcctttgatgtacatagtaattgccttcctctaaaattctgtgtctatcataactgttgcagaaatactttgtgattgtatgcaaaacaaaggcagattctagactcaaataattttatttttctaagttttttatttaatcatttttttttttggagatagggtcttgctctgtctcccaggctgaagtgcagtggagcaatcacagctcactgcagcctcaaactcccgggctcaagtgatcctcccatcttagcctcccaagtagctgggactataggcacatgccaccatgcctggctaatttttctgtttttgtttattgtagagatgggatttcactatgttgcccagactggtctcaaactcgggctcaagtgatcctctggcctaggtgtcccaaaatgctgggattacaggcatgagctagcacactcaacctcaaataattttaaatattatgcagggactttcaaaaatcttgcagggatgtgggaaaattctcatgcagagctgccacatgcattgcaagatgactagcttcattggcccctgcccactgaatgctggtagctgcctccaaccattatgacaattaaagatggcccacagatttccaaaatgcttcctagagaatgatgaaatccttgttgaggaccactgtcttagactaggagtcttgaaattttgttccccacaatctctaaaagaattttgaaaaatctgtataccttcttatacagtttaaagcagatgtctaaaatttatatatcaggccgggtgcagtggctcacgcctgtaatcccagcactttttgaggccgaggcaggcagatcacatgaggtcaggagttctaaaccagcctggccaacatggtgaaaccccatctctactaaaaatacaaaaattagctgggtatggtggcaggtgcctgtaatcccagctactcaggaggctgaggcactagagccacttgaacctgggaggtggaggtttcagggagctgagattgtaccactgcaccccagcctgagtgacagagcgagacgccatctcaaataaataaataaataaataaaataagtaaataaaatttagatatctgcttcttaatttaagtagttataaaagatgtaaattctggaatattgtgagtattagcctttttaaaaattaataaactttattttttagagaagttttaggttcacagaaaaattgactggaaagtacagcgaatccttgtatactcctttctcgcacaggcacaacttcccctactatgaatatcctgccccagcctgatgcatttgttacaatccattagcctacattgacacatcattatcacctcaagtccatagtttacattagggttcactcttaacgttataccttctatgggtttggataaaattttacattgtccaaactcatagatgtacattgtataatgacaggtatccacaatgatagtatcatacagatactatttttactgccctaaaaatcctatatgctctacctattcatctcttcctccctgtaacccctgacaaccactgttctttttagtgtagttttactttttctagaacatcatataattagaattatacagcatgtagctttttcagattggcttcttttacttcataatattcaattaatgctcctcaatgtcttttcatggcttgctagctcatttctttttggcgctgaataatgttccattgtctggatgtaccacagtttatccattcatctgccgaaggacatcttagtggcttccgcattttggcaaatatgaataaagttgctataagcatccatgtggaggtttttgtatggacatacattttcagttcatttggataaataccaaggagtgtgattgctagactgcatggtaggaatatgtctagttttgtaagaaactgccaaactgttttccaaagtggctgtaccaggagtgggtatagctcagaggtagagcattcaactgcagatcgaagtggctgtaccattttgcattcccaccagcaataaatgagagatcctattgcgtcatgtccttgccagcatttggtggtatcaatgttttggacttttgtcattctaataggtgtatagtaggttgttttaattttcaatttcctagtgacatatgatattgaacatttttcatgtgcttcctggccatctgtagatcttctttggagaggtacctgttaaggtctgtagcccattttttaaaatccagctgttttttttcttattgttgagttttagagttctttgtatattttgggtagcggtcctttatcagttgtatcattttcaaatatttttcgcccagtccatgtctttttttttttttttttcgagaaagagtttcgctctgttgcccgggctgcagtgcagtggcacgatcttggcttactgcaacctctgcctcccgggttcaagcaattcttgtgcctcagcctcccgagtagctgggattacaggcatgtgccatcacacctggctaattgttgtatttttagtacagacagggtttcaccatgttggccaggctgttcttgaactcctgacctcaggtgatccaccaacctcggcctcccaaagtgctgggactacaggcgtgagccatcgtgcccggcccccagtctatgccttgtttcctcattctcctaacattgtctcttgcagaacagaagtttttaattttaataaagtccaccttatcaattgtttctgtcacggttcatgcctttggtgttgtatctaaaaagtcaccaccatacccagaagaaacccatctgggttttcttctgtagagttttatagtttggcattttacatttacatatagtttggcatttacatttgatttttgtgaaggatgtaaggttatgtctagattaatttttttttttttttgcatgtgaatgtccatttgttccatttgttgaaaggtctatgtttgcttgcctttgctcctttgtcaaagactggctctctgtatatttgtctgggtctatttctgggctttctgtctgttccattgatgtatttgtctgttctttttgccaataccacactgtcttgattactgtagctttatagtaggttttgaagtcagatagtgtcagttttctgacactttcttctccttcaatatcaatttggtttttctggatctttttcctttccatataaacttttatttttatttttatgtattttttaagagacagggttttgctctgtcactctgaggccctacttgagctcctggaggtaaaacccacaaaagtatttgtcccctggcttcttgaactcttagacttgtccacactgaggtgccagcgatttgtcagtttaaattttcctatcccagcactggttcctggggaggtagctctgcttgtgggtttctgctctagtaagctaatattctctctatctgcctgtttctctctccaattttgggagtagtggtttgccctgtgacctcagttctctgatggatctaagaagacctgtagatttgtcagtttgttcagtttttacttgttgtcaggaccgagtggccacttttaagctccttacctaccagactggaaaccagaaatccaatattgacattttaaaacaaaattatgggccaggcgcaatggctcccgcctgtaatcccagcactttgggaggccgaggtgggtggatcacttgaggtcaagagttcgagaccagaccagcctggccaacatgatgaaaccccatctctactaaaaatacaaaaatactagccaggcgtgcacctgtagtcccagctactagggaggctgaggtgggagaatcgcttgaacccaggaagcggaggttgccatgagctgagattgcgccactggactccagcctgggtgacagagtgagactccatctccaacaaataaataaataaatacataaataaaaaacaaaattgttaccccatcactttaatgcatctattggcatctaaatactataatgctttgaaatatatcatcaacaatttacaaaacatataacaagctattttttaacttttaaatatttataagtttcattttttccctcaaacttatattttcattctgcttctctcccataatttttcctaatgtgatgtgttttaatgtttgcaaatcttttagtgatcactgtatcatacttctctgaaacaaaaatatgtatataaattagagcataactaaccaaagcaccacattatatacactttgataaataattgttaacatagacataaatttggacagcaatgtatctcttaatgagatgaatagtatgtacctggagatgtacttatggatgaatataactgactgctagaatgaggcagggtttaacatcaattttatccctattttttccttgtcatagttataagtgctgaaatatgttgttcatgcaaatgtgtagatagaatggaaggagtttgttacagtgatgccactcaattctttgaacttctgagttatttaccaaaaataacaacataatttattattattattgccatcaaaagtaattttaatggtctatcaagtgacaatttgttaagatcctccttcaaatttgttgcaagcaatggattagaaatgacctgacctgcaaaaggatttgttgccaagctattagaatcatttgctttttctctttctgggacttctaacaaaaggctatatcaagagttattaaatgactcttaattatatcccttattcttttacttgaaagcaacttattcaactagatatagccagaaaggatttgggaaatggaaatattagtaatttaattacatcattgccaatcaagtaatttttgataaaatgcttttatcatttgcttacaaccttttttaaaaaacaaaatctcagggctacagtttcagattactaactttgcagaaaacaccatccaaccaaattggcaaaaccagtcctcattgtcaaacctactaaaaacctacaaaccaagaaaatgtcttttcaattcaaatgcattaatgtattttcagttcaaatgtattaatgtatttcaagaagctttataaaaaacactcaaaaataaatgatagaatggattatgtaaaatagaatcagtcaagattaaaatgatgtagatctaatataataagttataaacaagacaagacaataaatcaatgcacttaatttgtagtaatgcaatgtaatttatacataaaattatgtgatatttatacgaagaagagtatgatttttaaaaggcatgttattccttctctaaatattggcacacgtgtgtgtgtgagtgtgtgtgtgtgtgtgtgtgtgtgtatatatatatcaaattctagtgtttgccttttgggaataatcaaataaatatgaaaaacagaaatagttatctttagtagataccatgactaaacttttcctatgtatttaaagatagaaagggggcatatattattaaaaagtaattggtctggaggcagataataattttattttttgttataaagaggtagaaaataaacattatagacaatgagatgaattaggatgacctgtaaatagaataaatattttatgatataagttgataacacaggtttttaacttcctttttaagtaatgcgtatgaagcctgtaaaaaattatgtaaatgttttacccatgtgtctattccaatgtatcttgaaaaatttgataattctagaaaatattctagtcacatttctaagaagcagcagtaccagcctatatagctttggtttattgaagtgattttcaagtaaatagctggaaaaaagtgcttactcttatctacaagagaaaagccatttttaggattcaatatgagtgttaagaatagctgaaaaaatgcttacccttgactacatgaaaaagccatttttttagaattcactatttctttccaatgctccttttgctttgagttcttgggccttatccctaaagatccatgtgttttttgacaatagttgggagaagaggcaaagttgttgggcaaaaatttgcattattctccactctaccatattgagtttctaacactaggcttcacctgtaacagaaatgtgtgtaagacagggaaagacaggaagctttcataggttcatggtgctttgaatggtcactaactgagatttccatttggtttgccctgaaggctaaatcgccctccaccccttccaatgcaacatattaaggtttgggtggtgcctttcttttgtaaagtggagtaagcatggctttggacccagagactttcttgacctagttaatattaggaaagtgtaccactggaagttgaatctggacattgattcgtttaaaactagctgttcatggataccttttgaaaagtctatgtggctgggtgcggtggctcatgcctgtaatcccagcactttgggaggccgagtgggcggatcatgaggtgaggagttcgggaccagcctgaccaacatggtgaaaccccgtctctactaaaaatacaaaaattagccaagcgtggtggcacacgcctgtaatcccagctatttgggaggctgaggcaggagaattgcttgaacccgggaggcggaggttgcagtgagccgagatcacgccactgcactccagcctgggtgacagagcgagactccatctcaaaaaaaaaaaaaagaaaagaaaaaagaaaagtctgtgtgtgtccatgagggtatatgtatcgtagtttaaggagacctttatcttagactgtctttctggagaatgacaaaccaaccaacttaatggcagacaattctatactgaggaaagttagggaggtcttcaagaataggtgtcctgtgttgttggttgaaaggctggatcttgattactgtatgtgtggtcaacatgtaaaatgcttacagtgagttaaatgggcctgccatattaactagggtcccctttccatatgcaggtaggtttgctgtaggagttcccttgggtggagcgaagacttcactcatgaaaccactttggtcagggcaagtatggggacaagtatttggtagaaatacttggtatttgtcagaaatcatttattaaaggaccagaaactgtgataactggaggtactatagtctatttctcaaccttaggcagtaaaaggcaccacaatcgtcatggttttgccctatgattataacaccagcactttttttttttttttttgagatggagtctcactctgttgcccaggctggaatacagtaccatgatcttggttcactgcaagctccacctcctgggttcaagtaatcctcccacctaagcctccccagtaactgagattacaagcatgcaccaccacacctggttaacttttctattttaagtagagacagggtttcaccatgttggccaggatggtctcgaactcctgacctcaagtgatctgcccacctcggcctcccaaagtgctgggattacaggcatgagccaccgcacctggcccaatacctgcacttctaattttttaagcatgtagccagtaataatttgaaaattcttctatgcaagcttaccttgttggcattattttagtgaattgagactctccacttgtaaagctcttttttccttcattttaatttacaagtttgtgtcatttaaaaacaggccaaggaattaaaatttatactagtgtgtttttttccctaaaaaaatttttaaagagtcaccaaatagccacctctgcttcgcaggagggcaataaaaataacaacagtaaacatactactactactatagaagacataaagattactccacaaacttgtgtttattttattatattttaattggaactaaatattctttaagagtcccttttgcctgactggtaggaaattcagtctcagtcttttttttttttttttctttgagacagggtctcactctctcgcccagactgaagtgcagtggtgtgatctcggctcactgcaaactctgcctcccaggctcaagcgattctcctgcctcagcctcctgagtagctggaattacaggcgtgcaccactaacgcccggctaatttttatgtttttagtagagacggggtttcaccatgttggcctggctggtctcgaattcctgacctcaaatgatccacccacctcggtctcccaaagtgctgggattacaggcatgagccactgcgcctggcctagtctcagactttactgggctctctttacctccccagagtcaaacaagtgtccacaatgtttatagaaacaggagcggggcctccagtcttcaacccagggctatttttgcactgccctcactgtctgagcccagataattactagaagggagcagattcattgcacctatcacagttcagtcacctgcagtctgttcccaggtagaactcccatgcctagggcctcacattctcatctctcttgaggtcctgccactggcatctgctgcttgtgggatccatagacatttggccctttccctgcaatttggagagatctcctctctcattgtcttcttctttccagaatacccctcaagttgctctggcttcaggaaaacagcagccaggaaggcaggctgtctactagcaacttgagctcacagcacctacaaaggagtctgtaccacggggccctcatacctgcttggagtagggggcagggaaaagacagaacacaaaatctgaaggaatagatccatgaatgatcgtattttcctactactattcgtaaatggctaacattattcagcattactctctgctcataaagatgatcaaatttaattctcaaaacttcaccatgttttaaagaccagataactgaggctcagagagtttgagtaacttttccggtaatagcagagctgggattagaacccgagtctgttgggctcccaagctcaattcctatgttgtattttctctcctgtgggagcacagtgagctgccagcataggttagttgcagcatgagttcccagatagctcaatgaattcatccatggaataccgctgcccagagctctccatctggttgtcagagtgcatttgccaagactcaagaacaacagtgctgctttgggcgtaattaatgtttagacaataactggtcagcatgttcagctgcttcttgaggtcactcctgggataggaaaataggaccctgtattggcataaacaggatgtttgttttctttgtgctctatcagtaggccattatctcggtcatgtagaagttataccaaattgctcaggtgcagattcagaaagggggaggatgtggcacggcctagttttgtgctgtttaaaatagaaaatggaaaatggatgaatctgaaatccatttctgctcaatatgattctcagggtggtattttaataaggtcctaaaagaacattcaaaaagtcttagattggttttgaaatcatattgcatggcccataaagaattcctgtttatggggtcaaaaactaatatagtcaataaatcaatacatagttattatggccctactacctgtccctcctgcccaccttcccccccacctctgggcataatgggtgatttaaagacaggcagagctcttgactcaagttatttataatatgcttcagggttttcaaatgttgtcttcatcagaatcatctctgaagcttgtcaaagacagagctatctgggccccactacagacttactgaatcaaaaatctcagggagtgagctgggtttctttacatgtgtttaacaagctccttgggtgattctgatactcatcagttttcaggccagacatatggttgatgttgttttggtaatataaacttttataatagaaaacatctcaggaagtatgtataggagatatagaggcatatatatatatatttatatgcatctagaagctcattagtctctcctttgcgtgtatgttgttgaaacgttcctgtaggccaggcgcggtggctcacgcctataatcccagcactttgggaggctgaggcaggtggatcacttgaagtcaggactttgagaccagcctggccaacatggcgaaaccccatctctattaaaaatacaaaaattagccaggtgtggtggcaggtgcctgtaatcccagctactcgggaggctgaggcaggagaattgcttgaacccagaaggtgaaggttgcagtgagctgagatcgcgccattgcactccagcctgggcaacagagggagactctgtgtccaaaacaaaaaaagaaaggaagaaagaaaagaaaagaaaagaaaagaaaagaaaagaaaagaaaagaaaagaaaagaaaagaaaagaaagaaagaaaggaaagaaagaaagagagaaagaaagaaagggaaagaaggaaagagagagagagagaaagaaagaaacgaaagaaagaaagaaacaaagaaagaaagaaagaaaagaaaaagaaggaacctgtagataaatataaatctattattgtaaataataataaatatttcttgagtatctatatgtatcaggctttgttaattcattcaacaaatattgttaaaagcctactaggggccaggtatggtacatcagaaaatgaaacaaaagtccctgccctcggggaatttataggggaacaccaacaataaaactaaataagacagctacatgagacaagtgtcatggggagaagtaatgcagcagaggatcacaattcagaagagggtgggtctacttgggaggctgaggcaggagaatcgcttgaacccgggaggcagaggttgcagtgagccaagatcgtgccattgcactccagcctgggcaacaagagcaaaactctgtccaaaaaacacaaacaaaaaaagaagagggtagggggaaagacttgagggagaggagaaggtgagctctatgagtatttggagcacaactattccaggtttggagaatagtgcaaggcccggacctgagaagaagcattcaagaaactgcaaggccggggagctgggatacactaggagactggtcagggaggcaaggagtgggcagaggcgtaggtcttgtcagccactggaggactttggttttactctgaatgagacaggaagggttctgaatttgggaatgacacagactgacaagcttcaacaggctcattctggccaatgagaataggttgttgggagtgggcaaggctggaatcaggagatcagttaagaggctactgcagtcatccctgggagagatgatgaaggggtggggatgggagcagtggaggtgctgagaaaaacatggcttccgggtgtgctttgaaggcagagcctgcagttttcctgatggcttgggtgtggattatgtgaagggactacaaaagaaggttttccaaggatgctgagtgtgactgttggctgtgcttactctgtggccagatttgattctgggtgtgggtcatcattcagttccaagaaaatgatcatatttttgttcttaaaacacatcttgtgagattaggcagtatttgtcttcctgtgtctggcttatttcacttaacaaaataacctccagatccatccatgttgccataaatgacaggatttcattctttttcatagctaaatagtatttctttgtgtttatataccacttatatatggaatctaaagaagctgatctcatggaaacagagagtagaacagtggttaccagaggctggggaaggtagatgacgggggacagggagaagttcatcaacgagtaccaagttacagttaggaggaataagttctggtgttctattgcacattagggtgactatggttaacaatattgtatatttcaaaatagctataagacagaattttgaatgttcttaccacaaagaaatgataaaggtatgaggtgatggatatgctaaatatcctgattagattattatacaatgtatacatgcatggaaacatcaccctctaccccataaatatgttaattattatgcatcaattaaaatttttaaattaaacacatattgtacacttaacattagtgaatttgttggctgggcacagtgcctcatgcctgtaatcccaacactttgggaggctgagaccggtggatcacttgcagtcaggagttcgagaccagcctggccaacatggtgaaaacccatctctactaaaatacaaaaattggctgggtgtcatggcacgcacctgtaatcccagctgctagggaggctgaggcaggagaatcacttgaacctgggaggtggaggttgcagtgagccaagatcacgccactgaactccagcctgggtgacagaacaagattctgtctcaaaaaaaaattagtgaatttattgtaagtacataatattttaaagaaaaaaaaatttcattgcaaagagcagtcagggtagttctgactggccaccgcaaggctctcactgggatcttggtaaacagggactgtacccacaatgatatttcttcctgacacataggagatcttaggaaagctgccttggccaaccaaaagataggatagtgaatagtatttattgttcagtttgtttaaaagcactttttttctaagttctcgaaacatcttttctaaggctgatagtggaagatatccccatttgagggttcaggaacctgagatctagaaaatataagagatgtggaggccgggtgtggtggctcacgcctacaatcccagcactttgggagcccgaggtgggtggatcacaaggtcaggagatcgagaccatactggttaacacagtgaaaacccatctctactaaaagtacaaaaaaattagcctgggtggtggcaggagcctgtagtcccagctactcaggaggctgaggcaggagaatggcgtgaacccgggaggcgaagcttgcagtgagctgagatggagccactgcactccagcctgggcgatagagcgagactctgtctcaaaaaaaaaaaaaaaaaaaaagagagatgtgaaaggatgaactctactagatcaaacctttgattttatgactttcttctcttgattgagtgacctgatgtgtagtgactggccctcaatccagggaacagaagtatatgtatttgtgtgtgtgtctgtctgtctgtctcacacttgggttacaaagtacaataatctagtaaaataattggaactgattgttcaaaccattcaaacctcctgtaaatcaggcctcttggttcctctccttctctccctcctgtgtctgttcatttggtcattttatttctgaatggtaattttcactgaggggtgggataggaaaataaaaagatatgaaagtcacattaggtagtgtagagaataattttaatagaagccacagtggagaatgcagatgtaattagcattaaaatgaaattctgaattgtcggtggattttagcttactttgctctccaaatcctttgttccctttaaaaactgagtacaattatgacaagcacctagcgaggctgtgcttcttttgtcctgctgaagaagccttgtctgaaccagggtggctgtgagcaggtcctgggccgagtaatggcatttaatgcatttgcctgttttagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaaggtacttctcattctcccacattctctaagtagcaagattagggagtctggttctgcagccaagactacggaaagcccaaagtctctctcaatttctaaaagaggtaacttcaggaactgtcatgtggaactgcttgatgtggcacctttcgtccgcccaagcccgaggactggtatcctctcacttctttgagtgtgggccctggagctaaaccgcccaggtccaaatcctgcctctatctcttcctagttgtgggaccttgaacaagatatctaaccacactgtactcgcttacctcaactgtaaaatgggatgatgttggtatcttccttgtggacgtgttttgaagatctaagaggtaatcttagttaagcagttagaacactggctggcccatagcaagagctccaaaaatgtcattgtcaccaccatcaccaccgtcattattgatgcttatcgattcacaggcattctttttcatgggacaaatgaacacacatcttatccagaaagtcacaggtcagcctttaaagaaagaactttatatctatgattttgtgaccctgagaatcctactgacataagatttttattagttggaaacatgagagattcttttgatctgcatcaaattatgtgctttgtatctccctaccagccccacattaggagctattctttccttttataagcagtacaaaaaaaataagattaagctgttctaagaattttcttttctatttttaaagccacgatgcagaagagaatagagaacactgataaatgtgcatgagtaatagctgaagagacaatttcccagtgagaataaaaagaaaaaggaaaaactacaatatgatttacttccagtaatcactaccacatttttactaagcatctattgtatattcaacatgtgctaggcattatgggggatacttataatgataatgatggctgtaatttattgagtatttaccatgtgcccggcactgtgctaagggccttgtcattatatgaattgaattcaatctcacagctaccctgagaagttgttattatacattggagaggaaaaggaactaagtttgagtactaagaatagaattaataataataataataataaacatttattgaggatatactccgtactaattgtttttcagcatttttacataattatgtcatttaatccagtgattctcaactggggtgagtttgccctgaggaacatttggcaatgtcttgagacatttggggttgtctcagctagaggggtgctaccggcttctagtgggtaaaagctaagcatgtgccaatgcacaggacaactcccgacaccaaagaattctccagtcccgaatgtcactagtactgagcttgagaaatcctaattgaatctttcccctaacttatgagttatatagccagcaagtagtggggcagggaatcatactactctaaactatctctaaactacctctcaagtatttaactactgctactctaaattacctctcaaggtagagtgaaaccccattataaagggcttgttatacagggctttaaaatctaggcaaggagtgtttgcttgatgttgcaggaaacaggaataaagatgagcaggcatgaggatgaccagaaaaaaacaaaaacaaaaacaaaaaaacctgtttaaggaggataccccatgtgacagcaggatggcttggagaggagggggcctacagtgaggaaggccagatacaagttggtgtcagtaatctgggtgaccaggtcctggatttggtgtagttgcaatggagagaaaatgatgggcacacacctacatatgcatgtgtgcacacaaacacacacacacacacacatcccagcagaacctagggtgagtgaaataagtagagaaaagaggcttattccaaggtttgggtctccccaagacccaaaataaataaaataaaagtgccattggaaggggtcactcgttttcaggaagatgaattaaattcaggacaggacaggacaagatgatttaaagtgacagcaagtggtaaaagagagggatgcagtgggaattaagcccacctggcctggtgccctggcagcccgctaaacatggcctggtgccccagcggcccactccagtctttaagccttgggtaaatctaacaaattttctagtttcagcaccttatgtcccaactgaagtagtaacatgtggcctgcccacctcacaaggtggttatgaggatcgaatgaggaaagagacaaattccttttcacagtataaaatgtgacctaagtgtgagtgcccattgccatcaatgggacaggaaatgaagatttgggttcctcatcataggagggatgataaaaattcaaagaattaatgagttctctcaaggagaaactttagatgcagaaggacagaagaccaagaaatcctactctctggggtaggacaagaaagagggaccagcaaaggagagaaaccaaaacatttattcttctagttcccattatctcatagaaatgaaaatagttggaaatacatttcagccaaggattcaggtctccactataaatgtaacatacaactgccttattttgaaaaggcattatgaagtcaccattccccccttcaaatctgcagacatgcacatccatcccagtggtgacatcactcttctctctcttcaacagattgactttgtggctcatgatgacattccgtattcctctgctggctctgatgatgtttacaagcacataaaggaagcaggtgaggcattcccctgtgctcacctgtcaaccacatcacaataatcaggtgcaataagagacatctgtctgccctgggacatctgcagtgtatacaaacagggagttacaactttaggtgtcccccaggcggcttctacaagccactgttagcatgtgctaaggctcagttatggcacagataccatttaggtatttatataggaatgaacctgagcaccaaagtgctcaacttcaggtctaaggcttaatttccggggtcatcagacgaaaagtgcaggaccccattacttaaatggcagccattttcctcattcataattaagtcttcacaatgagattattggatactcccaagaaatttccttccagaagcaggtagataactggctagttaataatctggactccttctgtccaaagttagtcctgccatatttctagtgtcatcttgtcacatgttagtaatattatcaggtaccatatgtggaggcaaaaaaaaatgggtaaatgttttaatggcttggcttattttctgctattttactatctaccatgcatctcatctataggcactgtaggtacacccatgcataccttcctacatacattaaaccataatctggcaggtgcagatactatagtgagttaccatatgcatagggatttcaagaagtctagtgctccctgcttatactagagccattgttgacatgtgccatcagagccatcttccccactcctggggaccaatgagactccactcagcttgctcccaccatttcccactcagcctgctgccactacagccttttcttggtactcatggaccttcagattcttgaggtaggatgggctcctaagggtcactgacccaggctcctatctccttcttggcatcattgccagctcctggcagaactgatgcttttacattccccatgatggagaactccctgccttgtgaggcagcccgttccatcttggatggttttggctgtcattgtttaatatatgaatcccctgagtgcatctataagccaggaattgtataagagaaaatgaataagacatagacctcacccttgagagagagcagagacagacataaataattacccaaaatataaccagcctgtggcagagtatatacaatacagcaggccagggcagcatgttcgaaggtgggactgtatgaagcacagcgtgtctggagaaaataaacatgttaatgtagtgtagggtgtgtggaggtgggaggcagagatggagactggcaggacaagctggttgaggcttgcttccatatgaagttacatggaaccaaatactgttctgaggcaggggagtgtcgtgatcaggtcttttgtgtgggaaggagcaactggggggccataagtggtttccataactaaacttaactaggaaaccccatttccacagctgacagaaaaaaaaaatacacttgacatgtgaaatcattcagactcttctaggtttgtacttagactgtgtagagtaaactttttgcctttttctcctgaggtgatctaagtttctggagcactctggcctggcatgggatggggatctttagttgtgaggtctcaagacctgcttagccatcagccccacttaccagacccctgtggcagcctctgagactctgtcatctccccactttggcctgagactgtcacctccccactttggcctgtcctggccacagcatctgccgcaggattcccttccctgtgctataggtgtgctgcccagcagtcatgctgatcttaaatcttggcttccttccatattcctctagagagtccccaggaaatttaaaaactgtcctccataatctactagagggcaagggaaaccaggcaatgtcagtaagccatgtcaggccctgtctgacctgcccgccatgttggcctctgtaaaactatttctttccaaaattcctggccataaacaaggtgccagtggccctgcactgagctttctaaaggggtctctttcctgcccctgcccctggtatttgaacctgagtcagagcaagggacagaccgcactcctgttctctcatttctgctgtccgcctcccaatccctctctgcactcctcccctcaactcccagaggtgcttttcttcttcctggagagcagaaaactgccccttaattaatttcatgccttcccagggttaatatacactccagggcttatagtcaaacattctgtaccctgagtctactcagcctctggttcttaatagttcaaaagacacttctgggatttataataccctttttatactcctcaaagcttggctcttcctagtggaattcttgcctttcttaactcttctttttaaatgagccttaaaaagagcctgttttagaagttgaaggctgaacacggcctcctgtactctcagcttcatctgcctccccctgaagtcatcgagttctcagtgtccatgggaacagggcctcaggacagacatgatccctagaaatgaaaacaacattggatactattttgaaaaattattgttacataaaatgtatgtattctccctgatggcatttttgttggttcacactccttgtgggccagcctgggaagctccatgccatcccctgcagggctggtggtggggactgtaccatcctcttaggaaggacttcctgagaagtcaagagcattggataatgggaggcctgacattctcaagtctcaatcttgtttgtgaggagttccaaggaaggaaacctcatacacttcggacttggaagtctgctctggaactggagaagaaactggcagatgcctcagttacatcaagatgggttacagcatggcgtgattaatatttatttatttacttactttacttacttaatttatgagacaagttctcactctttcacccaggctggagtacagtggtatgatcatagctcactgcaacctcgacctcctgggctcaggcgatcctcccacctcagcctctcaagtagctgggactacaggcacacaccaccatgcccagctaattttaaacttttttgtagagtttccctatgttgcccagactggtctcaaactcctgggctcaagtgatcctcccacctcggcctcccaaagtgctgggattatagctatgagccaccatgcctggcctgataaataccctttaaagtcattgtaagatctgaactatgagccagctgctcctttcctaaaattgccataaggatttgttatagaccagtgcttatgaaacttagatatgcctcagatcatctgtggaatcttgtgaaaattcagattcagattcagtaggtctggtggggccagagattcccatttctagtgagctctcaggttgttagatgctgtaggtccataggtctcacttacagtagcaaagatctggaccaggcattctcatccagctgagttatccccagggtttcttgaatcagtgtttcctgggggcagtagttccttggctaccttatagtgtataggaataagcatttggtggcagttttctttctgggtgagtggctgtcagtgagctaagaatatgttgctttcctgatttggggaataaaatgtcaagttccagttgtttaggtgtaggaacaagtccaacatttttctaactctagcaatccagcatccctattgttgcataagaaagtgactcctaaagttagtgacttaaaagagcctcttgatttcactcatgattttgtggggcaggattttagcagaggcttggctgggtagttcttgcttggggtctctcaaacagttgtaatcagatgttggtgggggctgtggtcatctgaaggctcgactgggctggggctcccaggtggtacacttacgtggctggccttggatgctggctatgatcatggcactcagttgcagttgccactggggcatacaggtggcctcttcatgttgcttgggcttctcacagcatggcagctgaaaggtaatatctagagagaaagcaatcttgacagaagccacaaggcttcttctgacttagtcgtggaagtcacacagagttacttttgccacgttcatttggtacaagcaagtcactgaggccagcccagattccaggggaagggaattgggccatctttaatgcaccacaatgccctttccaaattgaatagtcaggtagcattttacttgccctagtagcacaggctaagactcgatgtaacttttcctatgtgcaaggacccttccttgtgctccatcaaatctgctctgctgattccttagcaggagggagaatcacagtaatgatctatttgggacccaggtagagaaggccagaattcatcatgggagaaagatgctcagaaatggcctcagcatccatatttggctttcatactcaaatcatggcttattttgaaagtcaaaagtctctttaaatgaaaccagagatatcaagggcatgacttaagctttacaacactctgctctgcttgtcagaactatgtgtcaaaatcctctagcaaagctggatgaaaagatggagcttaaattaaatagactgtaaggtccacattactcatcaccattctaatattgcctactactgttgaaagtttccttcattaacatgtgctttgctgcttcttaaaatagctccataaccaaatgccgcaattctgaaaagcatgataaaaaaggttctctgatcatgctcattaccgaatatttttagcagagcaataattaggatttgaaggaagccgggtatctcattatgtcaacagaggacttggcttctttcagagacctacctcccaaccagccaaagcaaatctctccctaagccaaatctactttcagttactcaaacacagagacttcaccttctggcttcaaagaaagggtaagctcatggcatcaatgtcttacatgacttgctaaaatccattagtcactagagaatcgtcttattatttcagcaggaggggtgtgggtaaaatatctgcctgctgaaagatgggatggatttctcaccagaatgttccccactgttcccacaaaggtggggatgtcgtctgagggttcccccacccaccagagcctcctgcacagctgggtcaatttgggtgctatttatgttcgtgtgtttagatggttacatcttctgccttccatttggttttccgtgttagattcttccctcctagaaagtgataaaagaagtgtttggcctagtggcaaaccccaactgtcctctgaccatggaacataagaaactggatgttttgtctctaacatcagcagtgccactctgctactgatactataaatgtgcaaatgacatcaaaagaaagctccaaagagacaccctcattggggctgcaagatggaaacattcagagagaactgggtttggaagggcacttagagatcaatattcatctagtcattcattcaagaaatattcctatggtgcctgtttgtcacccagtgctgagaatgtagaagaggacgagaaaggcatgatcccttccctagtgtagcttatagtcaacaagacagttgttgaacaagttattttataaagatcttgctgtatttggagggaaggggagtggtccatgggaaggaacaacacaccagaagacctagtctgagggttgagatatttgcttgaggaagtgacactaaagctgaagcccagtggatgcccaggagttaaccaggtaaagattgtgtctgtggcagagtgaggggaggggaaccaaccctttcaggacactgaagaaacccagcatggctgggctgaggcagggtcagcctactgcacagctccacagaatacaacagcagtccccccctgcagttgtatagcaggggggccttggtttagggagtgaaagggagagggtctgagataaaattggagagaagcacagggaagagacatgcaagctactgcacagccaagttaaggatttgactctgaatccagagaagagcagaaagccagtggagggttttgagcagacctctgacttgcatttagtaagaatgctctgtagaacttgctctctgggttgaggcagacaaaaatgacattgctggagactggttttgaggttcttgctgtgatctttgaccaagatggtgttgaattggtttaggatggatgaaagtgagtgaattagggaaacatttaagaagtagattgggaacttggttggatgtgggaagtgagagagaaagaaatggcacagatgagtcccaggtcatcatgtccaatcacctttttctcagctgaggagactacagttaagtaactcgccttcagagggtttgagtgacttgcccacgtctacaaaccaagaacccagtgcccttgtccccaggctttgtccatactgtcccatgcctgatgcctctgactgagttgccgtaatgatatgggatagaaagatctcagttgccaacaacatgtcatttcagttcacaacagaagtgtaagcataaacctgattcttgcctttgttaatatttgtgacctctttatagctctatatctgttgatatacccacatttatctttgaagactttaaggaagttctattagaacttggcatcctctgtgcttgtttattttttactcagccccacatattctagatgaaagggcctttgagtggtgaaactaccatgtacagtagactgttcttaggaagataaatcatctaaccatccctacaggcatgcctttagatcagagacgacacaaatagtacactttttcttcttttcctttagtataatgtgagcagacttccttggagatgaagcagagttgctgtgatctaattcattgactcagttgttagtcttcatttactttctcactcaatttccatttattgagcaccttccatgtgctagacacaggggctgaggtgggtgctggggatgcaaagacagttaaggcactatcagtgctttcaaaatgttcattttctacatggagacaaatatttaattttttttgtttgtttgagacaaggtcaggctggagtgcagtggcgcagtcactgctcacagcagccttgatcttggactcaagtgatcctctcactttagtctccgaagtagctgggaccacaggcgtgcaccaccacacccagctaacttttgtattttttgtaaagacagggttttgccatgttgcccaggctgatctcgaactcctggactcaaatggtctgcctgcctcggccttcgaaagtactgggattataggcatgagccaccatggctggcccaatatttttgttaatgaaagataagttaggttctgaatgttgtggattctacctgatgacgtcagaaaagacttcccagaggcataaccttgaagctggactttgcaggatgaggaagagctttgcagttaatatgagcagggagggggtatccagggcagaaaggaaaggctcagcatggataaacagcaggggccaggcaagtacatggtatgtcctggaaacaggtctgggatgatgaacatgtagcatttaaggtagagaggaattccacggaactgagggtggaagagtcacttggggccagacgtaaagtcttcattggcatacccaggagctccaactttgtcctgtaaagggggaccattaaaggagatgggtcaactgaggtgatcttaatttttcctctatccgctcttttctacttgaacagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgtaagcatgccacctcaaaccctctgaagaccaccatgccacaccaccaccaccagtgctgctgtttattgagcacttactaagtgctatgcagtgttctccctctctctctctctcttttttttttttttgtgtagagatggggtctcactgtgtataatattttaagtttgatttaacttgtttttttttttttgagacagggtctcactatgttgtccagactggtcttgaactcctgggctcaagcgatcctcctgcctcagcctcctgagtagctgggattacaggcatttgccaccatgcctgtgcagtgtccttaacgctttgtatttattttctcatttaacccacacaataacccatgatgtattattatccccattttacagatgacaaaaccagtatctacaggggtaacataaattaaccaaagaacacaggtagtgagcttcacattttataaaggtgcttccttgcttccctcctcttaccccaaactctctctttagagtttttagacttgattgaagggtttctgggagatctgccccttgtaaaaggcaagagttatcttctgctgaaaggaaagggaggagggaagaggcaatgaaagctaaacccagagaaacttttttattctaacgttttaaaattttcatttgattaaggccttacagatgctcattagaaaccttaatggccatttttcattgtccaaagaaattacagctgcttaaataaagcctaaagtctttggcttccttttgtagttctaccatattgttcccacaggactgctgttagtttaataatagagcaactgttaaaacaatatttcagttctggcatacatgtgcagaacatgcaggtttgttacataggtatacacgtgccatggtggtttgctgcacccatcaacccgtcatctacattaggtatttctcctaatgctatccctcccctagccccccaccccctgacaggccctggtgtgtgatgttcccctccctatgtccatgtgttctcattgttcagctcccacttatgagtgagaacacgcggtgtttggttttctgttcctgtgttagtttgctgagaatgatggtttccagcttcatccacgtccctgcaaaggacatgaactcatccttttttatgtatgcatagtattccatggtgtatatgtgccacattttctttatccagtctatcattgatgggcgtttgggttggttccaagtctttgctattgtgaatagtgctgcaacaaacatacatgtgcatgtgtctttatagtagacaaagaacattaacagtgacttagattccctcaggatgccatttttatataataataataataaaaacaatctttaaaataagcaaaacaagctgttaaaaagcaaagagggcagcccagttgctggagatgatgttagtgattctgagcaactgtatttgcctgggctgtgaggtgccgatatctttgattaaaataagaaccctccgtacatacagaattctaacccccaaaatagacgctgtattttcaaaggatgattcatcttcaaagctagatacttaaaattacatgcagctataattatccaatagctcacacaattgatcattggtaccttcaaaataggaggggctcattaattgtgaatcgttgatcatgagttgtcctcacaaggcagggagtgttgagagtctaggctctgtaacttcatataagccgggcaacaaaatgtcaggaaatgtcggaaaatgtcaggtttgagtggcaccggaacaagtggctgaacataattcagtcaaagtgattatttagtatctgatagagaataaagccctggttatttcaataaattaaactgtctgttctttcaaattgaattcggtcaaccatccaaacatgtcaagccattttcaaaagttattgctcactctctttaaacggcgtttagataagccacttagctcaaggaaccgtgcaggcagttcggatgcactcactgccttcctgtgacgacaaacctggctgcagttcagagatgaaatctaatgtgttgcatgggcgtgtagacaaatcacggaacctcagaggtgacagggacctgatgccagtcagtcacccagtccaagtccctcaatttagagatgaggaacgctgagcccagaaagggagcctggccaaggtccttcaggtcagggagaggtagaggcagcagcaactccccagtctcatgactcccagcccagtgctcattcagctattctgtgctgccctgagagccatgtatagtaactatttccagtgcagaatgaactgtggaaaagaatgatataaaggcaacagctaacatttgccaagaactcatcatatgctcatctaagtgttttacttggattatctcatttaatcctcatgatgggcctacaagggtgggtaggatgactatgtccaacatagaaatgaggaaacagaggcccagagaggttgaacaactcacctaaggtcacctagtaagtaacggaagacagagtgacctcccatagcacatatatgtatatatatagctctcagtagcaacacacatagctcatgccccagcctgaggctgcaggaaggtttggaaggtcgaaatcaaggactctttaaccagttttgcaatattccaggtgtttcaaaaacttccgaaacacaggccaggcacagtggctcatgcatgtaatcccagcactttggaaggccgaggcgagtggatcacttcaggtcaggagttcaagaccagcctggccaacatggtgaaaccccgtccctactaaaaatacaaaaaattagccagatgtggtggtgtgtgcctgttattccagctactcaggaggctgaggcatgagaatcgcttgaacccgggaggcagaggttgcagtgagctgagatcatgccattgcactccagcctgggcaacagagcgagactccatttcaaaaaaataaaattctgaaacacaaaatgaactttagtcccacatagtaaagaaaaatgataagccttacccctttaggagaaacatcatgatttcatgggggaagagccacatgttattttcatggttttaatactgctctcatcaggtaacacagacaaatgcctctgccacttaatactaatgaaacagccaacatacactgagcatttactaaatgctggcctttgtgccaagcactttgcatgcattgtcacagcaaccctaaggtagggatgattattatccccaatttacagatgagaagactgaggtttagaggtgatatgtgacttgcccagcatacgatggtttccaagcacataagtagacattgctgcagaaagactataagaagaacaaaatctgagtctagagaaactatcagcacaaaagctttcatcaccaccaaggaaatcaatacagttaaattagcatagtggaaaatattacagtggaaattttagtataacacataggttctaaggcccagttaatggcccacttatttcaagcaatattgttttaaccatatcccagtaaaacagcgaactcaggcagcttctgaatagtcattgtgtgcacaattcatacttttgtctaagtcccagcagaattgaatggggttatttgcccaatatctatgcacaacaaaagacaactgtgtgttttttattctcctcttatataagtgaatccaactcaaagacatttaaaagaaagaagatattaaaaccacttgtagttccctttacatatccaaatggattaatggcagatgacttttcttacaagagatgtgcctttccatcaacctagcccttgggaaatggcaacatcttgactcttcaggttaggaacaaatacaaattggaataaaatatgacctttaatgtgaatgattgatctctctcatgtcctcttggataaatctgttttttttttcctgtaaactttcaccaggagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatgggtatgtaatgatttcactttaccccacaatgatgagtgttttcagtttatcctcctttttatggagccactcaagggtgccccttatctcagatccactgcatgccctctactttaggcatcagcctgaatgacttcaagtccatgtcacttccttactgagtttctgctttactcgtcaatatggcacccagtagcacacaaagccacgtctggtttcagtttctagttcttatccagagcttggaagccatctggtgatcacttgagtgtctcttacttcaggagttgatgctgtcgctcatctcagtctcccagttggggatgatgaaactttgggagtacagatgaagtgggctagtggcagcacggagcttgtgttacaagacatggatcatgggatcttggatcaactactggcatttatgttttggggaggagaatccaaagaaatgtactctgtcagtcagtttttgttgtgaggagccctcctcttttactggttgcaagacagagagagaagaagtaggagtttgccctgcatctgtgcccatcgtgccctgattttcccctggtttttcatgacacgcaagtgttgggataaggcacaacagtctttggggactgaggacatgatctgaatcttaaaactgagaggaaatgtagagggtctccttgcctaaaatctgaacaactttgaatgataactatggaaagggaaaagaaaattctggaaacctccactggtactttattggtatttctattgtgcatgcccttcccaagtaaataccagtattgtcaggagagttgatgaggggtctgtaaaagagattcgaaaagtttactttagagacgctaaagggttgacgagggttgtatgaaagagatactaaaaacaaaatttcctcctacaacaaaaagaaaaaattccatttgatttctctgattttaagtagcctggatttcctattataatatgagaagtctctaccaaaatccactttgacttaattattttattgacgggttgtcactgctacctctgcttgtttgagctcattcattataggattatctaaaagtgaaacactcaattagtaatagaaaaagaacaatgtttgggaagttgggagagatgctttgcttaacacctggcagcctctaagtgattatagacgtgggtgttataggccaaccatgtcctatcggctgagtctgagaggggtgaaaggtttacaaggactgcatgagccttcaaagactcctagaaagagctggcaagagtggaggagccaagggctgggctccttttcattttccccaggcctgttaaaaatttcagctcagataagttaattcctggtacatttcttaatgtttttgtctatgcatggcactatgcataaagaagaacataaaaacagacaaagtacagaccctgttctctcgtctctatgacatatggtatgaaattttctatttaatctagtgtgtattttaatagttcacattttcacaactaatttccaggctctaaagaaacagctagtggtttttaatgaaaccatgtaggtgttcattcgtttacagggattcagaaacctgtctctgctgataagagttggtatagtaactcaagagggtggatgttttctccacttggagtgagtaaaggcagggaaaaaatgtaatttcccactttgggaggccgaagtggatggattacctgaggtcaggagtttgaggctagcctggccaacatggtgaaaccccgtatctactaaaaatacaaaaaaattagccaggtgtggtggcgcgtatctgtagtcccagctactcaggaggctgaggcaggagaattgcttgagcccaggaggcggaggttgcagtgagcccagatcatgccaccacactccagcctgggtgacagagagagactctgtctcaaaaatatatatatatatgtgtgtgtgtgtgtgtgtgtgtgtgtgtgtatgtgtgtgtatatgtgtgggtatatatgtgtgtgtatatgtgtgtatatctatgtgtgtgtatttctgtgtgtgaatatatgtgtgtgtatatgtatatatgtgtgtatgtgtgtgtatatgtgtgtatatatgtgtgtgtttgtatatatgtgtatatatatgtgtgtgtatgtgtgtatatgtgtgtgtgtgtatatatatatatatatataatttgatgaaaactttatagaccttagtcatttcaggctcccagtgaaggtgaaatagtagctggaattgttcttgggagtctgatgacagcaagccaaggtgatttttaagaaatgaaacccagtttagagactggaggtttttctttttaaaacttgctattagtgtcaaaactgttattaccattaatttaccatatcagccagactaagacattactttttttctgttgacgttaaaaatacaggaatagttacaaggatgttaaacgccaagataagtaatttgcttttcatgaatatgctattattataataattccttatttgtgaatttgggactggaactcatttcttaaaatagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccattcaggtaattacaacccgactttttatgcagcatagtatgtcaacttatagtgggtattccacaaatgtttctgggttaaatgaatgtatgaatgaatggatgtatgaagaagacctattcacagaaccttccagcatctgcaaaggatttgtgtgctaaagcctaaatcccccaccccatatacgtgtgtgtgtgtgtgtgtgtgtgcgcgcgcgtgtgtgtatgtagacagatagatagatgataagcagatagatagccttagccttttattgcttatggtgctaggtacaggactttattacaacttggtgtttggtggatcaaattcagtacacagacgtggtgtgctttgcccttaacaatgttttaaaatttattttagggaaggcatgagctcttgtttgccatagtcacaccttgctccgctgctcctttcccctcccctaacctgactcacacatttatgcagcccatctggccccagggaatatttgaatttgctccttgtggtatagtcttttttaaagcagggtctcactctgttgcccaggctggagtgcagtggcatgatcatgactcactgtaacctcaaatttctgggctcaagcaatcctcccacctcagcctcccagatagatgggactacaggtgtgtgccaccatgcccagctaatttttaaattttttgtagagatacagtcttactctgttgcccagactggagtgaagtggtgtgatcatgactcactgtaacctcgaactcctgggctcaagagaccctcttgccttggcccaccaaggtgctgggattacaggcatgagccactgggattacagtgcctggccatagtcttttaagtctccccaagtgacctcatatttgacattaaggatgccaatataaaattgaagcccttacatgctatctctgagtagaaagtagtgatgatgatgatgatgatgatgatgatgatgatagtaaataagaaggtgatgatgatgatattgtctaaaagttgtatggcaggttgaattcttttttcaatgtccttgcacatttattctacccattttatttacttatttatttttatttatttatttatttttgagatggagtctcactcactctgtcaccccaggtggaatgcaatggcgcgatctcggttcactgcaatctctgcctcccgggctcaagtgattctcctgcctcagcctcccgagtagctaggactacaggcatgtgctaccacgcccggctaatttttgtatttttagtagagacggggtttcaccatgttggccaggctggtctcaaactcctgacctcaagtgatccacccaccttggcctcccgccacccattttaatcacacaggaaggtacattttatagataaatatatagatatagacaaaggcctacaaaattatacgatgaaactttcccgtggtctcacaggagctggtaggcggtaggatggagcctggggctagcctctttctcctggtcatgtctgtatccttcaccataggaatgtccacatgatgcagtcattttgcttcattttcctttggtcggggtgtgtcactgtagagaaactgaggtctaccaacatccctctaaggcctttgacaatgccagttgccagaattgtgcttgagaccaggccatctagatttatgataggcactctcagccctccactgtactgctgtctctaaaaattctcagcaaacagaaagtgtggtatccatgcctattagttagcttttggtggtaacaaattacctcaaaacttggtggcttaaaacgacaaacatttattatctcacagtctctgagggtcaggaaccaggaagcagcccagctggatggttctgactcggtctttcatgaagttgcagttaagacgtcagctggtggccaggcacagtagttcacgcctgtaatcccagtactttgggaggccgaagcaggtgaatcacctgaggtcaagagttcaagaccagcctggccaacgtggtgaaaccccatctttactaaaaatataaaaattagccaggcatggtggtacacggctgtaatcccagctactcgggaggctgaggcaggagaatcacttgaacccgggaggcggaggttgcaatgactcgagattgcaccactgcactccagcctggggaacaagagtgaaactccgcctcaaaaaacaaatttgtgacaaatatattcatatattcataaacataaaatgtaccattttaaccttttttttttttttttttctgagactgagccttgctcttgtctcccaggctggagtgcgatggtgtgatctcagctcactgcaacctccacctcccaggttcaaccgattctcctgtctcagcctcccgagtagctggaattacaggcgtgcgccaccaccatgcccagctaatttttatatttttagtagaggtggggttttgccatgttggccaggctggtctcgaactcctgacctcaggtgatctgcctgcctcagcctcccgaagtgctgggattacaggcatgagccactgtgcccggcccattttaaccattttaagtgcacaatttagtgggattaaatggttgcattcacattgtcctgcaaccatcaccaccatccatctccagtaacttcttcatcatcccaaacagaaactgtaaccattaaacaagagctccctatccccttctgcccccagcccctggcagccagccttctacttcctgcctctataaatttgaccactctatgaacctcatatgagtggaatcatacagcatttgtccttttgtggctggcatatttcacttagcatgatgtcttcagggttcatccatgttgtagcatgtgtcagaattttctttcttttgaaggctgaatgatattccactttatgtgtacatcacatcttttttatccattgttccattgatggatgtttgggttgatgtgaacattggtgtttgagttctgctttcaattcttttgggtatatactgagaaatagaattgctggacaacatggtaattctatgtttaatttttttgaggagccgccttactgttttccatagtggccgcacagttttacatttccacgagcaatgcacagggatctaatttctccacatcctcaccaacacttgttattttctgtttctttgtttttttttttaaataatcgtcctaattttaggcactgctaatttttaagatttttgattttgagaaaagagctacaaaatatagtttgtggatctgcattagatttcccacctgagactttgacagtttaaaaaattttatctttttttaaaaaaagattgttgttgttgttgtttttaagacagagtcttgctctgtcacccaggctggagtgcaatggtgcaatctcggctcactgcaactttgcctcctgggttcaagtgattcttctgcttcagcctcctgagtagctgggactacaggcatatgccaccatgcccgactaatttttgtatttttagtagagatgggattttaccatgttggccaggctggtctcaaactcctgacctgacctcaagtgatccacccacctcggcctcccatagtgctggggttataggcatgagccactgcgcccggccccaaatttttatccttaaacaaaggtacaagtaaaatgtgaataaacatgaaaagtttcttattatgcaactggctaattacaagagaggtggtcatgagcagggggtcactctctgggtaggtgacttaaggcaagttcatttgcctctctgggacttagtcatagcatcagtaaatggggaaagtaagcatagctgccacatagggctgttgcgaggattacattggttcatacttcatttttaaaatctatattttttgagacagggtcttcctttgttgcccaggctagagtgtagtggcacaatcatgggtcactgcaaccttgaactcccaggctcaagcgatcttcccacctaggccctctccccactcaacctgagtacctgggactacaggtgcataccaccatgcccagctaagtttttcaaaattgtttgtagagatgggggtctcacactatgttgcccaggctgatctcgaactcctggactcaagcggtcctcccacttcagcctcccaaagtgttgggattataggcatgagccatcgcacccagactggctcacacttcaacgcccttagagcagtgcctggcacctgtgtcgggcaccgtgtaagggttagttgttattgatttggccagaactgaagcatgggcccttttctctccttgagtttcatcttgcttacccaagggccaaaccaaaccagatcgtaccaggaactttatcatttcttttcggcagataaaccagaatagatctgaaatactgaaacctttaaaggcatttgtcaagacatttattgccccactagatgttaagtacttctggtttttgtttgtttgtttttgtttttttgagatggagtctcgctctgttgcccaggctggagtgcaatggcatgatctcgcctcactgcaacctccgcctcctgggttcaagtgattctcctgcctcagcctcccgagtagctaggattacagacacccgccaccatgcccaggtaatttttgtatttttagtagagacagggtttcaccatgttagccaggttgctctcgaactcttgaactcatgatccgcccgcctcagcctcctaaagtgctggaataacaggcatgagccaccgcacccggccgatgttaagtacttcttaaaagggaaaacttcataggagagaaatagaaaactactttcgtatggacaggactataaatgggattattttcttgagggaaaacattataaatggaaacctcttaatacagtgagagactgaatttaaatacctttactcttggaaaatgccatgcatactcttccttatttgttatatttctaaagtgcttttcttcccaggaagctcattacaaactgtctcctgactgtattgaattccgctcctttgcaagggaaccacccttcaaaatgcaccagaaacagatcagagagctggcaaattgaggctgggagttattttgcatggatattgcattttatgaagtgcgacaccgttgtttatcattaaagattcaagttctttcatcccctcaggcagaatgttctcagctatgagcttgattcaaactatagtagacaagtcgtagatttcttagaaagtgaacttctaatggaaatcctgacaatccattaacagcaggagggctaatggctgccacagaaaatatacttaaagattacagtaataaaaacacatattttaaagtgcctgctagaagttcaagaatgtttttaaatgttgctgttaataatagaccaccaaatccttatagcatttgaatttgcctcataaatgggtttaatctaagggagtgctgttgtactgcaccttttttttctgtttgactttgaggggggcttgatatcttttggcagaattatcaatgccttaatggaaggtaaataattggtatattagcagacgtgtggaattttaaatctggaaaagacctgagcaatcagccatcatctgttattatatctgctagaggaaacttgggactctacaaagtaacgggctagagcttagaaaggaaaaatgagtgttgggggcaggcagtgctattggtgatgcgcctgtggccttaatagttccttaccaatgtcattattgtaacacctgcccttccgcctgatctccttgcatgggttacatgagttctttcttcctactgtgatgcttttttatgataaaagtaatatatattcattatataaccattagaaagtaaagaagggactgaaaatcactcgcagtctcatcatccagagcagtctctctgttagcatttcgggttatcactcccatctgtttcccatctccgtatatgtacattccttctacaaacttgagatcatgcagaacatagtgttctaaaatcattttggctttgcagttgctcatgagtgttttctcacatgatgaaatattatttaagaacctgattctcctcatctgcttattatatcatcttggagttgtacaggtttttctaacctagttagagaatttgcagtgttgtgtgttatacattgcattgaatgtccatcatacacaataaagatttacttacatctctgattatctcctcagaaaatagaagtttttgcatctattgccaaattccccatcagaaaggcattgctgttttatcctcttaccagcagtaacatgaaggtagcccttttcctgagccctcactagctgtaacaaatttttaaaactttagcaatctgatatataaaatgtatcttatttcagccatttgcatttgttcgactactagtgatgctgaacagtttttctagctcatttacaaatttctcttgtgacttgtctatacaggccatatgttcatttttctactaagcttttcaccttcttctttttgatttataagctctgtctatataccgagatctatcatttgtaggtaaactttgcaaaaaattccactattttttgccttttatcttatttcatggtgttttttttttttttgaggtacagaagttttaaaattttgtgtagtcgaatgtcaatgttttcctttatggtttctttctttgcttttatgctgacacccaaaggtatttctaaaacacagatttgatcagactccgcccttgattaaaatctttctgggtttcttgagtaggaaatccagtctccttgtggtgctctaggtccagaccattgccaccccatgggcatttggggttctggccacactaagcaacttagacttagtactccttacttagcgtgctctgtttagaaaggccatcctctactagcccccatggacccactccccatctccacccacctcttcctgggcattatcaaagacccagctgagacatgaccacctcttctaccctcttcttcccccacttcctcctgtgtagcacctggtccccagaagatctctgtaacggtttgtaaaatgaataacccaaaggacaagcaaagcctaagatggtaaataggagaattggctttcagggccagttttgtatcaaaggattgaactgagtggctgggggctaaggctcaaatgtgagcaattgaaagaccccaggcagcacaggcaggatgctcaggagttggtgggatgcagcgtctgggaggctgagcagcaggcagcaggcacagtaggctgggagcactgggggcccagtggggagcttcagggaagggctcaattctgaaagcacccagcaaccatcacatgaggtcccaaactggtaaactgatcttaaccaccgaaacctcctcccaccccacagtcttccccaaactgggaaatggcatcactgctttccaatttcttggacccgagactgcagtcacttgattcccgttcctcccacaccccatgtcccatctgtcagtgagtcccgttggctctaccatgaaaacatagccagaccacatactgtaggattctattttgatgacattctagaaaaggcacaactgtagggacagaaaacacatctgttgccagtggctgggggaggggagactccaaagggtcatgagggaatttgggagctgatgggaccctcctatgccttgattgcagtggtggtcactcaactgtatgcattgtcaaaactcacagaactggccggttcgcggtggctcacacctgtaatcccagcactttgggaggccaaagtgggcggatcacgaggtcaggagatcgagaccagcctggctaacacggtgaaaccccgtctctactaaaaatacaaaaaattagccaggccgggtggcgggcgcctgtagtcccagctatttgggaggctgaggcaggagaattgcttgaacccaggaggcggaggttgcagtgagccgagatcacgccactgcactccagcctgggtgacagagcgagactccatctcaaaaaaaaaaaaaagaaaagaaaaaagaaaagtctgtgtgtgtccatgagggtatatgtatcgtagtttaaggagacctttatcttagactgtctttctggagaatgacaaaccaaccaacttaatggcagacaattctatactgaggaaagttagggaggtcttcaagaataggtgtcctgtgttgttggttgaaaggctggatcttgattactgtatgtgtggtcaacatgtaaaatgcttacagtgagttaaatgggcctgccatattaactagggtcccctttccatatgcaggtaggtttgctgtaggagttcccttgggtggagcgaagactnnnnnnnnnnnnnnnnnnnngcttttagtgttcatccaacattcaaacaaacaaaacttacagactgtacactaaaagggtgagtttattatacctcagtaaaaatatgggggaaaatatactaggaatcctgccatttttcagcacactgccatcatcccgggccgggccaggctccatcaccatcttggatttttttttttttctcttgagacggagtctcactctgttgcccaggctggagtacagtggcgccatctcggctcactgcaacctccaccttctgggttcaagtggttctcctgcgtcagcctccccagaagcttggattacaggtgcccaccaccctgcccagctaattttttgtattttagtagagaaagggtttcaccatgttggccaggatggtctcgatctcctgacctcaaatgatctgcccgacttggccttcaaaagtgctgggattgcaggcataagccaccgcgcctggccttggattcttattgcaacgggctcataagtgggctccctgttcctgcccccgcctcactgccatctgttcccaacacagcagtcagaatggtcttttgaaaacaagcagcagattgttaatcctttgctcagaattctccagaggtttctcttctcagaggagactgtacgtgaaactgccgcctgatatgtctctggcctgatctcccgcagtgcctccccctctcccttccccaccagctcgctccatactgccacgatggcctcctcctctcctgggacctgttgcatgggtcccctcagactgaaaggcagagttctcacaatggctgccaaggccctccatggcacagccctctgtgccttctctggcaacctcttcccaaccgcctccctcagctcctccccatctatcagccctcaaggcagccgcggtgccctgcctgcgcttcctgggtgtgcgttccatgctcctttcttggggtgctctgtctggagtgcgctgccctctgatttccattcacctggtccctccccttatctcttccaggttcttcactcaagaagcgttttctcagtggggccttccccgagcaccctgtttgcaatcgcagctgccctgctcccagccccacttgctatcctctcgccctctttttctcacagaccacagatccatctgacataccatattttgtttattgtgtgattcctcctcatatctgtgagggtatgaggtcaggggttttgttttctgccacccctccagtccgtaggtcatgactacttgcctggctagtcagagacactcagttaaattttgtagatggaagaaaaaaaaggaagaaggaaagagtgttaagaaccagtggtagctgggcatggtggctcacgcctgtaatcccagcactttaggaggctgaggtgggtggatcacctgaggtcaggagttcaagaccagcctgaccaacatggtgaaaccccgtttctactaaaaatacaaaattagccgggcatggtggcgggcacctgtaatcccagctacttgggaggctgaggcaggagaattgcttgaacctgggaggctgaggttgcagtgagccaagatcatgccactgcactccagcttgggtgacagagcgagactctgtctcaaaaaaaaaaaaaagagaaaaaaagaaccagtggtgactgtaatcttctgtcactacccctgaatatcactcggttccttactatacatagtcttggacaacacgggatgtggtacgagtgtaggtttgtgggctcaggagttttggggtagtggctctcctgcctgccttacctttttgttttgctgctgcctcagattgcaaagttaacagatgccttctctccaatttatctttagaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaggtggcaaagtgcttctgaaatagtcgagaaaaagacagattccaacctcctcagtccagccactgagacctgatgttggaacgcatcagctccttccagttccatgaatgtggctcatagacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtgggaactgcaacaaagaaaaacttcctaatatataaaaaagaggagctgctttgctttgcctccaggtttagcggacaagaaatgtctcctgaagcttctccttaaaggatgctattatggaatggcttttcccatttctgaccagttaacagtttcatagacctcaagtaacagtttgaggtatcaaacatagtataccaatagggggtgctacctgcacgtatctgttctatatatgctccaatatgtcatccccgggtgtatcccatgtgcaatatgagtatatagtggtggcattttataatagaccccactcctgcgctccaccataatactcctctgaaatccttggtctcaagaaacatctgttctcttgtgacttgggcactttgtcaagcttattccagattcctgtggaaacgttttatcccaaccaggaaattagtattttgttctcgtggcctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaataccccttttcagaggccttgggaaccagccttctaggtgacaaggggacaaccaatgaaggaaggcggcatgtctttccccttcttgttggggttgaactacctccctatccacttggagatgagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttctgagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttataggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaactt

SEQ ID NO: 13090 - DNA, 9653 bp, Human; identical to SEQ ID NO: 12275

SEQ ID NO: 13091 - DNA, 12383 bp, Human; identical to SEQ ID NO: 12789

SEQ ID NO: 13092 - DNA, 12383 bp, Human; identical to SEQ ID NO: 12789

SEQ ID NO: 13093 - DNA, 12383 bp, Human; identical to SEQ ID NO: 12789

SEQ ID NO: 13094 - DNA, 12383 bp, Human; identical to SEQ ID NO: 12789

SEQ ID NO: 13095 - DNA, 12383 bp, Human; identical to SEQ ID NO: 12789

SEQ ID NO: 13096 - DNA, 12305 bp, Human
ggaatttcatcatgtccaattctggggactatgagattctttactgtgagtggcagtggagcaggacatggggagagggtaattggagtgggttttgtgtagggggggctgttagaggtgttgttagataaggaagtggagatggggttaaagtggagttggaattatatgtaggagaaatttcgtgatttggaaacaactagtttcacaccatgtcttgttgacttgagggagttcaaaaatgcgctaagaaaagattgtttgggaaaagtttctcagggcaagtgtggagcacttgacttatctagggaggaggaactcgtggaagctgttagaacttcagccagagctcaggacaggacgcacacagggtgggtttcacagggggaggaggtgatgctactacggtgaccagatcacatgccatcgccgggtttcatgccagtctttccagtctggctttccctggcatcttccctactgagggcagggtgagagctgagctgggcgggctccctctccccaggggacgtggctggaggctgcaagcagctgaagaatcgctatgagagccgagaccgggaatgggctacctacacctgtgtgctgggctttcacgtctacggtgagcaggggcgtggaaacctgctggaagggtgggggacaaggtggagcccagtttgggcttggaacgctgggcgtgtgtcgttgggtgagagtccagaaacctgaagatccagcccaggaggcccctcgggaccgggaaggcttgcctggaacgcggcagtgggtggccgcggctgccggagcgcctgaaatggtgtagctctgggccgtgggtggcggtgggtaggaggtcgggctgaggccggccgctgtgctaggcgtctggccggacggctccgatgggaccgacatcaactccctgtgccgctcccacaacgagcgcgtggtggcggtggccgacgacttctgcaaagtgcatctcttccagtacccgtgcgctcgtgccaaggtgaggccgcggggatcgccggggtgggaccggtgggcccgagggctcagccgccaccgcaactcttccctccggcccaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcgcctcccggtgcttttgtggggcgctgccgggcgcctccggggctctgtggggtggggacgaaggaaaagaggcgtgcggaaagggtaagggagcgtagaccatttatgcaaatgacaggcaaagccgcttgcaaataacctggcgaagcgctaaggcgcgcgagtctttggggcgcgaggaggagctgcagggctccagcgaggacagagttaagcccgactcctctcccgccctcggaaaagggggtggggccgagctgcgacggaaatagccgagcggttgcccgacaggagccgaacttcttccggaagtagccgatctgcggggtctcgctctccgacctgagccgagcagtgggccttgttctccggatcggccgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggaggtgagtaccgggcgcagggatacggggcccggggcgggagaggttggggtagggacctgaggggctcggcaccgggtggcgcgaggcgcagcgtatggggcagcgtggaccggagcgcggaccggaaccggaaccgggagacgaggagagagggtgcggggaaccgcgacgcggcagggctccgagactcccagagagaagctgcgggcagccccgacggcactttcggggctgcgtcaggggctccccggggcacggagtggccttcggaaccggttccgaaggagctgacagggtagggagggaacgcgaggggctggggcgacggctttgccaccgcgggggagccgcccggaggtttcctcttcccaggcgttattgtgcgcctcgattcgaaaaggtaggggccctgcgctagagcggacaattacttcgccgcgactggggtgcaactcatcgctgagttgtggggactgcaggggaacccctgcttcttgcctgttccttaaggctctcttttgagtaaaggatctaattttagaactaggtgcggtggggatgggggacatccttattttctcttagtctgtccactttcacatctcagcgccctttctacctgaatccttatctccttttgatccactcaggccaactttctctcctaccctggtgctctgcgtctcccatctcctctgatcttcgtggttctcccccctcccttcccttacagattacgtctattttgagaactcttccagcaatccttacctggttagacggattgaggagctcaacaaggtgagtggagcagaatccctctccctccctcccgcagtggtctcttctgaggtttctaacttctggtggaagagaggatcctatactaagtacccattcatattcgttcattcattcattggatgtattcaggaaaggctattgagaggttagcaggaactttactattctgtctcttgggggcaaaggaaagggatttggaagtctatccttgaatgtaagtctttactcatattttcttgggctttttaatttaggtccctctgaaacttactgttatttgtctctttgtgcatttctgttcccagatgatcaatttccactgctacgttgttttgtttttgtttttttcctccccttagactgcaaatggaaatgtggaggcaaaggttgtctgtcttttccggcgcagggacatttctagtagcctcaacagcctggctgatagtaatgccagtgagtatcttcctccctttctttttctcctacccatgatctgaggcctgggcatgtccctgcaggtatttcccctggtagcatgcccaaggcagaggtgtgagtttgggggtgggaaatgcctggcctgaggagggaggcctgtttttacatgttggggttggaagcagggtggagagattgtgataaggaaagcgataatatggtttgtatatgagagtaagagagagatgataacatttagagtatgaggacgagctttagagaaacaatggttttctaaaggggggcagtttggggtacattgagacagtaggtgatgactgaaggtcaacgtgaagaggaagacattgtactgagaagcctgcgtaacagagaagcaggcttattttgtaatcacaaggtgatgagagtacctggaagttagaagatggctggaagttttcttgcgctttttaatttctcacctcgcccatttccccgcccgcccccctccattttacatctttcccttttcattttgccctatcttcattctctttaaggtctcatcttctttttttaaaaaacatattttccttagcttctttttcctttcctgctttggttttctttttccttccttttgttccacctttctaaattattttcctttttcagactgctctgggtgagaaggggttaaagaggagcccagcttaccaagttccttggccctttagggtttccagccccatctggcaggggctgaccttggccttgtccaatcagaaggggtgttgggggtgtggtcccccttgcctcagcacagggtttccggagcacacaagcgaggggtggagcctactgcacaaccccccccttctccctgaggttgggaacaatacaccaatgagcctggggctgaggttcttctgctccctcccactttggttggcgcctagccaggttaaccccttccgctaggtttcagggcaagctgcagctccttggggaggaaggtgttggcactggcttgagaggtgttgtccttggaaaccccaggaactattattagccaagtagaaaatgagggatagttagggctgcatgtgatgttttagagcaaagagtctcctgaaattgaaaagaactggtaaacacagtcttgtgtgatattttttcatcttgagttcctggacctcaggctggtttagcaagcaagagacaagtgtgatgttcttgctggcccgttgtggactttggtgtctgagtactggcagctgggtagcgatgtatttctagagcattcttcgtactctcagcagttcttctctaaaagcattactgatagagttgggagcatctatgatggggcatagagctaagaaggaaagctggtgggataagggtatagaaggcagacgcctgggaaatgtgagaaaaaaacagccaagataggaaatattttccctgagttagagtttccagggtggtgttttgctggatccatttctgacttggtttcttcctctttaatctcccaggggagtttgaagaggaatcaaagcagccaggggtgtctgagcagcagcgccatcaactgaagcaccgggaactttttctttctcggcaatttgaatcattaccagccacccacatacggtacaggacaactggggccagcatagcctgcgtgcacttacgtagaagatggagagaaggaggtggtattgagagatgctgtggggagggagagtggggctcaccggggttttccaatctctctcctatagggggaaatgcagtgtgaccctcttgaatgagacagatatcttgagccagtacctggaaaaggaggtgagaaagagatgttgagagaagagcgaggggaatgggtattgcccgcaaaagagagggggaaaggagcacaatgatgaggtacagggttgccagactgccggtcatggaaactcagatacacctccctccccgccgcctatgtggattgctgccttgcttaccttgtctctccccaattccaggactgctttttttactcactggtgtttgaccccgtgcagaagacacttctcgctgatcagggcgagattagagttggttgcaaataccaagctgagatcccagatcgcctagtagagggtaagcaacaggacaagactgtacggctaccaggttgtctaattccaaggggcactttaacattatagtctctgtgaatggcgtcacctggggttgtgcagtgcactgtctgcagggctctctgccatgaccctgacagaatgggcctgtaggaacctgaaaagggaaaatgggaacagttgggaagagaagtcggagagttgatagaatccaagcagaagaagagaaggaggaggtgctattgtgaatgaaaagacaccaactgttcccccctgccctctccctgttgatgccattgttcttttccccaggagaatctgataatcggaaccagcagaagatggagatgaaggtctgggacccagacaaccctctcacagaccggcagatcgaccagtttcttgtggtggcccggtgaggggtgggtggatagggaagatgggctgggggaggtgtggacattgttctgagtcccatggttcttagagatggactttatttctttcattgccatggatgttttccttctttctcctttggcttaatttcccagcccacttgggcttttgacttttctttcgcttttgacttctcaatttctcccttagagctgtgggaacctttgcaagagccctagattgtagcagctccattcggcagccaagcttgcacatgagtgcagctgctgcctcccgagatatcactctggtgagcagaagttggtgggtagttgggcaggctgggttttctggggacttgcagagcctgggaacagaagaggagggtatctctgagggagtgggagtgttttttttttgtttgttttgttttgttttgagaggagtcttgctctgtcgcccaggctggagtgcagtggcgcaatctcagctcactgcaagctccgcctcccgggttcacaccactctcctgcctcagcctcccgaatagctgggactacaggcacccgccaccacgcctggctaattttttgtatttttagtagagacggggtttcaccgttttagccaggatgatctcgatctcctgacctcgtgatctgcccgcctccgcttcccaaagtgctgggattatgggtgtgagccaccgcgcccggccgggagtgggagtgttttaaggagcaggaagggagtggtgccaaaagtttcaggtcctcagttgctctccatcttccccatagtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttgtaagtggatggcactaggaggagaagtgggagagatgacaggtgagggaaccaggacctggggccagatgccagctcattcttcctccctctgccccccttagctaccctggaagtcacttgccagcatagtccagttttattacatgtggaaaaccacagaccggtatattcagcaggtattatctgggctggggagggtggaccataggctacctgctgacctctgcctttgaagttgatgacattctccctgctatgaggctctgatccttctctttctttttaccttcttacagaaaaggttgaaagctgctgaagcagacagcaaactgaaacaggtctacattcccacctagtaagtgtggtgggtaggggagaccagagtgttttccttcccttcccctaacttgtgccttcctcagtgattgggggtgggcaggaggtaggggcacactgagagtggaaattgattcttttccttgaccagtttcttgtttttttcccttctcctcgccttccccgttagcactaagccaaaccctaaccagatcatttctgtgggttcaaaacctggcatgaatggggctggatttcagaagggcctgacttgtgagagttgccacagtgagttacgggggcactgggatggtggggatgggtggaaggcctgctgtggctcaagaatctgaggggcttaggtagtatgcttcttccctgtccccctcctctccgtactctacagccacacagtctgctcagtggtatgcctggggcccacctaacatgcagtgccgcctctgtgcttcctgttggatctactggaagaagtatgggggactgaagaccccaactcagcttgagggggccactcggggcaccacggtaaggatcagtgggaagaaaagcaggggagagcagtaagcatattgatggtgagcttaggtgaaggccagaatattcaactctttatatggtgatggtttgatggacggggtgcttgatgctggttggggagacacataggccaagaggtcagtaaagagattagacaggaataaattgtcccctgcagggaatggaagaaagaagggagcctcagtgctgatttctgctctctctctttcctatgctcttcttctaggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgtaagggcagggagtggtgggactggtggtgggtttcggattgctctgcccagagaccgttgtttctctggatgtctaataacaggagggatagtaggccacagataatttttttaagattagagttggcttctggccttagaggagacctgaatggtgaagcccttcagaagctttcttctttgttctccaggctccattcgacttcctaaggccgccaagactccattgaagattcaccctctggtgcggctgcccctggcaactatcgtcaaagatctgggtatgggatggggaccagtgaggttggcatcaggctcccagtcctttccctgtctgacatctctccccttgctttttttcttcctcatagtgtcctcagagatttagtctaacaaactgtacttttgttgtttaataattttttttgtaaactattcagtattactgtactgatttgataaggtcatactgatatttgaaatactagtgatagcttgccagaacattcccccattgctacttttggggatgcccaggtaaactgctggtccagggaagagagatggaagtaacaaaggggaactgcgtgggaagaaaaggtgcgaaagttttctgtttttttccagtggcccaggcacccctgaaaccaaaaacacctcggggtaccaagacaccgatcaacagaaaccagctgtcccagaaccggggactggggggcattatggtgaaacgggcctatgagactgtgagttgacagaaaggggtgggccagattgagttgggtgggcttttgtctctcataggagtctgagagggtcccttccctcattgtgccatcctaccccttttccagatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccaggtaaggcgtctaccatgggaggggctgagagggacagtccaggctggtgagtgtggggagtaggagtatcagagcaagagctccaggaaagttgtggatgcagggtggggatgccagaaaagaatgggccagaaggcataattgcagtgtggggcttcacctggaggtcttaatgttctctaagccttttctgtttcccacttgctctttctggccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttctcctggctcagctgttctttgccatgggtgtgtgttgtgtgtgtgttgggggtgtctttgagagggaaaataaaggacaaaggacaacaaaggaggtacagatggttcttgccctgggaacagctttatgagataggcagcctggacccaggcggcttgctccagctaggcttcttgtgggacccaaactgctccccagctcccagtggtgctggagctcaagaaccatcttggcccagattcattcaaaggagttgagatgagctttctggatgactggtggcctccataggaaaggggaatgggggtgtttcttcctctgtttcccacctcttactcccctctcccttttgtttaaggaattctggaagttgctagcagccagggtaacatgtatacccccttgggggtggtggtggggttataggaggatcccctcacctagctgtgtggtgtatttggcagacgagaattctaccactgaaccaccctagcacctctgggtgtatgtgtacagcctgctgcttcaggatcctcaaggccagtctcgatgatatcccgatccactgtagcactgtttcctgccttaaaggtttgggacactgagattagatgcctgagctgggcccattagaaggaacaccttaggatagagaacaagaagttcagcctgctgtgtgctccttgggcacttcctttagagatgggaaacagcctcaacagttgtgacttgttcaaggtcaaagaccttggtgtctgccttaggtccactgctctttgcgccattcaaagctgtgggctgataaccacagcacaagctgctgagcccatctgatagttctctccacctcgttatggtccctgtccctagggcatccccagctccccgtagtccctccctgtcctgagcctacacctcggcggcgttgggatgaactgacaattataccaggagggggttgacagcattcgccccctccagtgtctaaactcagttactggcactcggttttgtcttgtcgcactgctctgaggtgcgccagtagctctggcgcctccggcgtacaccacgcagcccactactgcggaaggaatgggcctggctccaggacctcgtggagtccggaaggtgcccggtggtggcagagctccccaaccagggctagaagccgtcgcagaacacccgttttgcgggaggacagggggcggagggagggagtaacagccctgaaaaggttggaagtccagggacagccctgggctccgtggggcaaagaattggaagccgccgatcctccgcctttattcgtcgggtaaataagggtcgagggtacagacgcacgggtgtctactgcggggtgaaggagctgccgcaagatgccacccggcgccggcctttgtggctgctgtcatgaatattcacgatgctttgggccaatcaacgtctgaacagcttaaagcacaccaatcggcttaccgcatgcagataagcatcgtaacgcgccgcttttcctgaaacgggcggggactggacagcggctagaaacggaacccagagtcgaaggagcttggtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattc

SEQ ID NO: 13097 - DNA, 40747 bp, Human
caacaagtggcataagactgaagaaaagagcctgggcacggtggctcacgcatgtaatcccagcactttgggaagctgaggcgggtggatcacgaggtcaggagatcgagaccatcctggctaacatggtgaaaccccgtctctactaaaaatacaaaaaattagccaggcgtggtggcaggcacctgtagtcccaactactcaggagactgaggcaggacaatggcgtgaacccgggaggtggagcttgcagtgagccgagatcatgccactgcactccagcctgggcgacagggcaagactccgtctcaaaaaaaaaaaaaactgaagaaaagaggagggaagatgaatgcctgtggccaaccctcaggcaggtgagtggaacagctattgggggtgactagcgaaaggatagacgttgtcaataaagtaaggcaatcatacaacacatgctgtccatctgtcttgtgcaaatgtgagtatcaaccactctatcatcagtctacaaatactttaaatgtttttatttaaagtcctgttgatggctgggagaggtggctcactcctgtaatccctgcattttgggaggccaaggcaggagtatcgcttgagcccaggagtttgagaccagcctgggcaacatagtgaaaccccatctctacaaaaagtagaaaaattagcccagcacagtgatgtgtgcctatagtcccaggtactagggtgactgaggtgagaggatcacttgagcccaggaggtggaggctgcagtgagccatgatcacgccactgcactccaacctgggcttcagagcaagaccctgtctcaaaaaaaaaaaaaaaaaaaaaaggtcccagggcctgttggggcttgggggtgaggggagggatcttagaggatgggtcaataggtgcagcaaatcaccatgtcacacatatacctatgtaacaaacttgcaccttctgcacatataccccattttttttgtttgcttgtttgtttgttttttagacaaaataaagaaaaaaaaataaggtcctgttgacttaaaacttcggatgaaattgtagtgggacctgtgatctgtttctacattaggatacagtgccttggggcaaggaaatatggcagtgcccgaggtgtcaaggtgggcaggcagatcagtcagcaggggctccaccatcatggtctgcattcaatactggctgcatttcctaggagaatccctgggggaatcattgcagttggagcataatgtagggggcccctgagaaaacctccaggcttcaagtgacatacctagtctgctttaccggtttacaggactcaagagaaaggtggacattgagagttaatccctgaggccaaatcttaaatggagaaagtcaacatccacagaaaatggggaagggcacaagtatttctgtgggcttatattccgacatttttatctgtaggggaaaaatgctttcttagaaaatgactcagcacggggaagtcttgtctctacctctgtcttgttttgtcctttggggtcccttcactatcaagttcaactgtgtgtccctgagactcctctgccccggaggacaggagactcgaaaaacgctcttcctggccagtctctttgctctgtgtctgccagcccccagcatctctcctctttcctgtaagcccctctccctgtgctgactgtcttcatagtactttaggtatgttgtccctttacctctgggaggatagcttgatgacctgtctgctcaggccagccccatctagagtctcagtggccccagtcatgttgagaaaggttctttcaaagatagactcaagatagtagtgtcagaggtcccaagcaaatgaagggcggggacagttgagggggtggaatagggacggcagcagggaaccagatagcatgctgctgagaagaaaaaaagacattggtttaggtcaggaagcaaaaaaagggaactgagtggctgtgaaagggtggggtttgctcagactgtccttcctctctggactgtaagaatatgtctccagggccagtgtctgctgcgatcgagtcccaccttccaagtcctggcatctcaatgcatctgggaagctacctgcattaagtcaggactgaggtgggtctggggtatggcaggggctgggcagcagcagcaatgtaccttgcttgggacccctaaaaaccagagagacagcatggctggtgccatttatcagctagtggaggaggctgacggagggtgggagtgtcatcagcacaaggccctggcagtcccttctggtgattagagaggccgaaagggtcctttccgacaagggctgagggtgggcggaacaggaagagaaaaatgtgacatgaggtgaccatccgaacaggtagcaaatgttagaaaggggtacctctggcaaacttagtggaaaagtaatattgcagggagcagtcagataaaaacaagcccttctgtcaaatagtgcttgaagactcaatagggatacatgggtcaatgaagcctttagaaaaagaaatactaagaggcagattctctgagaacatggtaaaagctcacgctccacgttatgaagttgacctttgtgagctagggaaaggcctggctaggccagggtgtaggctacctgccttgagctgtaccaggccaaatgtcgccagggtcagagctggcttattaaaggactgtgtggaagctgtgccaacctcgtggtaacaatgggtaaaagactgggccaggagaaagcagcctctgcctcagcccagacagtgcggccaacccttgaggttgtggcaaaggtttctcctcttaccattgccctccatgtgcatggcttgcttttctcttgtcttcattatttctcctttcctttcctcctctccaacctcctcctcttcccactcatcctcttttctctacctatatcccctcttcattataccctcctctgttctgttgattaccagaccctgacatacagttagcacttaacaaataattgccgaattgcattgactttttcttgctcctttcttcccccgctcttttcccttttcctttccctttccatttcctcctccctgcctgcctagcaccttccccataaggtggttgtgagcagtaaatgtgcaaatacatgtaaagcttttaaaacagggcctggcaatagtaagtgctggatctcagtatttgctataatttttactctgcctcagacctgccaatgtcccccagagggcctacctagagcaaataatatgacatttagaataaaagtgattggtgaccccaatcaagacatccttggataagttgcccagactccagcctctctggagcctcagttatttgataaaataatgtcactttccaaataagccacaaaatgcaaatactcatggcaacctaaagcattatacccaaacagtgtcccttagggcttgtcctgtctattctgactccttttatattcaaactatttaaactgcttgcttgtgttgaagtccaaatttccattgcgtatggctattgatatttttgtttggaattttttttttttttttttgacacggagtttcactcttgctgcccaggctggagtgcaatggcacgatctcgggatctcagctcaccgcaacctccgcctcccgggttcaaacaattctcctgcctcagcctcccaagtagctgggattacaggcatgtgccaccacgcccagctaattttgtatttctagtagagacggggtttctccatgttggtcaggctggtctcgaactcccaacctcaggtgatctgcctgcttgggcctcccaaagtgctaggattacaggcgtgagccaccgcacccaccctggaattctttgtaaactccttatggtgcgaactaatgtaactttccatccagttatgggggattggtgcaattttaaattatcactatgatttgctatttccatttgagcaaatttcctatagagtttcctttcagtggactagacccatatcaggaagtgacttaggtataaagggaagatacagctttcgaaaaccaaagtttgggcgttctccaaagagttatcagatacccccttctacacccacaatgatctgattgctgagatctgattgctaactactgaaaataaggaagaactagaattttcagtgacacagtgctcagcaagaagctagaaaagaggccttgacatatttgactccaaagctacttggttatgcatgaagccatctggggaggggaaggaggagggagaactcctctgaggaccctgaaacaattgggccacgtgtgactttcagtttctatggagattcatgtgcagtggctgagggcaatctgagagcattggaaacccagaagctttaataccaggctcttctctccgctcttagaaagttctcacaagatgtctttaggattatattggttatttgaatctcaaggagaagctcctctcactgccctacctccctgaactgaaaacaaactgtagtctgttagctcaccctagaagaaggaaattctagagtcaagagaagttaagttttagacaagctggaagttggaatatactggagtttaagatcattgactcaatgaaaaaaaaaaaagatttgtctgcagtaaaaccagagttttaaaaatgattagaaatggaccagaaaagagataaggataatgagaaagggggctctctaaaactatttggaactgaaattgggacaatgtttctggaaactattttggcagtatgtatcaaaatgcaaaatgcacatacttttttgactctggaaatgatgcttgtatagagatcctaataacatgggaaaataattaggaataatgttaaataagaacattagatctttttttggaaaaaggtaccttgaacggatggatggatggatagatacatacatacatgcatacatacatacatagatgttacgaaaaataggtaaattaactgaatgtgcaatatgatctcaaatattataagaaacacacacagaaaaaaatggaaggaatatgccgatatattaatgcctctggatgagtttatgaatgattttttcttttttatatccctgtacttgacatattttctacaataagcatgttttattttactatattttgttttattttgagatgggggtctccctatgtttctcaggctgaccttgaactcttgggctcaagcaatcctccaatatcagcctcctgagtagctgggactacaggtgcaccccactgcacccagctgcgtgtgttattttgatatcgatggaaaaaataaataaaatgtttaagccaaggaaaacaaaaactaggttgaaaaagaaggccaaaagggcacacaagtccagagtgaaagacagacaccccagcagtcaccctcagagcagagggagaatattgaaagtattaccactgatctgatctggcactgactataaacttgcagattggctctctggctctccttccatcatcagttggccagaatatattgtcgctaatgcaagacaaaaagagatgatgaatcacagagacctagaagtttccaaaaccacagaagaaaaatgtaaaatgctaaaaacataaggccaggcgcggtggctcaagcctgtaatcccagcattttgggaggccgaggcaggtgtcatggtgtgcggctgtagtccaagctactcaggaggctgaggcaagagaattgcttgaaactgggaggtagcgattgcagtgagccaagattgcgctactgtaccgaagcctggatgacagagcgagactctgtctcaaaaataaataaataaataaataaataaataaaacatgaactgctgtggaagaaccagagagccctaaggcctcctgtaaatgactacagcaggagagtttccctggtcagcatgcagctttcgaaaattgagtttggcttgatgccttcatcacaaatttggtcccctgtagccttgactatgaagcttatcataaaataattgggtttcactggggcccgaacaaaagcatcttgggaatttaacaagattaaaggttgctttgttgctgtgggtatgatttttttttcttttttctttttttttttttttgagacggagtctgactctgtcacccaggctggagtgcagtggcacgatctcggctcactgcaacctccgcctcctgggttcaagcaattctcctgcctcagcctcctgagtaactgggattacaggtgcgcgccaccacgccaggctaatttttgtatttttagtagagacagggtttctccatgttggtcaggctggctgctctcaaactcctgaccttgccatccagccgcctcagcctcccaaagtgctgggattacaggcatgagctaccacacgtggccatatgtaaattttaaacatgtaaaccaatactgtatatcttttatagatatttacatctgtaatgataatatgaaaacgtacctaggaatgataaacaccaaattcaagatattggtaatctctaaggagggagaagactaagattttggagtacataaaggggtcttgattatatagatagtatttcagttcttaacacgttctcttctggtcccaaggccaaggaattctcaattgaaatctcagttagaacgtgaaggatgcttcttgggactgggaagagattttccgtaggccaaatttaacctcccactagagatagttgataattctaccacatttcatagtgaagcatcaggaagacaggactgaaaaggcaagaaggaatgatgcaaattgcatagtccaaaagataagctggacctaggtttgccagtttgtctaagtaactgagaattcattctgagatcaaaaaatcaaaataatgttcacagcagcattgtttatcactgaaagcaaacaacctaaatgtccatcaacaggagaatgaataaatatattggaatgtattcatcatatagaatattttatgcatataaaaatgaattaaaacatatgaagtagaactagccagataaataaatcctaacatattatattgaggggaaaaaagcaagttgctggagaatgtgtaccatatatatatatataaattttctttttttttttttttttttttcgcgaccgagtttcactcttgttgcccaggctggagtgcaatggcaagatctcggctcactgcaacctctgcctcccgggttcaagggattctcccgcctcagcctcctgagtagctgggagagtagcgttggcccagctagtttttgtatttttagtagagacagggtttctccatgttggtcaggctggctgctctcaaactcctgaccttgtcatccacccgcctcagcctcccaaagtgctgggattacaggcctgagttaccgcacctggccatatgtaaattttaaacatgtaaaccaatactatatatcttttatagatacttacatctgtaataataatatgaaaacatacctaggaatgataaacaccaaactcaagatattggtaatctctatggagggagaagactaagattttggagtacataaaggggtcttgattatatagattgtatctcacttcttaacacgtgaggcaatatggcacaattttaggattttgtagagctaagcggtgagtccaagattgtaatgttatagtccctgtactttctatttgaaatatttcataatataaaacaaagtatatttgaggccaggtgcagcagctcatgcctgtaatccccacactttggaaggctgagacaagaagatcacttgcatccaggagtttgagactagcctaggcaacaaagtgagacccgtgtctctacaaaaaaattaaaaattagctgggtgtggtagtgcacacctgtagtcccagctacttgagaggctgaggcaggaggatcgcttgagcccaggaggtggaggctgcagtgagtggtgatcttgctactgcactccatcctgggtgacagagtgagaccctgtctcaaaaaaatagaaggtatatttgatcaaagttttatattcacagtaagcaataagaaccctagggacagagaagggtggatgttccacctaaacactgtgctttcattccatcaacaatgaaacatccaggaaaggaaacaacaagtgactctagaaattcactagttagacagaatctccttgggaatgatttaaagagggaaaatgtaagaaaacctggcaagactaagaagagtcctcaagtgcaaaaaaagtatagttgacagttaccagagacagatcatccttaccagcctggaggaatattgcagaggaaagagcttaggatcttgaatactctcttatctcctgtatttaccaccatttcctctcttgctgaacattcctagaaaatggagaggagtttgtcacaactgctctttgatgatagccatggagaatgacaggggccccaaggcagatggcatcaacctcatcaaagaccaaaaaacaaataaacaaacaaaaatccctccggtaggcagtgaaacaccacaaaaaaagcaagggctatagatgatataccaagagctacagatggatgaggttggacaagtcacataacctctgtgtcagtttcctcatctgtttgttgtgaggaataaatgaaataatgcctgtaaaatgcctgtcaggtagaagtcactgaaaggaacagaagttccattccatccccctaaggaaagacagggaatggccagaatcttcctagccaattgagtagtgctttcaaggagaaatcaagagaaaacactacttcttggatattttggctaagtagtcatttgaagtacagttgactggttattttattttaaatcatatctcatagactcttcccaatcataggctggctgtgtagttttctgaattttgctctggtattcttcttcttttttttttttatttttattttttattttttttttgagactccaggctggagtgcagtgtcacgatcttggctcactgcaacctccgcctcccgagttcaagcgattctcctgcctcagcctcctgagttgctgggactacaggcgcctgtcaccacgcccggctaattttttgtattttaatagagacgggatttcaccatgttggccaggctggtctctaactcctgacctcaagtgatccgccagcctcagcctcccaaagtgctgggattacgggcatgagccactgcgcctggacttattattcttaatagtattttatcttatgagcgaagataagagcccaagatggtttagtttactgattctgcaagtgctatttctattaattccttggcatactgcagtttgtatgatggctgcactcttgttaataagcttcgtctttctgaattctgttgctccatagggagctgggaggctgcaaaaggtggccctgtaaaaatctttgcatttataatttaataaaggggacattgtaacactggaactccatattttaaatgaagagctctgtgtctattttttctcctcccccatttctttctttctataaacaacagtggtgtgtgtgtgtgtgtgtgtgtgtgtgtgtgtgtctgtatgtttgagacattcaagtcacttccatttccacccttcaccctgagtggagctcagggttagccatcattgtgcatattttgtggtcaaaccgactctgtaggctactgaaattgttttaaaaaaattggggcctttactggccaggcacggtggctcatacctgtaattccagcactttgggaggccaaggtaggcaggtcacctgaggtcaggagttcaagaccagcctggccaacatggggaaaccccacctctactaaaaatacaaaaattagccaggtgtggtggcacacgcctgtaatcccggctacttgggaggccgaggcaggagaattgcttgaacccaggagatggaggttgcagtgagccaagatcgtgccactgcactccagcctgggcaacaaagcaagattccgtctcaaaaaaaaaaaaaaaaaatggggcctttcacaataagtacccacagaagctttaccctctaactactttttaactcagagctgtgtgttacacaccaaccttctggaggactcaaaaatggatccctttcctttcacattattgagtgatggaccagtggcacctaaggaagagctaccacattttcaggctgtgtgagtctggactggatcataagaaacaggagaaaagcagtcaaagaaggtggtaccaaatcatggcaattctggtagacctctagctcaatgatctagaggtggaggccatttcaccttttgctcagaggggcgatggctagtgagagacttgcttacttcctcatagtcagagcagcactaaaccctgcccaaacacagatacttgagagagaggaagacttcctcttgtacaaactggatttgttctaaaacagagaaagagtagaggcagcttccagaaggacctgtcttataggaagtaagagcaggggacaagaatgaaacagatggtgggtctaagcagggaatgtatccaccaagagcctgcaacaaaactaaagataaaatgttgcctgcgatttattcggctaagagaagtacaccagacatggtttgttgggatgcttctgaccccatttactggtcacagtactcaatttatttagggttttattttttatcctgtaatttgagtctttgattgtgaagaggtacttaattataatttgccacaagaataattgtggtatgattacagggctctcaatgagttggtagttcctgagaatagagtagtattatttggttaccactactcctgagtaaatgcataattgtaatgttaaaatgaacctctttgagtttagagctaaaactgagtgttgggaagggctgattgtaaactcatcaatttgtcactccagtgagagaccatttaaaccagggagtcagggtgtgtggcagggtggagggaaaggtttgcactcttgcccaatttttctcaaaatctaatttacaaaatattgaattaatccacctccagaagatagtggcatacacatggtagataagtggcaaagcgatcttccagaacacccctggtgttcctttgacgtattttcgtctccccagcatgagaatagaacctcctacaccacaggaaagagcaaaataacagtgtggatagcccccaggctttgataaaattcactcccttgctttcctagtgtgagcaataatctgcttaaaaagtagaaaaaaactgctggctttattcattctgcttccacggtgccaccaaaagcataaggagtttacttaaaaaatagacacattcccacccccacccccccaccagaggaaaaatccctaccactaattaaacttgaatggagggctggtggttttttcgttacttacttagtgtttttttgttgttgtttttgattttgttttttgagacggagtttcgctcttgttgccccgactggagtataatggcacaatctcggctcactgcaacctccgcctcctgggttcaagcgattctcctgcctcagcctcccgagtagctgggattacaggcatccaccactacgcccggctatttttgtatttttagtagagacggggttttgccatgttggccaggttggtcttgaactgttgacctcaggtgatccgccagcctcggcctcccaaagtgctgggattacagatgtgagccaccgcgccggcctagtgttctatttttatgacagcatttgttttcactttatctttccaatgaaagttcggaattagtaataatattacactgtgcataaactgtaagtgaataactgatatgaagtgttgcttggtgtgaataaaaaagccagtggtgactttgggaactttatttgtctttctgtgtttcagttacctaaattgaatccttctggagtattgtaggtttggggaggctaaataagttgtgtttcataaatgaacagaggtggcatctatatcagtaagacagttgcatcacttttgcatgatgctgtctaaaagaactaatttaagctaaatggggaaaaggtcagaaaacaacaactaccccccccccaccaaaacccaccaaaaaaaattatgttttcaactttagaacaaatcttctatcctttgtagctcagtcagtgggtgtgggcaaaatcagttgggcagcagttagtgtgtgtccagaactgcaggtgcagcctccatatccttattagttcccttggttacagaccccagtgggacaatgtttgaaaaattatattcaccgtctaggaaattgggaactgaaagtccaatatctgcctcagtggagttctggcacctgcattatcccttctgggtatatcaagatcaacagctgcacagatacttttgcttttcacagattctacacatatcatataaaggtgaatagtgtaaagctacctctacaccttaccaagcacacaggtgcgtgccatttaacatctagagcattccattgccttatacaagaactcagtttatatgagctcacaacatcgaaccaatccccccccaattcagtgtgcatccattatacctgaaacctgacagagctgggggctgtgggaggaggttggtaggaagaaattattttgtgagctgtgcacatttttgttccatttgaaactaggtagctaggctgagggggaaccaagagggatgaggattaatgtcctgggtcctcaggaactttcattatcaacagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtggggtaagtttctcgactatgaaaactgagtttcaagatatcaaggacttggccttagatctttcttggggaagaggtaaattttcgttggtaggaggaggggagtagaatggacctaagttctttcaaattcagcaaaatatttcctagcctataactagctaaagccggaaagtcaaaggtcctaagaagccacaaggaaaatattaccatggaatcttggaattgatgagcactcattaaatgattgttgaaaatgaaatcgaagagttggaaattgcttccttacttcctatgaggaaggtacatacagtcattcactcttccatggtatttgccctccatttggtagtcatagatttatagatctggaaggatttttttttcttcccccacatgacaggtcctggtgccacctcactttgttgaatgattagataacaaaatctaatcatctggttgcttaatccctcttaatctttctccattttcttcctcattctacttctcagagaagaggcagtaagaagggttcaatagatgttgagaagatcacttgtgttgaaacagtggttcctgaaaaaaatcctcctccagaaagacagattccggtaagaagagaccaatgtctgagatggggaacagcagatttgaagaaatttgcaacatttaaattctctgtaaatagactggtgatgctgtgcaacgtggaacacggtcaagtttcctttaaaaattcttcactctaccatattggttataaagaatcttagcttctttccttcatattcagaacatctcactaaacatggaaaatttgttaacacaaacttttaaatgatgctatatctagttttcaaactggtcagagatcattgattttattccctcagttctctcaggatcagatttagaggcttaagtaagtctgaatgtcataatcctagggctctgagtcacatgatatcctttaataccttactatttattctcttctcactttccggagcgagagacataaaacctactgatttttgagttcacttttaaaaaatatatatcaatttcagtattttctttttttcttttttttttctttttttagacagagtctcgctctgttgcccaggctggaatgcactggtgccatcttggctcactgcaaccttcacctcccgggttcaagcaattctcatgcctcagcctcccaagtagctgggattacaggtgtgcaccaccatgcctggctaatttttcgtatttttttagtagagacggggtttcaccatgttggccaggctggtcttgaactcctggcctcaagtgatccgcctgtctcggcctcccaaagtgcaaagattacaggcgtgagccacccactgggtctgaccattttcagtattttcttgatcacaggagaattgcgtatttattacagaaactctggaatatataaaaaatacaaaaagattaaaatgatgcataatcctgttacccagttaaaacaactatcaacatattggtgtacatagacttacagatgtttttcttcactgagaacacatacgcatacacttatatatatgtcatatatttaaaacatagactcatagtacacatcttgctttgtaacgtactttttcaatgtaacgatatgtgggaaacttttccccatgacaatagatattctttaataacatgattttaatgactgtatggtattccctattatggatgtattgtaatttgtttaatctcccattattacacattcggtttgtctacaagtacttgatagtataaaccatgttgagaggaacaatcttgcatacatctttctgtactttttttattcttttccttatgataatttcctagaagtaaaattttgttcttctctttaagaaaatctgtgcactttggttatttttatctttttatttcattttctagaagtggaattgaatttcatacacacctacaagctatgtatgagagtgcctgtttctgtacattttttccaacactagatattttgttatttttattattattattattttctgagatggagtctcgctgtgtcgcccaggctggagtgcagtggtgcgatctccgctcactgtaacctctgcctccggttcaagtgattctcctgccccagcctcctgagtagctgggactacaggcgcccaccaccacaccctgctaatttttgtatttttagtagagatggggtttcaccagattggtcaggctgatctcaaactcctgacctcaagtgatcctcccacctcggcctcccaaagtgctgggattacaggcgtgagccactgtgcccagcccaacactagatattttaaatattagttaatttgacagccaagaaaaatagcatttcaggtggggcgtggtggctcacgcctgtaatcccagcactttgggaggccaaggcaggcggatcatgagcaggagttcgagaccagcctgaccaacatggtgaaaccccgtctctactaaaaatacaaaaattagctgggcatggtggcgcgagcctgtaatcccagctactcgggaggctgaggcaggagactcccttgaacccaggaggcggaggttgcagtgagccgagatcgcaccactgcacatccaggctggacgacagagcaagactccgtctcaaaaaaaaaaaatagcattttattgctaacttattttgcaatttcttttactcataaagttggtctactgctcatttatattttaattttgtgaattgcccattaatttttggtccattttttacattgagatgtttacctcatttctaatacttttaaagagatcttgatataagaacatttatcctttaactgtaaagtatgttgaaaatgtttttcagtttatcctttatctttcaattttgtttatgatgctttttgccatatagggatttaaagtctatgtcatcaaattagttcaggtttttcttaatagttctaagtttcatccttatattagaaaaagcttgcctcccacaggattatataaataattgcttatatttactctcagtcattcatagttttattttttatattaagctcttgaatccatctggaattttctttggtgtatggtgtagcatagctacctaactcctctcctccccacaacgttagtggttaaatatttgtcccaacaacaattttttagaaacctccattttcccagtgatttgaaatacctgagtctctcttgactgggtatgtgttgggtcgtattggatatgtgtccctattggcctatagaaagtaatcactaagaatcagccttgtctgtgcaggagaaacttctgaagccacagcaaaaggcttctagtacctaaggaaattcagaaaagagcaatgcatcaaccaataaccattttttcttatttcattacagagaagaggtgaagagtccagtgaaatggagcaaatttcaatcattgaaaggttcccttatcccttccaggtgagttattttctctcaccaaatctcgaaaggcccctgtaacacaattagaaggggtggtggggtgcagggcagagggaaggctacgaggacccagtgaatagaagttgaggtggacaaggatgctgaaccaagaaatgagactggcatgggctaagaatgtttgcttttctatttacctaatctaacatagtttcttttagtctctatacctcaaaaagaatacatagcagcaccaattctatcatagtgtgtcttgtctatgataactgcattgagaaagatgctctgcttgttgagtgagcatttcacttccttctggttctgactatctgtctaatagtggtcatgtgggttgaaaagatagaaaaggggagtagtattaggaagttcagtatgaggaagacttattagacttatgcataaacctaaattctgttgtaatctggaagagctgaagtgccacatatgcatctgtttaggagagcaagaactacaaatttggtcttcagtttggcttgcttacatcctgagaactctgtaggccacatgtcgtgaatatagcagcctctgcaacagtgaaagccagaaaaggaagtggaaagtctcaggggagggggctttctgtcatggatttatgagcacagcaagactaacaagcaaaaagaaaaatgtaaaaggatcttgttcgtgtccctgactatatcaaatttacgaaacctttgaaagaggggtatttcagacacagtttttactaccaatgcctttcaacaagatgacattgtttggctgcactagtgaacaatgctgaacagcagataattttaaattaatttatatttgacttcagaatttattatgtgatgtctataaactctgtgagggttggaaccacatcttatatatttcatgcatcttcgtaacacctagcatgatgccttgtacatggttaaaaaaatactatttgacttgatgatattgcttattatataccttaccctttttgaagtaggtttgtagttccaaatttgatttattttggctaatattggtgaggggaggccactaggtagtggaggtggaggtaattagccatgaattaaaattttactccatattatccaagtgaataacccatatgtactaatcaagacttaatttatatagattatcacttcatttctcttctatacaaagtcagaatttaataataagataaaataccctttgttggataaacaaaaatgttatctccagcaagggcagacggagaccttataaaataagtttatgcatgaattgaagcacaagtcaggaggacctaagagtatgaaaaattctaagagcttttaaacgctacattcctagatatgaagagttcaggaatccttcagatagttcacataacctgaacaccattgctgactgaagattctgcctttctttgttttctacaataaatatacaaattgtcccctaagattagtactttcaaggtctttctccttttttctgaatcctaactgctgaagtctgtgttttcatcgacccaggttgtatatgatgaagggcctctctacgtcttctccccaactgaagaactaaggaagcggtggattcaccagctcaaaaacggtgagaattatttggaaaataaatgtttccaaagaaagaaggaaaggaaggaagaggagatagacgggaggaaaaggaaagaaggaagagagaaacgagaaagaaagagaaaggagaaacgtagagagaaaagaagaaaaaaatggatagaaggggagaaaagaaagagagagggaggggaggagggagacaggaaggaaggaagcaaggaaagaaggaaggggatgagggaggaaagaaagacaaataacaaagaaacaaaggaaagtttgtattttgtttcaatattagtaatacaattgagcttagtattccatcatatgaataaaagataaaatattagactaagagtttcccagttctatcactatctctctagtgcaattttgtaattttaggcacctccatttctctatttattaagaaaagtcccattttttgcactgaatacaagggtggtgtggcattcaatggttatgcaatatttagaatcctaagtataaaatacctagctccaaaaaattaaatagatgatgtatgagagtgcttgaagtcagagtcagagaacctggtttcaagccctcttttaccatttacaaactgggtgatttctggcaagaaggccaacaagcttctttgatgctcagtttcttcttctcaaaggagaataatggtaattcatgccacatctacctctggggttgttgtaaggatcaaatgaagtaataatacatgtaaaagcacatggaaaactgtaaatcactgtatacgaaagcactgtacatctctttgttgtggataaatatttcccaaggaaatatttcatattccttgctttgtgaggacctaaacttgaacagtttcagcatttcacatcaaccatacagtgtgttcagataaacttgactgtaaatgcttgcagcacaggatgcatgcacacatatttgtgtgtatatatagccacatgtcaagtgactgagagattaactggttgagttgacatcaggaaaggctgcctagagaaacaggaaggatggcagactgataatggtatggttgggttattgcatgacagccctttgtcttaataaacatttagattctgatactcactggctggctataccagccttgtacactcccttgaatgcaagtttggttggtcaaaattatattagccaagtctttcaaactgaaagggaacaggaggaacgaagatgaaggatcatctattcaattattgctatgtgccagatattgagctaaataccttttatatattatctcatttaattttcacaacaaccttggcctaaaaacaacaacaatgataactaacacttaatgagcacttactatgtagcaggctctgtcccaagtgcttcaaatgtattacttatttgatctttgcagtagccttaagaagtatgtattattcccctatttacagatgaggaaactgaagctcaaagatgttatgcaacttgctcatgggcacacagtgaatggtggagcctggattcttatcacatccctgtgtctgtatgactccaaagcccaagctcattgcatagttttgcgctgcttggtttccaagtccagaaatttcacatgtagttggttgcaaaatattctatagtaaagctatgttgaatattacaaataggtgatatcctgcaatacacagttcagttcttggcatattttaagataaggggtctgctttagccctggggctacaaaatgagcaaactctttaatactgcttattgtgatacaggctcttctttaagttctttacatatattaactttgtattaaccatatgaggcagttatcttgtcatccccattttacagataagaaagctgaggtacagagaggttaagtaacttgcccaaaggccctcggttggtaaatggcagggtcaggctttgaattcaggccccagactccatgtcctgaaccaatatactatctccagccacagaaatatttgcagagactgggataagagctctgcaggacatgtatacttgtacttctttagttctctccacaatgcctcatacagcgccttgcacacagaaagggatcagtagttgtgttaactgatttatctgtgggaataaacaaccatcaccagcttgggctccacatcgataaatggctaggttttagtctggaaatgggggaatgcaaggcagactagctgaaggagaaataagggagaaactggcatgctcaagttggtaacttctttacacttcatatactaatttcaaaaccagtcatagtttagtccaacaaatatttatttatttatttatttatttatttatttatttatttatttattttgagatggagtttcgctcttgtcacccaggctggagtgcaatggcacgatctcggctcactgcaacctccgcctcccgagttcaagcgattctcctacctcagcctcccgagtagttgggatgacaggcgcctgccaccatgcccagctaatttttgtatttttagtagcgacagggtttcaccatgttggccaggctcgtctcaaactcctgacctcaggtgatccacccgcctctgcctcccaaactgctgggattaaagcatgagccaccacacctggcccaacaaatatttattgaatgtccactatatttaagggtgagtaatgaccgaagataaggatatccagcttgtgagcttgtgagctttctttttttcttttttttttttcttgatatggagtctcactctgttgcccaggctggagtagagtgacgtgatgttggctcactgcaaccgccgcctcctaggttcaagcaattctcctccctcagcctcccgagtagctgggactacaggcgtgcaccatcatgcccggctaatttttgtatctttggtagagacagggtttcatcatgttggccaggctggtcttgaactcctgacctcaggtgatccacctgcctcggcctcccaatgtgctgagattacaggcgtaagccactatgcccagccgagcttggtttcctaactcagatgttaaccttacaatcttgattatgtgctgcttttaaggttcattagctaagtaaattcacaacaggctaaaaataaagccaaaataaataaacagaaacaccatcacttcagctgggtcatcagtgtgatcagggagtgtggctaggcacatctttgccttctcttcccttatgtttcaccaaaggcattttttttcccagtagttccacctgggtatagtcttgttgaaccgtcctgggctaacaacaagagccaaaaagtaggcaccttctgacaaataccatgattgctgggagatttaggtgcaagtcctaacaatcccaggacagtcccaggtgctgccaatgtcaatagtgagttagcctaggagccacaaaataatgatattattccactctttttgtttttttcttgtttgtttttatgtttttattatcctactcttgggtaaaatgcaccaataagaaatcattgacatgaaaaggggacctcatgagaatactggttacctttgcagggatattgactgaagaggcatgaggtgctggatctcaaggaggttaaatgggtgtggaaaaatatggtttgctgtacacattaaatctgtgcactttattatatgtaaattatacctcaattttatttatttatttttttttattttgagagagagagtcttgctctatcgtgcaggctggagtgcagtggcacaatctcggctcactgcaaactctgcctcctgcgttcaagcgattctcctgcctcagcctcccaagtagctgggattacaggcgctcaccaccacgcccagctaatttttgtatttttggtagagacgggatttcaccatgttagccaggctggtctcaaatgcctgacctcaagtgatctgcccacctcagcctcccaaggcgtgagccactgcaccaggcctatacctcaattttaaaagcatagcctcagatacctcatatccagctgccacattttctcaatggtgcttgccatgcaaaggttgtattcctgtgggcttagccacagactctctctttccatttccttaaatatggcagtgggcccttctatgttccagcaccacaaatatttgcctatacttattcttgaatctttggtcaagctcaatagaacctatcctaattgcaaattcaaaagtaggcaaatgacctgacctcaccaaaatgaataagagaatagcattggcaaatctcctacaaacagtatggaaaggaatgattcatgtatgcctgaaacagaattttagacattaacctcataaatatggatagaaaagaccagcccatcaagtgcttggagaatatgtactaaccattagtgcttcccaataggggaatgtgcattggtgaagcaagcagtctcccccagccctcccacttgtacaccctgcttttgcaatcctgtcctaagtagctggaaataccagctttggattagccaacaaaagaaggggtgtcatcttcaagggacctcttaagaggcagacattatttgagaatgtagggaggtttcttaatgagtgtgctaggggtggggaagacaagaagccttatttcccctcattatcgtattagcaagcttagtttattagagtggctaattgtcgattaggtattctttggcatgtctactggtgcccagccctgcagaagacagagcaaacttgaggatcttcaaatccctaggtgacagggagtggcatgcggggaggggccagagtgtggatgtggtaggagtaatcaatcctggcagggaggagtatcaatgacattgttcacaactctaccagtgcttagtaataacaaaaggcagacagactttgggtcggttttattattgttttaaaattccctctaggggctgggcgtggtggctcatgcctgtaatcccaacactttgaggggcgatggggggcgggtgaatcacgaggtcagaagttcgagaccatcctggccaatatggtgaaaccatgtctctgctaaaaacacaaaaattagccgggcttggtggtgcgtgcctgtagtcccagctactcgggaggctgaggcagaagaatcgcttgaacccaggaggtggaggttacagtgagccgaggtggcaccactgcactctagcctgggcaacagagcgagacactgtctcaaaaaaaaaaaattccctctatgcaatgcagtcccttatagcctgcactctatctgaacagctcccaccattctgtccttggtacactggtgaagaggagtgctgaaaaagtcagggtgagggtgggtaggggagaatggtttgaagttttcaaatctatgtggagaaaagtaccaaaatggctcttaaaaaaaaaaaaagaacttttgttcatttgcctgcaaaatgcaccagctactagcagcttttaggctttcctgcaaagccttaagtgagtgaagtgtgactagcaagcccttaaggatttgagttgtttctttttcttttttcttttctttttttttttttttgagttggagtttcgttcctgttggccaggctggagcacaatggcgccatcccagttcactgggacctccacctcctgggttcaagtgattctcctgtctcagcctcccgagtagcagggattataggtgcatgccaccatgcccagctaatttttgtatttttagtagagacggggtttcatcatattggtcaggctggtcttgaactcctcacctcaggtgatctacccgcctctgcctcccaaagtgctgggattacaggtgcgagccaccacacccagccggattttagttgttttctacagtggaaggttttgttttgtttttgtcttttttaaaaaaagttatgccagccactggacctggtggtgagtgcttgtagtcccaggtatttgggaagctgaggtgggaggactgcttgagtccaggaattcaaggcctgcctgggaaacacaggaagaccccatctccaataataataataataataataataataataataataataataataataatgtgcgggattcttcttagctgtaaatgctgaaatgtatatgttctcaaatgtgcgtgttcctggaccagcctgggtctttgctctagtgtttgctgctatcagttatttcaattgtctttgcttctctcagttatctgacactatgaaccctggatgacttttctttttttttttttttgttgagacagagtctcacactgtcacccaggctggagtgcagtggcgcgatctcggctcactgcaacctccgccagccaggttcaagcgattctcttgcctcagcctcccgagtagctgggattacaggcacgctgtaatttttgtacttttagtggagacggggtttcaccatcttggccaggctggtcttgaactcctgacctcatgctccacccacctcggcctcccaaagtgctgggattacaggcgtgagccaccgcgtctggccaacttttctaattgacttcatgtgaaggtttttgatatgccatagtattataaacaccaatactaattcctcctctctgcatccactctattctttgcaaaatacttttactctgggagatcttttgggcctcacaactccatgagggaatgaagctgctgtgttacctctggcaatgagctcagtctacctcagtggccctaggaagattcaaatcatgttgattctagaggcaaagtcaccttcatttgcccttgagatcagctctgttgactattctatacagaaagcctcatgcagaagttctcactaaggctaattatccctaaaagatcactcaaggaactgagaaatcagtattaaaagctggggagattggcctgggcacactgtttcccttatctgggaaacacttgccttacaggaacattgtaatggctactgggaaaacatagataacatatttctgttgttgggctctcaagccatcagatagtcttatcttgttgattgggagatactcctcatcacagaccactaaagaaaactgcacaggaactgtctgggaccagggcacagtcaggcaggccagtcatgtgagccaactggtcctgtgatctgctctccttcagggtggccaaggagggggcagttgcttgaagttcaccactaagctcaaagaggaaaacatgcaaatggtggcttctcctccatgtcagatgtgatctctctcttctttcctgctacagtaatccggtacaacagtgatctggttcagaaatatcacccttgcttctggatcgatgggcagtatctctgctgctctcagacagccaaaaatgctatgggctgccaaattttggagaacaggaatggaagtaagcaatctgatcgatataatttctttctcctttgactgtttccatcactctcccaagggtctgtcaagcccagggtcatagcataaggttgtacactttgggtgctaaacaaagggtcctgggggagggaggaggcacatgggggctgaaatccagctggtaatctgctctccaagctatgtgacctggcatgcctagctactttttctaacttgcctaaaggcactcaatatggacggcaaagtccctgaccaaacctgtccttggcccctttcctaaagtgcattccatatcatcactggcttcttgttttgcaggcttaaaacctgggagttctcaccggaagacaaaaaagcctcttcccccaacgcctgaggaggaccaggtatacagggaaactgggtgctgccactgcttaaatggaaacttatagtcaagccctaagaacacactagagtcttagaattaccctgggacttggcagtgttaattggtattcttgctaagatgggggatttgttcttctaattaggatttcctcctcgatggaaagatagaaggctctcagcaaccatgtaatccaatcacctgtttagaacaaaacctgatttttttaatgtaaagtttttgttgttgttttgtttttgcttttgtttttgttttgagacggagtctcgctctgtcgcccaggttcgagtgtaatggcatgatctcggctcactgcaacctccgcctcccagattcaagtgattctcctgtctcagcctcctgagtagctgggattacaggcatgcaccaccacgcccagctaatttttgtatttttagtagagatgggggtgtcaccatgttgttcaggctggtctcgaacccgcctcggcctcctaaagtgctgggattacaggcgtgagccaccgtgcccagctggaaagtattttcaaacatacagtaaagttagaagaatttaacacttaataccaacatactcaacacttagcactaacaccacctatcactaacacttcagaagttttttttttttttttggttccttcttgagggctagaaagccctttctcacatattgtaagtaagtagagcaggtattattatactcattttacaaagaaggaaaccaaggttctgagccacttagtagattcacgtacaagtttagtgccaagccggtttcctgaccttagctataaatggtttttgtctagtgagctttaaaaatagtaatgtttgggtcccattcctgagagtttgattttgatgtaattggtctgtgaggaaactgactaggtattggaattggttttttgttttttgtgggtttttttttgagacagtctcactctgtcacccaggctggagtgcagtggcgtggtcttggctcactacaacctccgcctcctggggtcaagttattctcctgcctcagcctcctgagtagctggggctatatgcacacactaccatgcccagctgatttttgcatttttagtagagatggggtttcgtcacgttggccaggctggtctcgaactcctggcctcaactgatccgcccgccttggcctccgaaagtacattggaatttaaaagttccatacatggtctttatatgtgtgcaaggctgagaactcctgcactggtgcttaaaaatggttgttgaatgactgctgagtaatattttagtatgcctgatttgggtgtcttgagtaagccagagagttgggagagaagagaagagtgcttggtatcttgacaaaccctcctaccttttctcctaactacatagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggtgagtccacaccagcccttcctgagcctggtgcctgcccactccctacacgcaaaaagtgctgcggcataattcccgtgatcagcatcctcatcagagactgttcttcccacaccagactgaacatgctctccctccaagtacttcccagcgtgcagctccctatacatggcctctgccacatctctgagcctctgttgttgggcacatataaccaatgcaacatgtgcataagctctgcacctcactggctcactgcctaaccatgcatcagagacatgattgtctttgagggaggtgcatgatacatatacctccatttgagatttgttctgagctcagggacgtgggcatatgaatctgtctcctggaggctggggaggtgctggatgaactgccacattgtttccttcacaggcaggaaggctacattcctagtaactatgtcactgaagcagaagactccatagaaatgtatgagtaagtatgtttatgtcagtccacaatcttccaggaggaactctctctctctatatatatatatatttatttatttatatatattttatatatatttatatatatatataacacacacaagtgtatatatgtatacatatgtatacatacactggtgtatatataggtatattatgtatacatacacaagtgtgtatatatatatatacacttttttctactttcaacatattttttatttcaagatatatattaaaattagtaccatctgaatcaaatgatgccaccacctcaaattagtgtatctgtcttacctttaccccccaaacaccctccatttatgagagctggagaggtcaccatgccctcaaatccagaagaatcacactcaaagaaaaaggagttgacgacctgatgaaagaattaaaatgtcaaactgctactgttgtcctttcctccctaatcatggaagtggattgttctcaagtgccctagtccctgatctcttccctgcaactccctgctgcttgcctttgcctgctactctccatttccatgaatcttcaatgccaacctgggtttgggaaagggatacagtgtgctatgcacatgacagatgctcagtaaatagggtttgagtgagttgactgaatcactgacatggacaagccctggagggtgctgtaacctccaatctgcttatgaccaggagccactcaagcagcactctcccttcacaggtggtattccaaacacatgactcggagtcaggctgagcaactgctaaagcaagaggtaagtgtggaaccactagcacacagcattctccttgcataagtgaggatcttgaactgagggcctgttctgccccctacctttgggcaaggcagtgtcaaagctgccatcgtctgggatcccaattacaccattttttttgtttttgtttttctgagacggactctcggtctgtcacccaggctggagtgcagtggcgtgatctgggctcactgcaacctccgccttctgggttcaagtaattctcctacctcagcctcccaagtagctgggattacaggcacatgccaccacgcccgactaatttttgtatttttagcagagacggggtttcaccatgttggccaggctggtctcgaactcctgacctcaggtgatccgcccacctcggcctcccaaaatgctgggattacaggcatgagccaccatgcccggcctgcaccttttaatattaaaagcaatgaggctgtagctcaagcgtggaacttggcagtaaaatcaggggttgttctattttctctctcaagtttgggcaggtgggatgcaggtgtgagcaccacttcctcctacagacagcttctttttcgttgtttcaggggaaagaaggaggtttcattgtcagagactccagcaaagctggcaaatatacagtgtctgtgtttgctaaatccacagggtgagtgctactattccaaggccctgaggacaaagaacaggggtaccctcctaatagctccttgatgctgtgcccgtcccacttcctctgtctctgaaactcaaaactcatctcacttcacttcctgggttctgttgacctttgtgcccaagttactgactaagcatccacttcttcagggaccctcaaggggtgatacgtcattatgttgtgtgttccacacctcagagccagtattacctggctgagaagcaccttttcagcaccatccctgagctcattaactaccatcagcacaactctgcaggtgagtaccaggggcaactgagaagggagttacagacaccaggataagcaatgcaggacaaggtgataagaggaagaatctgcctcacaggacagtgtgaattcactgtgaaaggaaatccctgtgatactgggtagaagctggtaaagaggtggtcagaggcagacctacacccaacagggactgactctttatttggtgattgatgttcagtgttaagagaagacacaaaagaggctggtgactgattcatcagcaagtattcattgagttcctactgtgtactcagcgatttcctcagttctagaggagaacacgggaacattctgagtcgaggtccttgtcctcaaagaacatacaggttagacaacatcagaagaaagtttataagcactgtaaaatttctaaaaactgagacattagtgagggcatggatatgggggaacagcttcatcaagaaggtaggatgtgagctaagcctgggctgggaggtgggaatatattcagttaggcagtgtatttcaattagtattttctcttttttgtccctgaaaagtattttgtgagaggagaaacctctggaaatatgtgggttcatggaggtcttctgggattcaaaatgtactagaaagatacacaccggaagtgtgaggctttaagtgaggatgtgtgaggcatcccacctcctacaccacaccaacagcatgacctctctctctgtttcaggactcatatccaggctcaaatatccagtgtctcaacaaaacaagaatgcaccttccactgcaggcctgggatacggtaactccttatttctctggggtagggtggactggccagttgcaaaaactacctttgctggccttgccttagggagtgtccttgaggtacactgttctgcagcagctgcctcaaggacgctcaagacagatccaagcaaaagttattcactgattttcttcctctagtggctacgactgggactgcaaaaacatagattcataaagggctttgtcgttgtcttgggtctttttgtcttttatttttaattgtgggaaaattttcagtactatccctgagttcattaactaccatcactaacataatcataaagggatttggggaggttgcttagtctatcttcttgccttatggccaccttgaacctaaaattcccagattcctctaaccaatgaatcccgtttctgagattgacttaagcaaagacagattagtacttctaaaaatttcccttttactagttttcctatttctaccccagtagggatttttgtctattgtaagaattatacattcatgaccccaaagaatcacaccaagactttattgttaggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgtgagttatagcccaaactcaactctcaatctatttgctggagtctaggaattcacacaacaacccactgaggcttaaagatgacttacagtaagagaggtttgggacgagggactgaagtttacctttaactggcggtagtcctaagtgctaagataatagtttctgtgccttagatattggttgagaatagtggtgatcatgggtgtgtaccatctcagtagcatttgggggtagatgtagaaaattaaactttcaagagaaatattctaatttagccttagcgttctttcattcctggacttgtttctttttcaattgatgggctccaaatccctgcttgcttccacattttaagcacttttgagatttagggtgggaaagaggaaaataaacttgctggtgtgaccccttatctgatgctctactcctaggtcagccccttcctccccagcccctttattgctattatgcagagccaaaaggagaagactagttccttgcctttcctgtaggaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggtgggaccttagaaggattggcctaggacaaagggctgatggggtggaagtagcagtggaagatatatcatacatggttgaggggggctgctggtgccatcatttcaattttatctagaaagtactataagttaggcgtgcctctgccccagtgctgagcccatcaaatatctccagcctcagctccatgaagtctgccgtggtgggaatcagagcagtcactcactcccaaccccctaccacccacaagaaaatggtggggtctttcagtggccattctggatttggaacagaagggactgtgcttcccaatgggactgctcctggcatggggccatcatttggttccttcagagtcacatactggggcctgtggatgcatttggcccacatgtgtgggttttttttatgttatataataattagcaaacccttaaaaagaaacatttcgcttaaaaaaaaaaaaaccctggaatttccagcttctcttgaaaatctacaccgtctggaaataccaggtccacattctcacgaaccgcctcctttcctctaggcatgtactctccatttcctgcaatctcgatccacttcacttcactcttacttaacttgcctggcccctgtaagcatcagagtttgcgcccctgtttctttcagtcaggccaaggctcaaattgtcctagtctcactggcagaaaagcagaaagcaaaaaaacttacttctcattctcccttctttgttttttgtttgttttgttttgttttgttttgttttgagatggagtctcgctctgttgcccaggctagagtgcaatggcaccatctcggctcactgcaaactccgcctcccagattcaagcaattctcctgcctcagcctcccaagtagctgggatcacaggcgcccaacaccacgcccagctaatttttgtatttttagtagatggggtatcgccatgttggccaggctggtcttgaactcttgacctcaggtgatccacccacctcggcctcccaaagtgttgggattacaggcgtgagccactgcacccagcctctcccttaattctttcagcatatcagtgagggaatggggtggtgtggaattgcccatgagaatgcaatcgttctgtatgtcctcagtgctttacctaggactacacagcaggttgctttccacgtggtggaaatgaatcaaaatttcttggtggcatcaacagattcctattaggtgggaaggtgtctgtagtcgaaggagatgaagcttccctggcttcattctactggtcagcagaagctttgtgcctttaacctctgtgctggggacggagtctcactggtctctgtttgcactacaggcagctcgaaactgtttggtaaacgatcaaggagttgttaaagtatctgatttcggcctgtccaggtgagtgtggctttttcatctttccctccagaagtaaaaatagcacagtatgaaacatgggtaggtgttacagttttaatcctctccttttcttttttttctcattctagcgttttctgccgatctttctattctttttcttcctctgagttatttaagccacctctttcatccttttgttttattgtcatatccctttccttcctttctccctttatctctacctcctcttttttaaatctatttccccaataccttatcttgatctattaatcctgatgactttactccattcctccttctttcttaatcagtctaattcccagtgacaactgcagataaaaggaagggaaggagaagagcagagaaaggaaaggtggatagagaagaggaagggagtacctactagatcttatttcacttcatccttcttgtaaccatattgtcaatcaggaaagctcaatcagatacaaaaacaggaaattcgttaaaagtaacgtttgtagaagatactagttgaggaggagagacttttgagaaagcctgtgtgtgtttgtgacactcttgtgaccgtgccaagaaaacgtaagcaaatatcaagcctccaaatcctaatgcaacaagtcctgaatcccttgcaggtatgtcctggatgatgaatacacaagctcagtaggctccaaatttccagtccggtggtccccaccggaagtcctgatgtatagcaagttcagcagcaaatctgacatttgggcttttggtaagtggataagattacacagattatacagctcaaaggataagaaatgcaatggggaaaattcacactttgcaacctccacagagatattgttcttgctttcattcttccaatccttggggagtgcttactgtgtgtcagccaccacaggggtttctgaggatgaaaactaaactggacatgatctctgcctttttagaacttaaaccatgttaaggaaaacaattcattcagttttcaacagcttctgaatactgattatgtaccaggcactctgccagaccctataactgcaaagacaaataagatgctgtctctcttctagaggagttaatagtctagtacgaccttgatctccatctagtgtggtcagtactatagcagaaatttgggcaaaatataaaaagcacagagcggggaaccaactgattctaatctttgaggttgatctaggaagactaggacccctgctatccaaaaagactgcaaaccaatttaataatttttttcaccttctaggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgaggtaagtgctttattaggatctcttaaattatttccttgaatctacttgcccatttagctggccattcagccaccaaagactgatagctgcacacattcttttttttcctttttttttttttttaatttgagacaaggtctcgctctttcacccaggttggagtacagtggcgcgatcttggcttactgcaaccttcgcctcccagattcaagcgattctcatgtctcagcctcccaagtagctgggattataggcgtgcaccaccacaccaagctaatttttttttttttttttggtgacacagtcttgctctgtcacccaggctggagtgcagtggcacgattttggctcactgcaacctctgcctcctgggttcaagtgattctcctgccttagcctcccgagtagctgggactacaggcacatgccaccgtgcccagctaatttttgcatttttagtagagacagcatttcaccatgttggccaggcaggtcttgaactcctgacctcaggtgatccacccacctcggcctcccaaagtgctgggattacaggcgtgagccactgagcctggccaattttgtatttttagtagagatggcatttcgccatgttgaccaggctgatctcgaactcctggcctcaagtgatccgcccacctcggcctcccaaagtgctgggattagaggcatcaaccaccacgccaggccttgcacacattctctgaccttggcctgcaacttgatcatctgatggccagaggctttcccaggcccactccgattctcactagagtgtcattagtacactccaatgccagctcagctttagggagtgaggtgttgtggggccatgtcatctagcataagcaggcagccagaggcattcagacaagtgaatgggcattacaaaagaaaagtcatgaaagtttgttcattcctttgtgtgtcattggccctttcttctactttattagctgccaaccgtttctggctgaggtcctaaatgagatttttttttttttttttttgagaccgagtctttctctgtcgcccaggctggagtgcagtggcgtgatctcggctcaccgcaagccccgcctcctgggttcacagcattctcctgcctcagcctctcgagtagctgggactacaggggcccgccaccacgcccggctaattttttgtatttttagtagagacagggtttcaccgtgttagccaagatggtctcgatctcctgaccttgtgatccacccgcctctgcctcccaaagtgctgggattacaggcatgagccacagcgcccggctaaatgagattttttttaaaacctactgcttgaaagggaactaaaacaggtagtgggttttttgtttgctttgttttgttttgctttttaatatggtgcatcgtggggtatgtgggtaggtgtggtattttggaaataaggaaatctgtcctactactattaaactgctttgctcctcttacctcgagttcttcccaagatgccttctctacttttcagtagatccttggcaacctaaatttctagtaggaaataaatgctcaactcttcagagtgtccaacaagtgcatatgtgaatctggagccttcttggtgaggtgaaaagtgggtatctggatccgagcatggctggtttccctcgaacaaatgacagatcacagagaaagtgcagaaagggaggactccttctttcttctgtgtgatgcaggattaagggtgattggctatgctccctcccaatcaggaccttcttactctgctaattaaaaatgatttcagacaggtactttatccacagcctgtttaaaggagtggtcaaaattggatgcatatcagaaaccctaaggagctcttaaaaatgcagattactggctgggcatggtggctcatgcctgtaatcccagcagtttgggaggccaaggcaagcggatcacgtggtcaggagatctagaccattctggccaacatggtgaaaccctgtctctactaaaaatacaaaaattaaccaggcgtggtgatgtgtgcctgtaatctcagctactcaggaggctgaggcaggagaatgacttgaacccaggaggtggaggttgcagtgagccgagatcctgccactgcactctggcctgagtgacagagcgagactgtgtcacaaaaaaaaattcaggtaactgggacttttctccagaaattctgattagctatgcctgaagtggaacccagaaatctctttttaaacttcccaggaaattctgatactcagctaagtttaagaatcactgagtcaaggaatcaagaaattgatgaccattggttctaacagattgagagcattctggcatgaatgttccctgaaccactaaataccaaatacctcgggggcttatgggccatggccatcaaaaagaaccttagtcgtaggccgggcgcggtggctcacgcctgtaatcccagcactttgggaggctgaggcgggggaattaccttaggtcaggaattcgagactagtctgaccaacatggtgaaacccggtctatactaaaaatacgaaaattagctgggcgtgatggcgtgcacctgtaatcccagctacctgggaggctgaggcaggaaaatcgcttgaacctgggaggtggcagtgagctgagctcacaccactgcactccagcctggacaacagggtgagactctgtctcaaaaagaaaaaaaaaaaaaaaccttagtctttttgttaccagtggtaaaaaaaaaaaaaaaaaaaaaaaggtcccaggtactcagaatccctgctcagtaatacagcctgtggttttgaaatattaatcactaaaaattatcacatgggatttctgttctgccaaccacttgaacttgtttggtagccatttttcacttgaggatccaaaataagaatgtgttgtatacagttacataatgaacttgccctcaattttgatcagtgtgattgtcagtttaatttgcaaattgttcttatcacactaataacctgagttactaaagatgaaaagtgcacaaagactttatggagagctgctatttcttttttttttttttttccttttgtaatcgacagggcatgctactgggcatagagcatatatttaataaacatttgctgcttactcattgcatttcccttgaattctggattctagccactctaacactttactttttctttggttttagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacacaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtctttggtatctctattaatcatgcagcctccctgaagcgccctatctcagtattccagaaagctgctgtgtagcattagtttggcatattcctacactgagaactcgacaggatcctccaggtttaagccctcttgttaactcctgcctctgaatcaaagatgcattaagcaaaaacagtgcctgtcacagcacgcatgcaatgttatttgaatgaatctgaaagttgggcacaaactgccatagcctcatttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggtgaggagcctggggctgggacctgaacactgtacctactttccctctgtccttgtaccgcgggactcgcgacaacgtcggggattcggggtggggggcgggcacctggcagcaacccttgattttctcaggttcctgtggcctagccggatgggagaagggtgactccgcttctctggggactgtcattccggacctcggctttgttggtgtagaggactgggtatcaaagaagacttatgccactggacacccagcactttcaggcacccgaggttgaagctgcctagtgctggtcaccaagactgatcggagcccccagtactgggattttatttttggcagcccgagtcccagagagtcagtgaatcagtgaatctgctattcctggactcctcgggatttaccttcattacccagttctaaccctctccgctgaaaaatgagtggctccagcccagtaactataaaagtggtgtaatctcttccaacgtacatacttatttgctttcttgttggattgttgtgtaataccaagccgttttgggtctgaaggttgaggaattgagcctgccctgtgaggggactttggcaaaagggtggaaggtatttgcagcttgccaacaacgtgttctgcttgccaaggacagatctcccttaatgtacacaattcacagaattcagaggccaaggataattttccttggaattagagggtctgaggcttgtgtacatggcagagaataatgaacgaaatttttgaaccacttaacttgaactatatacagtcattggtttccataggccctttcccataaacttacagtattgctggactatgacacctaccagatgcttacttaactctggtctgccttggaccagagtgctttgattcttttttaaaaatatctgtgattcgttactttggggctaggagggcgtgtggttaagtactattgcaagaatctgtaagctgcccggcgcggtggctcatgcctgtaatcccagcactttgggaggcgggtggatcacttgaggtcaggagttcgagaccagtctgggcaacacggcgaagccctgt

SEQ ID NO: 13098 - DNA, 34372 bp, Human
taaaaataaaaagtacttttcaaaaatgatgctggggcaattcgttttccatatttaaaagtagtaaattggataccatacatgaaaatcagctccaggtggattcaaaacataaatgtaaaatgcaaaaatataaaatttctagaagaaaatataaaagagtatcttgatatctgggtagtgatggatttctaaaacaagacataaaatgcataaatcataaaagaaatgactggtaatcagagtgcattaaaattaagaacttccatttatcagaaaacactattaagagactgaaaagacaagccataaacataagcaataaaagattagtataagattataaacagaaccctaagaatctaaaagcaaaagaaaaaccaatagaaagatagaccaaaaagtagaataggctcagaataggctcttttaaaaagagaaaactcaaatggccagcagttgaattaaaagatgctcaaactcattagtaatcagggaaatgcaaattaaaatcataatacgatagttttccacacttacttgaattataaaaacaaaaaagtctggaaaataccaagggttggtaagcatgtagaggaagtagaactctcattcataactctctgtagtatacatttaggtggtcacttcggaacgggtttggaattacacagcaaagtagaatatgtgcaaatctcaggaccctggaattttactcctgggtatataccttagagaaactgtagcatatgtgtgacatttgatcaacattgttccatcatcatatccatcagtagtaggatgaatgaatacattaatgtatattcattcatgcaatggcatattagatagcagtgtaagtgaaccgcaattacatgtacatgtatgaatctcaaaaacccaatgttgaaagaagcaaaccacagaagcatacatacacactgccaggtttcatttacaaaaagttcaaaaacaggaaaaactaaacaatatattgcttagggatgcaattatagttagtaaaaatataaagaaaaataacagaatgattaccccaaatttcaggatagtgattacatccggtggggtagaggaggggaagaagatagatgtgatcagggagggaaatacaaagagctttaagatactggagaaaaatagtctattttctttaatctgagtagtgaacacatagatacttattccttaaaattattctttaagttacatatgtatgttttatatactcttctgtgtatatttcaccattttagaaaagggaaaaaaaatcagtgcccagagctgaacacacaactctagtaaatctatcatactagaagacaatcatctccattcttttgagtgctctgcctctgtttattttgaaccaaagtgcacttttatacttgttaaattttctcttgctctatttggcccttcttttcacttgtccttccagccagtcaagttctccccaaagccatcatcatatatgtcaaccacagatcatcctccaggggaactggtatgctaaagtttctgagctagccaggctgaaatccaaatggcagccggcagatgtggcaacagtttgaaaagtgcactttgaaacagcttccttaccacacacgcttccctccctacttctcctgaagtaatctgtttacagacccagactaataatcttttttatgagaaactttagcaaatcttttatctaggaaggcaatgcttcacattaggtcatgttgataagatgatgagagagaatattttcatccaagaatgttgctatttcctgaagcagtaaaatccccacaggtaaaacccttgtggttctcatagatagggctggtctatctaagctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatgtaactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgggcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccacagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtgacagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacgctgaataaatgtctttttttttttaatgtgctgtgtaaagttagtctactctgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcgcccaccaccacacttggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactacactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgggaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttcttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccacgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttcttgagacacagtcttgctttgtcacccaggctggagtgcaatggtgccatctcggctcactgcaacctccacctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtgagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttcttcttcacttgatgaatgagtcttttgttacttctttttgggctctccatttgggaaagaaaatctagaaagtatgctcattgtaattgaaattgtattataattgcaagtcagctatactgtcatcttgtattattctgttaaaagcgattgtgaaaacttgaactccatgttaggatgacttatttagtcaagaggagctctttatcactattaagggagtttattaatgtctagtttaaaaaataacaatttataattttcatagatttttgtggactcctacctatatcgctaaggaatcattcagctaataacataagcaaaatgccttcattctctatcagaatgctttttatttctgccatctacccaacctcggcctacaaggaccacactggctctgggatgttagtcgtcacagtgaatccctagaaggagagaagcccagggctcttaagagagaaacctcacacttcattgtgcccagacaattcaactcattatagattagaagaatggttgtactgaattagcattatattatctattttttctaccattaagtgaccacgaatgaacaaatggttgtttctaatagtttaggaacctctacggcttgagggataaaactgtttttggtttttttttgtcactagtctgagcacaataaaggtaggtcatgaactcatggtggctaatcatgtttcatttattacaacagtaaaacaatactgatggttgtttacatagggagggataccactgctgttgccaatttgttcacccggatttcagctaattcaggtttaataaggctttgggaaaatgcacaatgaaaccttgaagacatgattcttattagacaactactgaccaaatgacaacttcatcttcaatgaccttgatttggaatcttgaaacttacaacgagttcctaatgagaaaggcatcactcttggtctccatgtctaaatatattgacacactcacttcaagatatgatggctgccaaaatcaatatcccaaggcttgaatatttatgggagtaggcataaattcgtgattatattcatggtaatgaatataataaatcctatgcatagccaacatccaagttgaactggggatgagcaggatacacagaaagctcctcacctgctttgagcaagtttttcttgcaaagttgtaatatgaaataccttaatcaacaaatttcttataaatgtttatatgagtagaaaatccctcaatttcattgtcactcaaaaagttgattatctttgcattcttttgcttgacatgtaagcaatatgctattacattctctaagcctatgccaggcttttaattcacctgaccataatcctaacccaggggatagaattccaagaatataaattggctcaaaagtagttccagtagaactttactgattattaaggcaactcttaacctcttgaggttggcctgatagagagaaaccatgttcctccttaat

SEQ ID NO: 13099 - DNA, 34875 bp, Human
taaaaataaaaagtacttttcaaaaatgatgctggggcaattcgttttccatatttaaaagtagtaaattggataccatacatgaaaatcagctccaggtggattcaaaacataaatgtaaaatgcaaaaatataaaatttctagaagaaaatataaaagagtatcttgatatctgggtagtgatggatttctaaaacaagacataaaatgcataaatcataaaagaaatgactggtaatcagagtgcattaaaattaagaacttccatttatcagaaaacactattaagagactgaaaagacaagccataaacataagcaataaaagattagtataagattataaacagaaccctaagaatctaaaagcaaaagaaaaaccaatagaaagatagaccaaaaagtagaataggctcagaataggctcttttaaaaagagaaaactcaaatggccagcagttgaattaaaagatgctcaaactcattagtaatcagggaaatgcaaattaaaatcataatacgatagttttccacacttacttgaattataaaaacaaaaaagtctggaaaataccaagggttggtaagcatgtagaggaagtagaactctcattcataactctctgtagtatacatttaggtggtcacttcggaacgggtttggaattacacagcaaagtagaatatgtgcaaatctcaggaccctggaattttactcctgggtatataccttagagaaactgtagcatatgtgtgacatttgatcaacattgttccatcatcatatccatcagtagtaggatgaatgaatacattaatgtatattcattcatgcaatggcatattagatagcagtgtaagtgaaccgcaattacatgtacatgtatgaatctcaaaaacccaatgttgaaagaagcaaaccacagaagcatacatacacactgccaggtttcatttacaaaaagttcaaaaacaggaaaaactaaacaatatattgcttagggatgcaattatagttagtaaaaatataaagaaaaataacagaatgattaccccaaatttcaggatagtgattacatccggtggggtagaggaggggaagaagatagatgtgatcagggagggaaatacaaagagctttaagatactggagaaaaatagtctattttctttaatctgagtagtgaacacatagatacttattccttaaaattattctttaagttacatatgtatgttttatatactcttctgtgtatatttcaccattttagaaaagggaaaaaaaatcagtgcccagagctgaacacacaactctagtaaatctatcatactagaagacaatcatctccattcttttgagtgctctgcctctgtttattttgaaccaaagtgcacttttatacttgttaaattttctcttgctctatttggcccttcttttcacttgtccttccagccagtcaagttctccccaaagccatcatcatatatgtcaaccacagatcatcctccaggggaactggtatgctaaagtttctgagctagccaggctgaaatccaaatggcagccggcagatgtggcaacagtttgaaaagtgcactttgaaacagcttccttaccacacacgcttccctccctacttctcctgaagtaatctgtttacagacccagactaataatcttttttatgagaaactttagcaaatcttttatctaggaaggcaatgcttcacattaggtcatgttgataagatgatgagagagaatattttcatccaagaatgttgctatttcctgaagcagtaaaatccccacaggtaaaacccttgtggttctcatagatagggctggtctatctaagctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatgtaactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgggcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccacagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtgacagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacgctgaataaatgtctttttttttttaatgtgctgtgtaaagttagtctactctgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcgcccaccaccacacttggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactacactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgggaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttcttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccacgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttcttgagacacagtcttgctttgtcacccaggctggagtgcaatggtgccatctcggctcactgcaacctccacctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtgagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttcttcttcacttgatgaatgagtcttttgttacttctttttgggctctccatttgggaaagaaaatctagaaagtatgctcattgtaattgaaattgtattataattgcaagtcagctatactgtcatcttgtattattctgttaaaagcgattgtgaaaacttgaactccatgttaggatgacttatttagtcaagaggagctctttatcactattaagggagtttattaatgtctagtttaaaaaataacaatttataattttcatagatttttgtggactcctacctatatcgctaaggaatcattcagctaataacataagcaaaatgccttcattctctatcagaatgctttttatttctgccatctacccaacctcggcctacaaggaccacactggctctgggatgttagtcgtcacagtgaatccctagaaggagagaagcccagggctcttaagagagaaacctcacacttcattgtgcccagacaattcaactcattatagattagaagaatggttgtactgaattagcattatattatctattttttctaccattaagtgaccacgaatgaacaaatggttgtttctaatagtttaggaacctctacggcttgagggataaaactgtttttggtttttttttgtcactagtctgagcacaataaaggtaggtcatgaactcatggtggctaatcatgtttcatttattacaacagtaaaacaatactgatggttgtttacatagggagggataccactgctgttgccaatttgttcacccggatttcagctaattcaggtttaataaggctttgggaaaatgcacaatgaaaccttgaagacatgattcttattagacaactactgaccaaatgacaacttcatcttcaatgaccttgatttggaatcttgaaacttacaacgagttcctaatgagaaaggcatcactcttggtctccatgtctaaatatattgacacactcacttcaagatatgatggctgccaaaatcaatatcccaaggcttgaatatttatgggagtaggcataaattcgtgattatattcatggtaatgaatataataaatcctatgcatagccaacatccaagttgaactggggatgagcaggatacacagaaagctcctcacctgctttgagcaagtttttcttgcaaagttgtaatatgaaataccttaatcaacaaatttcttataaatgtttatatgagtagaaaatccctcaatttcattgtcactcaaaaagttgattatctttgcattcttttgcttgacatgtaagcaatatgctattacattctctaagcctatgccaggcttttaattcacctgaccataatcctaacccaggggatagaattccaagaatataaattggctcaaaagtagttccagtagaactttactgattattaaggcaactcttaacctcttgaggttggcctgatagagagaaaccatgttcctccttaatgccactacgagagagatggggttggggtggggggagaggaggaggcggcggcgcggcgagagagagaaatactaggcaataagacccatagattagagctaatggcactaattatgttcatacctatccgcaaggaagcaggcaggagcagacctaatgagcaatctgactgtgctctacatttggtccacttaaaatgagaagaatgtacaagttttagggttttctgtgttgtaagttcccagaataaacgtagttacagggtagggctgcaggttagggactgcctggaagataggatgaaatgtattttgttcatttgatttctgtttttatttcatcttgagcatgtgaaaaatcagtggctttttaaactttcaaagttgactgcctagactgataagtttaagaacacacaagtaaatgtcaacagtctcttgtgttgctgacacactcaaaccagtgctaaaacaatttttgtcttaactctgaattatacatgt

SEQ ID NO: 13100 - DNA, 24538 bp, Human
taaaaattatttatgcaaggctggcagtgcaacatagcattcagatccagggtccatttggtctaatatggctgatattaagtgtttctcaaggggagagacattattggcattcagtggggggaggggttcatcctgtagaactgccttggacatggcagtccatttatcatctctggcttctcttcccctagcagtagtcattgcaacaactgaaaatgccactgtacatttccaaaaatgctcctccacaagggttgagaactttgagaactactttaagggaaatttcataagaaagcatgcgtgtcttaaatgctgccataaagctacctcaataactacaatgctactcaaattacctgaccctaagaatcgccagtggcacttgtttaaatataacgattcccaagttctttccctggagtcccattccatagggctggggtggagccccaggaatctatactcttactcaaagaccccaggttaatcttttgtttatgtaagtttgccaaacactgagttagaaatatactcagccgtacatgcatttagcaaaagttcaccacaacggaacaatgacacaccaaaactctttgaaactgtgccttctacagagctgtaaatctccttttggaccattccattacacaaggtgtcctcttggtcacacagtgattgcaaatgggactctagagtcatggaaatgggtatactcttctcaaactttccatctttaccagaattacttcttaaagtgatatgcttcatggtgtaaactagcacttattaattttttctaaatatttatcatatttcatatacttttattttggagatggagtttcgctcttgttgcccaggctggagcgcaatggcagatctcggatcaccgcaacatccatctcccgggttcaagcgattctctggcctcagcctcctgagcagctgggattacaggcatgcgccaccacgcccggctaattttgtatttttagtagaaaaggggttctccatgttggccaggctggtctccaactcccgacctcaggtgatgcgcccgcctcggcctcccaaagtgttggcattacaggcatgagccaccgcgcccggcccatatacttttaatacatgtggaattaataaaaacgtccatgcctccaattccgtggctattttaccgtcttcctttttcggacaagtccctcaaaggtagcgctcttggctccttcctttgcttatcccctaaccctgtcctcctgaggtgccccctggatttcctccaaccccggcagggtctgcctttccgggatgatacaacgacctgccctgcatgccatatcccaggcgcgtgggcaccaaagtgtggaaaaaccgatgaatgacgttttctgtttccgatactctgcctgccagaatcccctgccgcaccgccccaccacgaagcacatggaacccacggactacacgaggacagaggtctgttctccctttacctctcccatttctttaactatgcttctctcggctggcatgccctttcctcatctcactccacacacgaacaggtttagcaaataatatgcacgctgctgggacgggcccaagcatttccctcccttgatagggcggaactaaaatgcaagccccacagttgtcagcaaaggacttccctgttaccatggtaaagccgctgcgcctttattgtggttgaggagtacttgcatcaacctaagagaaaattaataagaaggaagtctgcaggctgaaacccttcaaattagcctggactcgcctgcatctggctcggaacagagttaatctcaggagtgagaatatagccctccggtggacgcaactcgcgcctgcggctaacagaatgtctccaggggaggggctctgcgtccgttccgcccaggcccttccggctcacgcgccgtacggaagcgtgctcagcgctgggcttgtgctccgtacggaagtgtgctttggcgcaccggaagccgactcaacagagctatggcgggtttgactgtgagagacccagcggtggatcgttctctacgttctgtgttcggtgagaggaattcgttgtagtcaagcttcggggagggactcccctctgcaccttctatctcatgaatcgctaccggagccgctgacggttcggacgtgcagttctccctgcttatcctgtagggcgtccaacctggtggactcatgagcaaagagatattcccattctgccgaggtctcgtaggctttccgcaatatcagtggggaagttagactagcgttcagcttctgtgcgtttctcctttcatgagcttcaattattctctagaggagaaggctcacggtaacagctcctcactgtcccgtactacttctcatcctctgccccagaatacagactatatgctgagggtatagatcctagtgtccacttactgtcctctcctaaggactttcatcctttgctttttatctgtaacattttagtgcatcaatagtggtagcggccacctggtgtcctgagatggcttgtaagtgaatgaatgaatgaactattaagatctcctcagaggaattttaaaaaggatcgaaacgattctgaattatctttttggctgaaataagttgtttttaaaaatacgtgtgattattttagagtaccatttgaaagggacatgacaaagtagttcagaatactttttaaacatctttcactacattcatcgtcattctcccttaaatgttgtatgtgtggaaatacataggaacctgttttaaaaattatattaaataacattgatattttttgtagtcactgatgagacttgcagatctttaggtaaataccagtgccaaagtatttatttgcaccaaagttaaggaaaatctaacacgtgtcagatcagtctgagaactaacatttgagagtacctacacattttgtatttagtttcagtggtatatttcctttgttaagaggtctgaagaaatacaatggaattgggattggagaacactattttgagtcttatatttgatgatataagtttactttctcactaaagatctatgttataaactcagaattttaatgttacctattttcttccttagtggggaacattccttatgaagctactgaagagcagttgaaggacatcttttctgaggttggacctgttgttagtttcaggtgagatccccttttccttcatggtgggagcttcttaaaaatcaccacagatttggctcttagtaataatggcaggttttctttactggtgacttttcacatacattttgttcttgtaacagctttattgagatataattgatacactatacaattgacatttattcttacctaaaatatgtttttttcgttaaaaatgttttttaggcagggcatagtgactcaagcctgtaatcccagcactttgggaggccgaggcaggcggatcacctggggtcaggagttcgagaccagcctgaccaatgtggtgaaaccttgtctctactaaaaatacaaaaattagccgccgtggtggcccatgcctgtagtcccagctactcaggaggctgagacaggagaattgcttgaacccgggaggcagagatagcagtgagccaagatcatgccactgcactccagcctgggcaacagagcaagactccatctcaggaaaaaaaaaaaaaaagttttaaaaaatatttctgtgaggctgtcagagatataaggttatttatgttacagtgggcccaattaaagcatggcaatgttagcaggaaccctgtatgtgtgtaacatttgttcctgacacttggttctgctctccagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagtgagtacaaatccaacttggatgcagtatgagttagtaaagatgtaacaatgaagattttccatttctgatatgttttagaatatgctgaaatggttagccacgcagcttgtttattacttgactgacctgatgtgcctgagttaggcaagtattatatatatctttttaaaaactttttataaattttttttcaagtaattgtctgaaatttctatacccttgctctggatggagcagggcaaggcctcaaaccgtttcaaaactgttctggcaagcactgtagggatgcatagggtcactgcagacctaagcatgctggaggcttgctagtaagtgtatatctttaagaaacagataaagttgacattagaaattcttcagttgctccagcctgggcgacagagtgagactctgtctcaaaaaaaaaaaaaaaaaaaagaatttccattgctaaggagttatttccagttaaagatgaattcaaattcatcaagccattagtagtactaactgtggcattagtcattcctgtcactcttttcaggaatttttgaagttagcgtatttttctcttttaaccttttgtttctgaaatgacttgttaaaagaagtcaatgtgcctagttctctaacttaggttaacattgtccttccatgtgatcatgatccccagctttcctctgagaacagaaaatacactctcactttcctccacagaaacaagaggctttcacatcatttatttctcagctctggagaatctaaaattatcagctggttcttacagcagccctgaaaagtagatatttgaaatgatttagctttttgttttgcctccctaactttcttgtactttcttcttgattaggccttggcactggtgcccctgtcattgagtcaccttatggagagaccatcagtcctgaggatgcccctgagtccattagcaaagcagttgccagccttccaccagagcagatgtttgagctgatgaaacaaatgaaggtgggaggaggcattaggttatgaataaagcaaatcacatcaggttttcaaggagttacttgaattagttccctgagctcaaatagaaattgtctgtagaccaccatttcttgcaccttcaatattctgtatgtacacagtatattttacattttgtacaaagagctttctatttttgtacacaaacacagctatccaaacaatccagctggagttttgtggcccatagatgtcagatgtagatattaaaatttggcttttttcctaaatgataatatcacagtatttgaaatgcctctttcttctcttgcctgccatgaccaaggtttttttgtgccatgcaaaaactaatgataaagagcctcttgaatattacatttctcagaggggaatggctctaaatcactatcagtttctaagtcataagtattaaacctgaatctgcttatcttctcagctctgtgtccagaatagtccccaggaggcacggaacatgttacttcagaaccctcaactggcttatgctttgctgcaagcacaggtagtgatgagaattgtggatccggaaattgccctggtgagtgcttctggttcttttatggaaatggtcgggtaaaccttgaatgggataggaactacctgattgctttgttaaacagacagctcataggtttgtcttttcactttttagaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttggtagggctttatcccttaacatttttttgtatctgtcttagaatgtcattttctttttaggagaatatattgaaagaagaatggtcaggaaccagagatgataatttcaatttccaggcataaaagcaatttccaggttgcagagcacatgacatctgaatgaatatagattcgattccaagtttgtaaaacaaagagatccttcccgtatgcccttttcttataagctaactttgtgtgtatgtgcatgcctggcactgtggttggcacttcgttattccatatgcattatctcatttaatcctcaaagcaattgtatgaggttggcactcttattatctccattcttactgatgaaaaaagtaaagcttgctttcaaagcatgacacaaaaccttaaagccataaaaaattgatacatttgaaaactaaaaaatttctatataaagaaaaaaataagtatcaaagacatgacaaattgagaaaaagtatttaccacacatgtgatggaaaacagactaataaagagcccatagtcattcacaagaatgtttattgccttagagtgaaaaattggaaatgtcctaaatgtacgtcagtggaagaatggagaaaatgtgtggtacattcatccagtgaaatactgtacaacagttaaataaactacacgtatcaacatgaatgactttgaaaaacataattccatacagcagttaagatgaactaggatacataatatcaacacaactccaaaacagtgacatacggacatgaaactaagtgaatatggatgcattcccgaaatgtaggatatatgtttctgcataaatccccaaaatatgtggaatgagttgcaaaataatatattgagtatgtaatgattcatataaaattttgaaacattaagaagacgtcttagtggtcatcaaaggagaagagagcacaggatgcaattggggaagaccgtacaggccattggtttattttatttacttatttatttcctaagctgggtggctattttattttctatatgatttgtatatctgtaatttttcataataaattttaaaaggcctcctataaattagtaagaaaatttccaataacccagtagaaaaatgggaaatagacataaatatttcacaaaaggagaaatataaatatataaaaatttattcaacttcaaaataagataatgtaataaattatcatttatatatgtaatgttataagataatgtaaatagaaactacaataagctaccatttttcatctctcaggttggcagaggtacagggcagggaccagcaaacatttttctgtaaatgatcagacagtaaatatttttggctttgcaagtcacaggatctgccacagctactctgccatggtagtatgaaatcagccataggcaataagtgaacaagtgtgtgtggttgtgttccgttaaaagtttgtttataaaaccaggcagtgagcccgatttggcccatgggtcatagtttgccaacccctgctctaaataaataaatacattttcagagatagaaaaaaaaagctaaggcccagagaggttagctggtccaaaaattgacacaattataagtggcagatctatttctgaacctggttttatctgacctcacagccagttttctcttaactactttcctatacagctcttccttttcttttgtagagttttgtgttccttaaacgtatatgtgattttttttatataacttggcttttattctttatttattgagctgtttctaattcaagggactactcagttttttggggaatgcacagatgaaaagatgacattctctttttctcaacgagttttaatgtagcatttaaaaaaatatatttcacattcccccaaaaccagaattatatctaaggacaggagtgagaaaagattggttaaattaaaaaaaaaatttaattttaaaaatgtggactaccagcagttgttttttttaaaagagtcccagtctccttttatgtttcttgggtttagggcttttttttttttttttttttactcttattggcagccccaatcatgaagttaacagtaggtgttatgtgctgccttgccacacagataagacttgtcaatctctacattgagaatatgttccatcttaaccgtgttccatataaccaggctcatgacgtatattgcttctgtggagtttaaagtgtgtgacaaatctaatgctgcataagacatgccatacaaaaaggatgtttagtagtgtatttggggctgttcatttgaagaggacttttaaggtcgtagacttagtatattgagtatccacagaggcatatacatactctgttttttttgcttggtcagggtggaatgcatgtcaatggcgcacctcctctgatgcaagcttctatgcagggtggagttccagcaccagggcaaatgccagctgctgtcacaggacctggccctggttccttagctcctggaggtaagtttcatttagtcttcaccatttcagtacttgctaaagttttgtcatagccactgttgcagtgcagccaaatatgataatgggatccttaggtaaaattaatacacagctagaaagtatatatcttaggtggaggaaatagtagatttcttacgttaaatcctgtatgtctaattataagaacagggaaagggacagtaaagtgaaagagcatagtaaaacttccaagttaacaagggggaaaatggaatgagtggaaacaaaatcaagccagcaaaaatagagaagaggaaaaaagtaagagacagtgtaaaataagtaataataaatgtagagtaagatggaaggaataaaaactaatgtagttgttactctgctaaatatgaatgaactgtcagattaggttcaaaagctcatgaagaaaacagacaaaaaaatacaaggtcacatttgttatagcatattaaactgacataaaattgtattttaacaaacataatcagaacaaacaacaaaagggaaaaagagaaatttaaaagctatgtacatttattgaaaatgtatagatcggcaattaataagagtattgctcatatacttgtaactgttccttgttcaacaattgtaactaagaagattgagtgaaataatgattccccatatgaaacatctgtatgaacacatgatgtattaccaatatttaaagtttttttatgtaacaaacttggtttttgttaatttatctaatctagggtaggttgagtacaacactactcatggagaatgatttaattctaaattgttctgttctgtagagaatccagtctgcagagctaagttgatgaggaatggaagaagagattttttgaagaaatttctgcaaactcaggaattttttgtatctactttaggattgttatgtatctactttatcctaatagagttatacttgtatttaaattatctttcatgacaggaggtccatgggtaagtgacattgttttcctgtattatagaagagcttcctgccaagagtttggtaaccaatgaaatgaattattcttattgaactcactattctgtcactgaaacataaagtacaaattgtaaatatactaacaaaccccatcttctctctcattgcattgttgaatatcttcctttgtaggtttctgcttgtggagcagaatgaggaaatttgtaaactcagccactgttctaatttttcttttccgctgttctaattggtgttttttcttgtctgccctttatcttctaggaggaatgcaggctcaggttggaatgccaggaagtggaccagtgtccatggaacgggggcaaggtaaataaatattaatgtctgactaatgttaattggtcatggaagtgttccacatccacagtatctaatatggcagccactaaccacccatggctatttcaatattaagttaattaaaattaagtaaaatttaaaactcagttcctcagtcacaatagccacattccaagtgctcagtggccacaggtgactagtggataccatacaggacattacagatatagaacatttctatcatcgtaaaaagatctattggacagtgctggtctagactttccacctggtgattcagagtccagctctacaagaattgataatgaagcaagtggatcgtttgtttcctgattcctagtctaataattccactgacatgttctctctccctgtatggatatctgttgactgagtaaggaattttaataatgagcatgtaaatatgtggctgggtatgtagaagactagatttaaaccccagagaaaactgggagggaatcataggtctgtaacgcctacttaatgaacatatgttgtaccgtggctgtactgctatatacaacagtagctgctgctccaaaatctccatgttgtttcttcatgttactggagtttgaaggacaagaaagtgcagtggttcagttggaaacaatgttaggaggagagatcgtaagaaaagagaaggaactgagtgcatactatatgccaggcactttaattttcataaataatcttgtgagttaggtggcagcacctcagttttacaggcaaagagttggaagctcagaataagttactttctcaaggggacaaggtaagtaaatattaatgtatgagtaatgtggactggatttggtgctcttattttctcttccaactagtaagtggcagagctaagattcagaagtctttgactccagaatctgtcctctttctgtcactccacactgcctctgttaacttccaagcatattcttcagtgtcttctactcttattccttgggaataaaatgatgggaaagactgctttggacaagcatagagaagcttaaggttttttcttttgtagcatatggtttataagtggaacccatttaaaaagcaaaatattggccaggcgcagtggctcatgcctgtaatcccagcactttgggaggctgaggtgggtggattgcttgagctcagaggtttgaaactagcctagacaacatggcaaaaccccgtctctataaaaaatacaaaaactagttgggcaatggtggtgtgcacttgtggtcccagctacttgggaggccgaagtggaaggatcacttgagcccaacaggttgagactgcagtgagccataatcgggcaccactgcactccagcctgggcaacagagcaagaccctgtctcaaagaatatatatatatacacacacacacacatatatatacacacatacatacataaacattaatatacaagcctgtggtttttacactggggttggttgctgaagtgacagaattaactttttcttgttagaagtctgacagcaggacaaactccctggccaaatatctcatattttctctaagcatccaatgcttttgtgctattgtacatccctctatccccaccgcaccactgtcaatagatcatatatgttccccagagtatttctgcagtaatgagaaggtattagggtttcagtcatacttctgcctgtcatggggccagccctcaatccatcaggttttagctgtttaacgcatacttgcacaagacatcttcctattatagttatcttcacctttttgtcagaaattggcaaagggaagtgactcatgttttgagggtatttccaggatgtcttcatgcagagactaagtgagatgagctttcttttatagtttccttcagtacccagcagaggaagcaagagtcttttcgtgtgtgcctagtttgtcttacttttcctgaaatccatgctgcttttaatgctgaaaggagatggagatgtttgagaagatacttcttgcttccctgccatgtttgtttagtgtcggttcccatgtcatctcattagtctttgtttgctgttgtcatgatgtttattatcaaagacttgctgtggcagagtatttcttgtggagtgatattctctttcatcatgtaaagttcattcactgcatttccccatctgatacatttttgacagcagaaatttttgtgctttaaaatgtgacaaaaatagaattgccgtacttcagttatggccgtttcagaatgaatcttgccttccagattcagtgcagtttcttttatgttttgcttctgaaactacatttatgttctttgcataactagaagattcaaaactatcctttttatatatttttttcctaatgatttcataaggagacctaacggaaaactagtagcagaggtgaaaatcgaaaatgtcaggttattcccacctagatcaaaccagtgcccccatgggattccctttcaaaagctatctggtcaaaatggaactatttcagagacccaaaggagctagtgtagtttagggagattttgtagcctggagcaagccgatgaactcttggctttttaacttatatatgtaaatctcaatctccatgtgtgtgtgtttctgcgtgtgtatgcaagctattttaagtgtctgctctttctccttttgaacttactgcttacctaggaaccctacagcactcgcccgtgggacccgccgggcctgcatcaattgagcgagttcaaggtacccattgtatctgtgggtttccttttgcttgtggtgttcagggtgggacgttgagaggaaaagagctgcgtggcagtcatcctcgcgttcagaacccaaaagggtagtgtttttgggtttttgtttttttaattttttcctgttgaggccacaagcctaagattgacctcttcacacagggcagagaacatggatgatatgggcatctgtccgaggctgtactccctccctactggtgtcaggaggcttggatggaatagcagtctgtaaggagacagcgggttcttgcagagccatggcagtgttcacatatgccaagactctacctctgttttgtgactctggtccttgaactaagattgattagaaggaaaaccaggagcataagtttctccaggtcgcagtgctagtccttggcaggttgctccccagtttgctctttatataattccatccatacctctgacatggcacagattctgcctacaccctgcttctgttcttgagctgcaagaggattctgctgtggtgaggtttcacccactctaaggtgtctgaattatgttgtcagtggtatatagagtcatttcttgtttgcttatgtgtctttcacagcagtaactccccgtttgtttccctgtcagtgccgatgcaagaccccagagcagctatgcagcggggatccttgcctgcgaatgtcccaacccctcgaggcttgttaggagatgctccgaatgatccacggggaggcactttactttctgtaactggagaggtagagcctaggtaagcactaacatagaaggaaacagttgaagaaatcagaattgtcccttcttccctgagaacaaaatctttctgtaccagttgtacctgtttgcctacttcaaaaggtagatcaatattcatggccactgtccaagggtaagcacttctcctaaggcagaactatgtacttgagtatgtcattttgagctattatatttttagaaattggaaattttagtatacatacttgaacagggaaatttatagtagtggaaatattaataatagcaataataggccgggtgcagtggctgacgcctataatcccagtactttgggaggccaaggtgggtggatcacttgaggtcaggagttcgagacctgcctggcctacatggtgaaatcccatctctactaaaaatagaaaaattagccgggcgtggtggcgggcgcctataattacagctactggggaggctgaggcaggagaatcgcttgaacccaggaggtggaggttgcagtgagccgaggtcatgccactgcactccagcctgggcaacaagagtgaaactccatttcaaaagtaaataaataaataaaataatgatagtaataataattgacattaatggggatcatgcctctgactctgctctgagtactttacttagatcatcttattaaatccacaagatcctgtgagatggataccattattagtcccattttacacgtgaaactgatgtgtggaaaagttaaataatgtgtccaatatcacacagctaataagtgatagagcctagatttgaacccatacagtctgaatccagagctcatgttcttatgcattgttctgcaaactcatacatataatgaatattcgttgattcctccctaattatgaaccaaataacgaaattctagaatacatggatttatatctctgtagcttttcttccatctatttggtgttattttcttgttagtattcatagactacatcagctctttgttggatgtttacttactgatctggttggtactttgttgttgttttgttctattttaaaatacaacgtttttctccatctccagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtaaggggagatcacattgcaaatgccataatgaactcaactgtcttaggctctaatctgggataaagaatgctggaacagtaggtttgcaagcatctttaaggtttatccacaaatctgagaaactggggaggagacaatagtctcatatgttaatagctgaggggacaaatgtgactagaagagatttctatctttcttggattgttcatcattcttgcagtacatgcaagtagctacataatggttttgttacatttttctttataggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtatgtgtaacactgacttctggcatccaagtgaaatcttgatctattcaggaattgattattgagcctaattattactgccttctgacttgggctgtttcttagcttgttagaaagggaagacttggatctccctgtagcttctctgtcccttagggtggtgattttctggctatcaggattgtagttcaaaaaaaaacaaccttatcccacaataaatagctattcatttggagcagagcccctgaaaatttaggggttagaaagtagtcttgattggggtacaaaccaacatcatgtacacggttttttccaagatatacttgcccggatctcatccgaggtataactcagaatctcttattagtaggatctgagcatggatagtttgaaaaacttcccccaaatgattctaatgtgaaccctgactgggaaccactgggttagagtatatgaagagctgttagtggccatttagataatcttaggtttagagagacctgtgttaatttattgtcatcacatagcctaagtgaacagtggaatgtgaaaggcagtttattaataatcaccttaaaaggtgtggaaccgaagtcttgtctcctctcttttatttggatctctctgcctgtgtgtacatgctccctcttcatctcgacttggttgtggagaggtggtatgtgtgtttcttccgtgagtttttatatgctggcaccttcatttccctctaactgctccaccttccttttccccccttcctctgcgtacttctctcttctttttttatgtgtcttcctccccatgtctgtgtgtatgagagagagaaagataatggcagagctggaatggaatacatcaatcatctaattccctcagtttatagatttggaaattaaggcccaagaattcaggtgacttgaccaaattcacatgactaaaaagtggcagagcaaggaacagaagccactactttttccactttactactctgtcctgttatctgcacatttgtgtgtgtgtatatgtgtggatatgtgtctaccccctcctctgtaatatgaaatacaaatagagggtttttttgctatgtgtagaataaaactgttctctattgtgtttgaagtgtttgtgggccttgatttttattgtactctctatggtcagtagcctagtaacagaaatggtttttatgcattcattctgtcactcagcaaatatttattgagcacctactatgtaccaaacatagatctaggtacgggggatactgcagtgtgaacagaacaaagccccttcccccatgggcttacattctagttgggaagacagataacaaacaaataactacataatgcgcttacataattttactggtagttctatgatgcaagacattgcaagtaagggttggaagaacatttctggataatattttgctcctttctctctgctggtacttgaacttattaccctaatactaggtttataccatttttattagtagattcgataaagccaattagatctgaggcaagagaaaatacaaattttatcttcaaacctttaaaaaaattttaaattaatatattaacttataaatatatatattcgttcatctataaaagatatatgtattaagaacttcaagccaggcatggtgacatgcacctgtagtgccagcactctggaggctggggcaggaagaccatttaagtctaggaacttgaggctgtggtgcattctgatcgcacctgtgactagccactgcactccagcctgggcagcatattagactcccatctttaaaaaaaaaaaaaaagccagggtagaatcctgtagtcccagctactctggaggctaaggcaggaggatcagtagagcccaggagttggaggcccgcctacacaagatagtgagaccacatcttaaactaaaaggaaccttgcttcctctcctatgcttgtctcccctgtggccctctaggtcctgtagataatcacttttattagatttttcatgttactttctggaaaacatgaatatatattatttttcccctttcactgttctataccttttttttttttaacttaacaacatgtccttaattcatacttttaaattagattttaaaattaactctagtccacttagttagaaacttgtgggcaaaaggcttattattactagggtgattatataatttatcatctaaaggagaacatgaaagaaagtgctgttactttacttggaggcaaaaacataaactgggactatcttagggaaaccaagatgtatggtcacttttgctagtacttgtctgcctagaacaagcacacctagaaacttaaaatggccgttattgagtggttagatcacaattacagtacctcagattaaagcttcaaaaagattatactcaattccgaattgtgctgctataaactcatgtgaccaaacaccacctgttccccaataacctatggaaataaaaaattttaaaaaaaaagattatactcataggtgtttcagacccataatagctcgttaatgttcagactggtctctggaaacttgtctctggtttcagtattgataatgaacagaacagtgataatattctagcagtctatacaaatctgtactaatgtttcatctatccattgtctttgggaaatgagttaatgcatgtaagtgaatgttccagataatagaactattctaccaagttttttaacttttttaataaaaaattataaaaagtatttgatatttcctttcttgaacaggatacaaaaaaatagtttaatcagttttgactactcaaggtcatcattgaatagattcattattgtctataccgtaatataaaacatagttatctcctgtttggtttctggtctccttcactgtcaggccgtcacctggctcttcatattactgaagtggtatctgctcctaacagttatttatccgtatttcttttatgttttgctgcttctaatctgctgggtaagcaggtaacaagtttgttaacaatatgtgtttattaagagagtacctaagctctgggtgaatgcctgagtgtgaacataatgcttgtatagggacattctaacagttagatttggtactcaagaggtcttttccttgggttctggtagtcttgcaaagggttgaactcattgaagatcttaagtaccagtaagtatgatatcactgtacttggttttttcactccagtcagtcatattttttggtctacatttagcagaaagcatctgccatatgttctctatggaaagctataaacagcaaatgttgggctaatagcagtctttttcctggaggccttcccattgcctttctgcctctctgacattatgaacatctctgcctcacttgtgggatagggccctttgggacaaactacctgtatctgattgaactagggtagggggtggccctgtgaatgtaacttccccagtggaccagcatacattttctctagactctgttggctttcatttgtatttccagtgagcactagtttccagggtgttctcagttttcactgtgcttatttggctgaattttgattaattcagtggtatccagttgtgctgtgtaatatttgttgatgatgctggaggtgttgtaagcaagtatgtcgaacttgctagttgatctctggctaaaccctgccttctgctattgctaacagtagaaaatgatcttcagagtcattgatttgctttttttactcatatctgtatagagatcataatttgtcacattattactgaattcaggttacctatacattaaaaatgccaaaaatctctcttttctctttgtacacataggtcccagtcatgcagggaacaggaatgcaaggagcaagtatacagggtggaagccagcctggcggctttagtcccgggcagaaccaagtcactccacaggatcatgagaaggtaagcaacactgtctgactgcctccttatgcacaattctagcctttttgattcctcttttcacagttaccatgtgacgatcctgggtcttcaaagtccctttggaggtgatgtttattctaacttagaactcttttatgatcttgttacctgaaaatttgtgagtctggtcctgaagttcctaatggatgtgaagttcttaagtggatgtaaatggcagcttattttatatttcacactcatctgccaatagcaggtttttcttgttcaggccagattgacctgaaaatccacaccctttttccttccctttctactttatccctaaaaacaatagtagattccccatgattatatctttctgtttttatatttgaccattgtggggagcttatgtctgatggaaaggctaaaatttgtgaaaaagagagactttcaaaacaggattaaaacttgaaggatttccagggctcacagataccatcttagtctccaggaactttgagttcatgaagttgtctgttttgaatcgtctaatcttaggtattttaatttatacttgttcttttcattgtaccttttctcaccagtttttttttattttttattttttttggaggggggctgttggtttttttctgtgtgaaatgttcttcctttttccattttgcttcatatcccactacagtagctttttggacagaagctggtggtgggttttttgttttgttttgtattttttagctgccatcattaaaactcactaccttttttttttcctctgcacaggctgctttgattatgcaggttctacaactgactgcagaccagattgccatgttgcctcctgagcaaaggcagagtatcctgattttaaaggaacaaatacagaaatccactggagcaccttgataggtgagcaaacttaatccccatctgagtaggactagctccttgtctattctgggtatatacttttaaccttaaccaacaagattgttctctcagcggccctcaatccactcagctagactcttctttacccttcagtaggtcagctcctgtagggatagagtaaggctatacaatgtttgttcagttgttgaattgcttataatctttcctaatgacaaaggtaatgtatgatcagtttaacaaaagtaatcatatacagaaatgtagaaggtgaaaggtaaaaagccctgtttcctcaatctcattccccagacaaaacctctaaatatagtttggtgtgtatccttctacaatcaattgtattattttattccaaactgtcctgtcaaaatggaaaaatacaaagcatttcaataaaatgtgtaaatattttgtttcttgtatttattttatagggaatattttgatgttgaactatagtagcacataatttaaggtagtaaatgtccgtcatcaccatcagtttctatatattttggagatcgctgtaccccgctacccttatttttcttgctcatcatttaggcagaaagaatccaggggccaagcacagtggctgagccctgtaatctcagctttggcaggctgaggtggaaggattacttgagaccaggagttcaagaccagcctaagcaacatagtgagaccccatctttacaaaaattttttaaaaaattagccaggcatggtgagatgcgcctatagttccagctacttgtgaggccgaggtgggaggactggttgagtccaggaggtcagggctgcagtaagccatgattatgccactgcactctagcctgggtcacagagtgagactctgtgtcaaaaaaaaaaaaaaaaaaggatccaggtaacctgcttcataaataatcatgtgacaacttgattacacatacatgtatcagtgtttcttttttaaaaaaaatttccccagcattttgtattttataaacagttcttttttctaaaaacagtttaaaattcatgttgccccactatcaggtaggacagcacaatttaaatttctactttttaccccatccatattataattcctattcttatgttatataatagtgaactcatttaactattaataattaccactcttacaaaatatatcattttaatccatacttgtgatgtctttaaacatttaaactgcgactatgcatcatatatgtatttagaccttaaatgaattaatgagaagctatcatagatagaaggctcagtagacttttggtaccttaacgttttattccacaaaccccacatattctttttttttagtaaaagtatagactacctattacattcagaggaataaataaaaattatttcttttactaatttacttaagccagagaaggcattccctacaatgtgagaaaattactccttactgtttctggatagtagaggtagaaatgtttctgaaatttctttcattatagttttgcttataggatgtttaatttaaggccttgcatattaaccacaaggcaaagtttttgtctatttttttaccttttatttttaaataatcatagactcaaggaaagttggaaaaatagtacaaggagtctcatgtacccttcacccagtgtagtgcaaaaccaagaaattgacattggcacattactgttaacttgactgcaaactcagttttcaccattttaaaaaaactatcatgatttgtgtatatgtatgtgtggttctatgcaattttatgtgggcaagattttattgtgtgtctactggtgtttgtgcataccatggctaaagtgttgggttttcctccatcctatacctagctagttgtgatccatctctgccatcatggacaggcttctatactgttgtcattagagatgaatggttctcaaacaagggcagttttgccccctaggtgacattgtcttgagacgtttttggtcatcacaactttagggagtatggcatgctactggcattcagtgggtagaggccagagatactgctaaacatcccataatgcacaggatggtccccctcacccacttcccaatagcaactagtactccagcccaaaatgtcagtagtgctgaggttgagaaaccctgctgcaagggctgattgctttgaggagtcaggaggcaggagacagatactttgcaaatctgtcctggtgatttgattatatgcctgtcctccctcccctagcctttttattttttttcctgaagtttttccggaagagagctttgtcttcacttctaatggctttgtcctaacttcttcttacaggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgcaaattgatacacatgacctttttgcttttaaaaagcttaacactaagggtgaaaccttagatgtgttttctacccttactgcagtattgtactttaacatattgccatagttttgtttttaagttaaccacttattcttcttgatgatatttgagaatttctcagaagcaatgttttctggaacttggtttttgtttagtttgcttccagtaagaattattataaggctttgccctctgaaaatattctagcacttcggagtcttctaggagaaaatatcacatgcttagagctataaaatggtcagaaggctaacagagcaaagagcctagcacagctgtgtgtttagtttagaaaaatccaaatatcaaaatgcatttgtttcaatagcaggtctgaacatgtataattcagagttaagacaaaaattgttttagcactggtttgagtgtgtcagcaacacaagagactgttgacatttacttgtgtgttcttaaacttatcagtctaggcagtcaactttgaaagtttaaaaagccactgatttttcacatgctcaagatgaaataaaaacagaaatcaaatgaacaaaatacatttcatcctatcttccaggcagtccctaacctgcagccctaccctgtaactacgtttattctgggaacttacaacacagaaaaccctaaaacttgtacattcttctcattttaagtggaccaaatgtagagcacagtcagattgctcattaggtctgctcctgcctgcttccttgcggataggtatgaacataattagtgccattagctctaatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattcttggaattctatcccctgggttaggattatggtcaggtgaattaaaagcctggcataggcttagagaatgtaatagcatattgcttacatgtcaagcaaaagaatgcaaagataatcaactttttgagtgacaatgaaattgagggattttctactcatataaacatttataagaaatttgttgattaaggtatttcatattacaactttgcaagaaaaacttgctcaaagcaggtgaggagctttctgtgtatcctgctcatccccagttcaacttggatgttggctatgcataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccag

SEQ ID NO: 13101 - DNA, 44947 bp, Human; identical to SEQ ID NO: 12018
  misc_feature (1)...(44947): n = A,T,C or G

SEQ ID NO: 13102 - DNA, 67181 bp, Human
cgacatctggggtcagcctaggcaaaataatcactataattgatcatgttaaattcaagaaccgagacacgaattgtcccgttatacgcaaaatgacgaatgtgaacattcttatattcttagcacagtgggaacgccagccaatcagctgactccagcagcaacggcccactcgctgctctcctcacaggcccaggtgggtggggcaagccgctctccgtaattggttctacgccagcgtcgtcgcgcgcgccacctcccgccaccgagcctcccgccacctctagccaatcaggcttcagctgagtgcgttgctccgcccagccgcccctctgggtctgcgcggaagcgcatgcgtggggtggagtcagcttctttgaattccggaggcggcattcggtggtcagaggcctgtgcggctgcaggtagagtgtcttaggtgaggaggtacttttaagcaccgcgcgaaatgggggcgaagagaatttttttacttttgagggtgggactatcctgcaaggtgtgactgcggtcgggttttccgtagccagtttcgcaccagggatccttgggaagcgctgggatggttcaactgggtggggtcagaagctgctcccctgcccttctttcctaggaacctaggaaataactcggaacctgtaacgtcccactggtttggacatattcctctcctgatctggcctcatctgttccagggaggtgggattgagtaagtgtcattccgactattcctttagtttttcctatttgcagccaaaaacttagaagtcatttttggttcctcttcccttttccctacatccaattcttttatcacggcctactttgtctaactccaaaacattgcacgaatccaatcattttccacctctacaccctaggcctagtgcaggctacagtcaaacctcttctggacttctgcgacagccttttatttggtttcttgccgctccttgacctctaacattctcgtctctgcactgcagctaacatgatcgtcaaacacaaatcaggtggtattgctcccctctctaacctttcccccttcccctatgttttcccatgacatttaaaatccaaactccttactctggcctgcaaatcccaatatgaacttagtccctggctacgttctgacttcatcgctcattaccttttacctctttcattccactccctccagactgatgttactactgtttcttttcttttctcttttctttctttctttctgtctctgtctgtctctctctctctccctccctccctttctttctttctttcctttctttcttctttcttttgacagagttgggccaggcgtggtggctcacgcctgtaatcccagcactttgggaggctgaggcaggtgtggatcacttgaggtcaggagttcgagaccagcctggctaacatggtgaaacccagtctctactaaaatacaacaaatagccgggtatggtggtgtgcgcctgtaattccacctacttgggaggctgagacaggagaattgcttgaacccgggaggcggaggttgtggtgagccgagatagagattgcgccactgcactccagcctgggtgacagagtgagactgtctcaaaaaaaaaaaaaaaagaaacaatgtctcactatgttgccctcagcttcccaaagtgctgggattataggtgtgacccaccttgcccagccaagctgctgtttctttaacacataaagctctttttgctttaaggtcttagtcttagcatgtcttcctcttctctctccatgaaatactcttccaccagatcttcacagggctggttccttcttggcattcaaatctcagtttaaaggtcacctcagagaggttttctctgaacacttattacaaagttacaatgtagcttcccatctccacttcatttctatcacatcactgtgtattatattcattattgtttacttttcttccttttttttttttttttttttagacaaagtcttgctctgtcacccaggctggagtgcagtggcgcaatcacggctctctgcagcctcgacccccggggctcaagctattctcctgcctcaccctcctgagtagataggactacaggcacgtgcggctatgcctagctaattttttaaatcttaagtagagacattgtctcactgtgttgcccagactggtcttgaactcctaggttgaagggatcttccagcctctgcctcccgaagtgctgtattacaggtgtgaactaccatgtccagtcttagttgtatacttatttattgactctcacctcccccttcagtgtaagtgtcatgagagcagagatcttgattgttttattattttatccctggtaactagacttgtgcttggcaaatagatgacatttagtaattatttattaagtgaataaatgggaatatttgtctcctgaaaatgcttagtctggccaccagtttggcttttgaactgtgcagctttaacttagcactgacaaatttaggagcataaagattaaaagcaaaatcaaggagaagtggggaaaataggagtggagaaagtaagattgagttattgagatggattagtttttttgtttgttgtttgagacagggtctcactgtgtcacccaggctggagtgcagtagtgcaatctctgctcactgcagccttcacctcctgggttcaagtgattctcctgcctcagcctcccgagtagctgggattacaggtgtgtgccaccatgcccaactagtttttgtattttttagcagagacggggtttcctcatattggccaggctggtctcaaactcctgtacgcctgacctcaagtcaggcccacctcggcctcccagagtgctgggattacaggtgtgagccaccacgcccggccgagatggattagttttggacccacttatatgacatagccattctaagagagaacttgcatatgttgcctgtactcttactggttttttccactagaaagctagttcagctgatgaatgttaccttgtcaggttgtttctatttctatttagggcaaggactttctgagaaagtcaacctctagactttgtttcctggattgttgtcaacttatttattgtatgcctgttgtatgctagctattgtatactaaatactggaaacacaccctgtctctgtggagaaaaaaggactgtttggctgattaatgataacttaacacttgtttctgtgtagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtaaaggtggattgttttccttatgaaactcctatttctgtaaaaatattctagtctttttttcttaagaatttttaaaggaaagcataattttgctcattcatgcttttgtttatttaatagacattgagcaattactatatatcagtatgctaggcactagggacacaacaacaaaacttactagcagagtggttcccaaacggctgcatattgggatcacttgagaatctttttttctttttttttttcctccctctctacccctttggctctgagaatctttaacaaacaaactgatgtcaggcatctactcttagactttctgattttattggtatgggatgcaacctggcatagggattttttttaaaggcttcctaggtggttccaatgtatggtaaagtttgggaaccactgtcctaatattgaaacaggttgtagtctaagttcagtgcttttagtttagaataggaatgtcagggcataatccagctttcctcactgaagttgctatcgctgttaaatattctttagttaaaaacatctttgaacagtttttgggaagacacttcttacataaactcctttatttatttttggagacggggtcttgctctgttgcccaggctggagtgcagtggcatgatcattgtacgtttaaccttttgggcacaagtgatcctcccatctcagcctcctgaggagctgggaccacaggtgcgtgccagcatgcccagctagtttttaatttttttgtagagatggagtcttgtcatgttgcccaggctggtctcaaactcctggcctcaagtgatcctcttactttggcctcccaaaatgctggaattacagatgtgggtcaccacgcctggttattaagctattcctttaaagagttccaaattcttattattgaggccgaagactgaaataattttaaaggtctcactatttaatattgtttcttttttcaggtcccattaaagcttcacagaataaagataaaaccttggaaaaacacttgaaaactgtggaaaatgtggcttggaagaatgggttagcttcagaagaaattgatattctattaaatattgcactcagtggcaaatttggtatgttgaggaaatgctttttttttcttttaactcacctagcacctatatttttttcttttaaaaataaatcttatatatatatacacacacacacacacacacatatatatatatacttttttttataatagagacagcatctcactatattgcccaggttggtctcgaactcctagactcaagtgatcctcccgccttggcctctcaaagtgctgggattataggcttgagccaccgcacctggctcgagggggatgttgttttgttttttgttttttgttttgagatggagtcttgctctgtcacccaggctgtagtgcagtggcaccatctcagctcactgctacctctgcctctcgggttcaagcaattctcctgcctcagcctcctgagtagctgggactacaggtgcgtgccaccacacctggctaattttttgtattttttttttttttttagtagggacgggtttttgctgtgttagccaagatggtctccatctcctgacctcgtgatccgcctgcctcggcctcccaaagtgctgggattacaggtgtgagccaccgtgcctggccgaggggatttttttttcttttgggagactgggtctcactccatcgcccaggctggagtgcagtggcgcaatctcagctcactgcaacctccactttccgggttcaagcagttctctgcctcagcctcccgagtagctgggattacaggtgcctgccaccacgcccggctaatgtttttgtatttttagtagagacagggtttcaccatcttgggcagactggtcttgaactcctgacctcgtgatccacccgcctcggcctcccaaagtgctgggattacaggtgtgagccactgcgcccagcctgggatgcttttgtcatcactttgctgttagtttttccttttagactttgtttatttatttttttgagactgagttttgcacttgttgcccaggctggagtgcagtggtgcaatcttggctcactgcaacctctgcctcccaggttcaagcgattctcctgcctcagcctcctgagtagctgggattacaggcatgcgccaccacgcctgactagttttgtatttttagtggagatggggtttctccatgttggtcgggttggtctcgaactcccgacctcaggtgatccgcccacctcggccttccaaagtgctgggattacaggcgtgacccactgtgtccgaccttccttttagactttgaattacattgttcattggaattagttgcagttttttatgtttactgttctcttcataagaccaatctgttaagattataaaatgggtttttttgtgtgtgtgtttgggccaaaagtttctgtgtgcatatgccaaaaataaccagttaccatatatcatcacagataaaatgcaaaatacatacttttgtcaccaaatacatgagaaccattttttagtatttatcttaagaagcatacgtagtaatttaaacaatgttgctggaaggcatcttaaaagatcacttagtctacttcattaccttcattttctttctttctttctttttttttttttgagatgagtttcactctttcacccaggctggaatgcaatggcatgatctcggctcactgcaacctctgcctcctgggttcaagcgattctcctgcctcagctttctgagtagttgggcttatcggcatgtgccaccacacccagctaatttttgtatttttagtagagacggggtttcgccatgttggccaggctggtctcaaacttctgacctcaggtgatccacccgccttggcctccctaagtgctaggattacaggcgtgagccagtgtgcccagctaagatgctttttcttttgtgcaaatatcttttcctgttctaaattcattggtggtggttgggatggttggaagaggttcttagaaataacacctggtcaatattttatttacttgaaccttttaagtttttctcatttaaattcagacttggaagatattttagactctaaacactctcatttaaaggtgaggaaaaagaggctcagagtagttaaagagacttgcttaaagatgtccaaactcccattctagtgcttatactgtaccacattgctgctttttttcctacttaaaaaaaagttaaggctgggtatagtggctcatgcctataatcccagcactttgaggggccaaggcaggatgattgcttgaagccagatttgagaccagcctgggcaacaaagcgaaaccttgtctacaaaatgttaaaaaaaaattagctaggtgcagtggcatgtgcctgtagtcccagctacttgggagtctgaggcaagagaatcacttgagcccaggagtttgagctatgatggtgccactgtactccagtgtgggccacagagcaagaccctgtctctgggaaaaaaaaaaaaaaagaaaaattaagacagctctcaaaaccaaatgctttatatactaagtatttcctggctgttgcatgttagattcctttgtttataccctagcagcatacttgcaggggtgtgtgtgtatttattttaaagtaacaacacattactaaccgaattcaacatatgactgtcaagtattttatttctctatttttatctgattagttctctgtttccctagaaagttaaattagacctaataaaattggcttttttcttgtagatggttttagattatttggttctaatatctttccaggaatccatgtttaactgaacaatgtctgtcaagatcaattctcccactcccatctcaccttaaaacatatatggagtaggggccgggtgcagtggctcacgcctgtaaccccaacactttgggaggccgaggtgggcggatcacgagatcaggagatcgagaccatcctggctaacatggtgaaaccccgtctctcctaaaaatacaaaaaattagccgggcgtggtgtcgggcgcctgtagtcgcagctacttgggaggctgaggcaggagaatggcgtgaacccaggaggcggagcttgcagtgagccgaggtcatgccactgcactcaagcctgggtgaagagcgagactccatctcaaaaaaacaaaacaaaaaaacaacatgtatggagtatacagatgttttctattttagaaatttttttttcgtgacagagtctcgctgtgttgtccagactgcagtgcagtggtatgatcatggttcactgcagccttgaccttctggactcaagcaatcctcccatctcagactcccaagtagatgggactacaggtgcgtgccactgcacccagcctccttttgatatctcagaaattaatgattaggttatcttgatgtctgctaggacttgaggtgtctcaaaatgcatgcctcagactcgggaaacttttatatagcaagttaaaaaataatctctggctttctattgttacttttcattttttttttctgttaagctggaatttgctgaggtcaaatgtggcctccttaattccttttctcccttttattatagttatttctgtgatgtccccatccctactagatctttacatgcagctcttttggtaagttgagatgcatatttagaggcaggtatggtagaaatgtcatcataattaggtacaaagggactttagactctttaaaaattaagtcacttggaagtaaaaatagaattaatattgaattctccctttgaatttggtgcacatgtaatgtgttggtggtgagactattttaaatttcgaagagttagtggatgggagtgagaaagaaaacaagaaaaacaagaaaccacaagagtggaaagcagagatttttatttttgtgattcattacctatcatcactgcttcctttcttctccacagaatgatagtgtagaaagtgatgagatatattctaattcttgaagccttaattaacagaaattgagataggatatattcaaagccagtctctatgacatcttttttttttttttttgagatggagttttgctcttgtcacccaggctggagtgcaatggtgtgatctcagctaactgcaacctccgcctcccgggttcaagcgattctcctgcctcagcctcctgagtagctgggattacaggtgcccgccaccatgcccagctaagttttgtatttttagtagagatggggtttcaccacgttggccaggctggtctcgaactcctgacctcaggtgatctctgtgacatcatttctattaccagatgggagaacaccatagaggcctgagatcaagtggaaagattggactagtgtagaatggtattactgccagccaattccaagaatatcttgttctaggccagtcacagtggctcatgcctgtaatcccagcactttgggaggccaaggtgggcagatcccttgagcccaggatgtgagaccagcctgggcaacatagtgagaccttgtctttgctaaaaataaaaaacttaaccaggtatggtggcacgtgcctgtagtcccagctactctggaggctgaggtgggaggattgcttgagcccaggaatttgaggttgttatgagctatgattgcaccactgcactccagcctgggtgacagagtcagaccctgtctcaaaaaaaaaaaaaaaaaaaaagaatatctgttctcttctgctactctccccacttttttggggtgagtggatggtacaaatatatatatttttaattttatatttatgtttttatttctggttcacattctctcatgaacaaatacattcttaaatgtaacacctcatgcaaagtgtccgtcagtagctttaaataaatcagtctattaggccattaaaaaaaaatctttgaaatttccctgtgattgaaagcttttttggaggtataatttacataccataaaattcattttttttcttttcttttttttgtgagatggagtttcactcttattgcccaggctggagtgcaatggtgtgatcttggctcactgcagcctctgcctcctgggttcaagcgattctcctgcctcagcctcccgagtagctgggattacaggctcccaccaccacacccagctaatttttgtatttttagtagagatggggtttcaccatgttggccatgctggtcttgaactcctgacctcagatgatctgcctgcttcggccttccaaaatgctgggattacagttgtgagccaccgtgccctcataaaattcattgttttatttttttatttttgagatggagtttcactcttgtagcccagggtgcagtgcaatggcatgatcttggctcactgcaacctctgcctcccgggttccagtgattctcctgcctcagcctcccgagtggctgggattacaggcgcctaccacaacacttggctaatttttttttttttttttttgagacggagttttgctcttgtcacctgggctggattacaggcgtgagccaccacacctggcctaattttgtattttttttattagagatggggtttcatcaccttggccaggctggtcttgaactcctgacctcaggtgatctgcctgcctcagcctcccaaagtgctagaattacaggcgtgagctactgtgcccggcaaaattcattgttttaaaaattcagcatttttgtttttggagacaaagtctcactctgtcacccaggctggagtctagtggtgtgatctcagttcactgcaacctccaccttccaggctcaagcgatcctcccacgtcagcctcccaagtaactgggactataggcatgtgctaccacatctggctaatttttatattttttgtagagattggggtctcactatattgcctaggctaatctcaaactcctaggctcaagcagtcctccggcctcagcctcccaggaggcaccaccatgcccagctaatctttttttttttcccatagagacggggtcctgctatgttgcccaggctggtctcaaactcctgggctcaagtgatccatctgcttcagcatcccaaagtgcttagattataggcatgtgtcaccacgctcggccccaaattcagcatttttttaaagcatagtcacagagttgtgtaatcatcaccactatctaattcttgaacattttcatcaccccaagaagaaaccctgtactcatttatattttttaaatagaaatatttggaccaaataatttgccttatagttttttttttttttgagagagggtctcactctgtcacccaggctggagtgcagtggcacgatcacagctcactgcagcctcaacctccctgggctcaggtgtttcccccacatcagcctcccgagttgctgtgactacaggcttgccccaccacccttggctaatttttgtatttttagtagataacggggttttgtcatgttgcccaggctagtcttgacctcctgggctcaagtgatccgcttgcctcggcctcccaaagtgttaggattataggcatgagccactgtgcctaactattgccttattgtatattagtagttaaaggtacatttttgttttgaacaatttattaataatgataagagatactgaattttacatactgttggtttttattgccttcaatataacgtgaggtgtggtgtttttttttttttttttttttttgagatggagttttggtcttgttgtccaggctggagtgcatggcgtgatcttggctcaccgcaacctctgcctcctgggttcaagcgattctcctgcctcagcctcccgagtagctgggattacaggcatgctccaccacgcccagctaatttttatatttttagtagagatagggtttctccatgttggtcgggctggtcttgaactcccaacttcaggtgatctgcccaccatggcctcccaaagtgctgggattacaggcatgagctgccgcgcccagcctaatgtgagatttttagatccaagagtgaataatagtaaaagaacaatcgagacactaaaatgtagtttaatttagcttgtctcctttccaggaaatgctgtaaacacacggatattgaagtgcatgatcccagcaacagtaatatcagaagattctgtggttaaggcagtctcctggctttgtgttggcaagtgttctggtagcaccaaggtaatctttttaaacactttgatgataagtccttcagaaccacttaagggctggcaaggaagagccacttatgaagtaatggcattggccttttgtgcaaagcctgtagttttggaacaatatatcttgatgcaaggactatgttcaaacagaaatttttactgagaaataaaatctattattctactttgtgcctgaagcttctaaaatagccctggtggcgggggacggggggcggaattaaactcttctgtaccagttatatttctttaaagataagtattttgtctcttcaataggtacttttttatcgttggctggttgcaatgtttgacttcattgatcgtaaggagcaaattaacttgctctatggcttcttttttgcttcattgcaagatgatgcactggtaagtaaaaattggacagcattaggcatcaatcaaatagtacatgtgtgtatattgatgcaccatatatgcttcagtgtgctacacaatatgtttttccttattttaaaaatatatcaaacatatagaaatgtaccaagataacgtagacatatcaaatatacagaaaagggcaaataataacattctattttgcacctgtctctcagattaacaaatagaaaatttttatcgtatttactttatgtcttcttttaaggaaataaaaatgttacagataaagttgattccacgttggagtcttgtttgctgatctggagcactcattgccatcttttcccttttaaaccacttcaacagagtcctttgagtcatttactctacattttcttgattaacactgcaaaagcctcatcagaattaatgagaaggagaggattacttttcatgagtgccaatggagtgattttgattaaatagcataattatttctcttaaaaacattaataactttaagaaatcaatctactgtccacctggaagactttcaaggaccatcagtagttcacagaccatgtgaatcactcatctaactgtattgctcttgcctttgggaagggaattcatttattgattttattttttaaaaatgatgtttccagtgtgttcattgcattgtcctagccactgtagaagattcaaagtttagcatagggtttctatattccacgaacttgaaatctcattggggaattaaggaaatcacataaattatcaaaaacagtatatgatagtttgaggataataattgctgtaatatttccaggaaggaagaaagcactgtaaatcaaaatgattagttaaaacaccataaagtatgtgggtgttgagctgggccttacaggttgaataggatttgggatttgatgacagaaagtgatacttgatatgatgggaatatttcaagcaaagttgtgaggtgtgtaaattgtgttttaggagaccttaaatagaccagcctgacctaattagaggtggtgttaggtggtaagcctgaaaaagttgggtgaggacagattgtagaggtcttccaatgtgatgctaaggaattggaactttattcagtggggaaatcactgaaaatttttggctagaatatgttgaaagcagctttgtaggaagctatatctagtagttcccaacaatgtgaattaagagagaggctgaaggcaggaatactagttaggaagctgacatgataatctaggtataacatgatgtcctagacaagaaattctcaaatatggtctgtggaccccctggggcttcctgagaccctttcaggaagtccaagaggtcaaaattattttcataataataccaaggtattatttgccattttcactttgttcaccttagcgttgatggtgctaaagcaatggtgggtaaaactgctggccatttaacaggaatcaaggcagtggcaccaaactatactagcatattcttcattatgttcttcattgtggtaaaaaaaaaaatgctaatttcacttaatgtcaaatgaagcagtaaaaattaactcattagttttattaaatctctacatctttaatattctgtatgatgaaatggcaagtacaaacaaagtcctcctgcatgctaaagtacagtggttattctgaggaaaagcatttgtgtgattgagttgcgagccaaactagctccatttttatttgaaagaatgactgatggccaagcgcggtggctcacacctgtaatcccagcattttgggaggccgaggcaggtggatcacaaggtcaagagattgagaccatcctggccaacatggtgaaaccccgtctctgctaaaaatacaaaaattagctgggcatggtggcacatgcctgtagtcccagctactcgggaggctgaggcaggagaatcacttgaacccagtaggcagaggttgcagtgagccaagattgtgccactgcactccggcctggcgacagagtgagactctgtctcaaaaaaaaagaatgactgacgtacgaaccgtagttatacagacttgggtacttggaagatgttttcttgaaaatgaacaaaacagtcctgttatttcaaagaaaacaactggccgtatctgttgccagtgatagaatttgagcattcaagtgaaaaatcaaagtttggaaaatttgtatctgccactatgaacctgacagcttttagatacctgaaagacttttctaataattggtgatggtattaatgttgtgatttttagttatcatataatgaaatgtgtcagcatttggaagctcagtataactcagtgagccaatattttccagatgaacaagtacgatgttctaaattcatacatggataaaagatccatttaaaatacaagatacatcaatgaattttaatggaacagagtacagagcttttattgagagtgtttcagattccacattgcagctaacccttaagaaagtaccacttgtcaagttttggtgtagtatcaaaaactaatatccacaattttctgaaaaggcttttaaaatattcctaccttttccaactatgtatctgtgtgaggctggattttcttcatgcaattcaatcaaaacataacagaattaatatagaagcacagattccaactgtgttctcttaagccagagacattaaaaagatttgtagaaatgggctgtgagttggaggcagcagtgagcctcaggtgatccacccgcctcgggttcccaacgtgctgggattacaggtgtgagctaccacactggccaaggggtcctctaattttttttttttttgggacggagtctcactctgttgccgtgcccggctgagaattagtttatttaccttggtgtagtgattattgatatagtagaaataaattcagatatcttattttgagatattctaaataagctttttttttttctaagtgttctctatcctcctttttttggattgaccgtagtttctttcctattcttgtttggaagtcacctaagtgttttcgtacctacttaacatgcatactttaagtctaaaagtgactggcatctgtacctttatcttataggatacaaaaaccttaggatgctttaactctttttttctttttcttttttttctcttcttgtcatatggtgctgaagaatgctttaactctcatcatactgctcctggcttatatgctgttgttgtctggttttagttttaccttgtttttctccatccctttacacacacacacacacacacacacacacacacacacacacagagtagattttttttttttttgagatggagtttcactcttgttgcccaggctggagtacaatggtgtgatcttggcttaccgcagcctctgtctcctgggttcaagcctcagcctcccaagtagctgggattacaggtatgtgctaccacgcccagctaattttttgtatttttagtagagacagggtttctccaggttggtcaggctggcctcaaactcaggtgatccgcctgcctcggcctcccaaagtgctgggattagaggcatgagccaccacgcctggccgatactatttttacagttgataattgtttagatttcccacatatctcccagtatctttgctcatcatttgtttttgcatctcacaccttcaagatgagattattttcctttggctaaaagtgtattttttattctttcattgaaaatcttttgatggcaaactctttgtctgaaaatgtctctactttgcccttgttctcaaaaactggtattagtgtatgtagaattctagagtgacagttaaattttttcgggatattgacaatattattccactggctccttgcttccatcatgttattgaatcagtctaattgtaatcctttttttcttttctctctggctgcttttaaaaaacagctttaggccaggagtggtggctcacctctgtaatcccagcacttcgggaggccgaggggggcagatcacctgaggtcaggagtttgagaacagcctggccaacatggcgaaaccccatctctactaaaaatacaaaaattagccaggcatggtgacaggcacctctaatcctagctacctgggaggctgaggcaggagaatcacttgaactggagaggcggagattgcagtgagccaagattgcgccactgcactttccagcctgggtgacgagcgagactctgtctcaaaaaacaaacaaaccaaccaacaaacaaacacagctttattgagatttaattcacataccatacaattcacccatttaaagtattcaatttgctgattttaagtatagtcacagatatgtacaaccatttcagcatagtcaattttagaacattttcatcacctcaaaaagaaaaaaagaaaccccacaccctttgctatcactcccatctctctattacccccctagctctaagcaacccctaatctaattttctgtctttataggtttgcctattttggacattttatataaatgaactcatgtaataatgtggtcttttatgacttgcctcttagcaaaatgttttcaagtttcatctgtgttatagcatgtattagtactttttttttccccctgagacagagtttcactcttgttgcccaggctggagtgcagtggtgcaatctcggctcaatgcaacctccgcctcccaggtccaagcgattctcctgcctcagcctcctgagtagctgggattacagtcatgtgccaccacgcctggctaatttttggtattgttagtagagacagggtttctccatgttggtcaggctggtcttgaactcctgacctcaggtgattcgcctgcctcggcctcccaaagtgctggggttacaggcatgagccactacgcctggtgtattagtacataaaaaaattttttttttaatttattttttgagacagagtttcactcttgtcacccaggctggagtgcaatgacgcgatctcagctcactgcaacgtccacctcccgggttcaagtgattctcctgcctcagcctcccgagtagctgtgattacaggcctgcaccaccacgcctggctaatttttgtatttttagtagagatggggtttcgccatgttggccaggctggtctcaaatctctgacctcaggtaatccgccctccttggcctcccaaagtgttagtattacaggcttgagccaccgagcccggccatttatttttttcattatttctattttttttttttaaatttgagatggggtctcactcttgtgcaggctggagtgcagtggcactatcatggctcactgcagcctcgattgatcagcctgggtaacgagcgagactctgtctcaaaaaaaaagaacaaagacaaacacagctttattgaaatttatttcgcatatcatacaatgagtcatccacttcatccttcagagtagctgggactacaggcatgtgctaccatgcctggctaatttttaaagtttttctagaggcagagtctcactatgttgcccaggctggccttgattttctggccttaagcaatcctcttgcctcggcctcccaaagtgctggaattatagatgtgaggcactgtgcctgactctcaccattttaaaacatttttttggtgtataattcattgacatgaattacattcacagtgtcatgcaagcatcaccactatctatttacaaaactttttcattaccctaaactgaaattttctaaccattacgcagtaactccctattccctctttcccctgctcctggtagcctctaatctactatctgtctctatgaatttgcctattctaggtacctcatataagtggattcatacagtatttatccttttgtgtctggcttctttcacttaacataatgtcttcaaggttcatccatttgtaccatgtatcggaacttcattcctttttatgggtgaataatattctacttcatatatatgcagtcagccctctgtgtctgagggttctgcatccatggattcatccaattattgattgaaaatattaaaagatacatataacaataaaaaataatacaaataaaaaatatagtgtaataactatttacatagcatttgcattatgttaagtattataactaatccggagacgatttaaagcaagcttgtccaacccacagcccaggattgctctgaatgaggcccaacgcaaattcataagctttcttaaaacattatgagatttttggggggttttttttttaagctcatcagctatcgttagtgtattttatgtgtggctcaagacaattcttcttccaatgtggcccggataacaaaagactgggcaccccctgattaaagtatacaggaggatgtgcatagattatatgcaagtactacacaattttatataaggaacctgagaatccgcagagtttgatatggtggcggggaagggaagtcctggaaccaatcccctgctgataacaagggatgactatatctaattttgtttatccattcatctgatgttggacatttgagttgttctcactttttggctattgtgaatggtgctgtgttgagtattggtatataaatatctgttcaggttcctgctttttcagttcctttgagtgtatacctaggaaaaaaattactgtatcatatggcaattctatgttcagctttttgaggaatcgccaaactcttttccacagtggctgtaccatttttcattcctgccagcagtctataacagggttcaaatttcatcacatcctcaccaatactggctattttatctgacttgattatagccatgctagtaggtgtgaagtggtctttcattgtggttttgatttgcatttccctgataactaatgatattgagcaacttttcatgtgcttattggccatttgtataccctccctggagaaatgtctcttaggatcctttgccctcttttaaattgggttgttcattatcctatagggttgtaagagttctttctgtattctagatacaagtccctagatacaagatatatgatttacctgagagttacaaagttagagccactttaagttactctctttaggttttccaggccatcccactagtgtaaattcaaactgcagacatatatatataattttttttttgacagagttttttgctcttgttgcccaggctggagtgcgatggcgcgatcttggctcatcgcaacctctgcctcctgggtttaagcgattctcctgcctcagcctcccaagtagctgggattacaggcatgcaccaccatgcctggctaattttgtatttttagtagagacggggtttctccatgttggtcaggctggtctcaaactcttgacctcaggtaatctgcctgctctcccaaagtgttgggattacaggcatgagccaccgcgcctggccaaactgcagacgttttttgagctggcttctggttacaaattcttgggaaaggttttattttcctttcacccatttccaaggtcaggacaagcaagttttcttgctgtcctgttcaacacagtggagttttaatttcacaaccatacacttagtgtgtagctcttggggattccagttttttattataatagatcctctgcataatctacacattgggtgggtcctaagctttatcccctgcctaacctatccctgcctccctttgtagctattaaagtcgtaagttcaaagtttctaaggtttggcaaaaaatcttggtgagaaagcttgttcaatatttagtgtttctactttcactttgtttttgggaactgcagattcttgctttcatgccagctctgaaacatgcttcaacagctggatatgatgtcaaaaacattgctgagctggcaggaaagcggtcagggtcattcagagtatctaatacacaatatttctatagatggttatcaggtcattggaattgaggtcagtaaactgtaagaccacggtgatttgttgatatggacattaaagtcatctggcatgatattgggattagagttagagctgaaaactgagtgagatgcccaaatcctcacggaattttggggaaggtactaggttagtagtgagctgacagggtataggtaaggtagaggtagtaaagttgggtgaactaagtctcagaggaggtctttttctatacaacggtgaaagagtggtaaccttggaagtgtcgatagaaagtaaggatgcaggatgctcatccctgttccatgtcctgtggtgcacaggtgtggttgaatgacaagtggtatgtcattgtctctctcttacctttgacatctctcttaacctcatattgtttctgttcataaactgaccaaattgcaatacaaatgaattctgtgtttaaacatactttgtaaagaataggaaataagaagagacgctttctgctttcttctaacagctcaatagactgagttcttccagtcagggactgagccttttataacccaagtacttattaaagttcttgccattgaaatggcaaaaactgcaattacttttgcaccaacctaaatatttgccagaaaggcaattgtaaaatgattaaaatatatgagtttttcctttctagatgtgattaaaagagaatgtcagatttcctataataatggagtctagggcaagtgattgtgtaacactcatttcatattcaacatgatagtattgctagtagttcatatccttaagcatatgacataacacattttttatactgaaaattgctattctctgtgtagtatatggcagatgtggtcataacatgtattctttcttttaaaaaaagattccggccaggtgtggtggcgcacacctgtaatcccagcactttgggaggccaaggtggtcagatcacctgaggtcaggagttcgagaccaccctgaacaacatggagaaaccctgtctctactaaaagtacaaaattagccgggtgtggtggtgcatgcctgtaatctcagctacttgggaggctgaggtaggagaatcgcttgaacccgggaggcggaggttgcagtgagccgagatcatgccattgtgctccagcctgggcaacaagagtgaaactccgtctcaaaaaataaaataaaaattccatatctaaattcatgcttcttaaaagtatgtttagattctttctcaaaccatttctaagtacagaagaggcagtatggaatatgctgtagtttagactttaaagtttagagtcatgactacaaaaatacaaatttgtttaaagaaagtctttgctcttgttgctttctctagtactattaaatattttttcactttcctattatttagagaaggtattggcaaactttttcttaaagggataggtagtaaatattctgagcatgaaggccatattgtctctgtcacaactattcaactctgctggtgtggtgtgcaagcagctgtagacaataaataaatgaatgatgtggctgtgtcccaataaaactttatttacaaaaacaggtagaccatagtttcctgacccctgatctagagtaagacctcaacagatggacactgaaaatgaaatggtagaagggaatcagtcatacaataatttaattagcaaattgagtgcatactgtttgccaaactgaagactaagctgttaactaaattcttgtatatatactgactggaatatgaagcatcattgaaaatgataattttgaagactaaacaacatgggaaaatggttttaaataggaaatcaggataaaagtttcaagtttatgtcttaataagtatgggccaggtgcagtggctcatgcctgtaatcctagtactttaggaggctgagtcaggaggatcacttgaggccaggagttagagaccagcctgggcaacatagtgagaccttgtctccaccaactaacaatacacatacataaaaatattgaaaggaataacaaaaattcatgcattcctttcaatatttgtatgaatttagtaactaaatacatacatgcaaatattgaaaggaatacattaatttttgttaggtaggaggatgataggtaattctgtttttcaaattgtctgcaatacctttacattccaaaaataactaaaaaatgacctaatgaaatgctgattaaaactattgtttttttatcactatacagtaggaaaaagagactctttgtaaaactattgttcagtgaagtcctgaaggttttttacttaatcagcgtaagattgacatttgaggaaaatgtgttgcccctctgttcaagacatattatcatttctcttaatatttttttatgttttaacagtgcccttatgtttgccatttgttatatttacttaccaaaaaagagaatggtgagtattttcattacagttgtattatactttgtagaattagcatttgtattggcctttataaagttaaaataactattagcattagttatatgacagaagtcattttgtggaaattgctttttagtactttaagagcatctgcttaatggcttaactgaacaggtatttatttccttgatatgttacaagaagaaactgtatgaattgcatggtggttaaatataaccaatttctttttattctgaatccaaatgcatagtacgtctttcctttatgttttctagtcaaaccatttcgtgtgagaaaactgcttgatcttcaggccaaaatggtgagtactgaaaagacctaagacctgccaatgtactatgtgccaggtactgagccaggcattgggaatacaaaatcaaataactcttgatctttttttttttttttttgagacagggtctcactctgttgcccagactggagtgcagtggcatgatcttggctcactgcaacctccgcctcccaggttcaagcgattctcctgccttaccctcccgagtagctgggattataggcacgcgtcaccacacccggctaacttttgtgttttttggtagagacagggtttcaccatgttggccaggctggtctggaactcctggcctcggtgatccacccgcctcggcctcccaaggttctgggattacaggcgtaagccaccgcgcctggcctatcactcattatctttaaggaacttattttctggggagctcagtgaacaaaatgaaaaatcagaatcagacttggggtcaaggagaagtggtgatgcttgagagaattatttattttatttttattttatagatggagtttcactcttttcgcccaggctggagtgcagtggggtgtaatctcagctcactgcaacctccgcctcctgggttcaagcaattctcctgcctaagcctcctgagtaactgggattacaggcgcccaccaccatgcctggctaattttttgtatttttagtagagacggggtttcatgttggccaggctggtctcgaactcttgacctcaggtgatctgcctgcctcggcctcccaaagtgcagggattacaggcatgaaccactgcacccggcctgcttgagagaatttttaagggatgaataggatttaagtaggcaaagaagggagagaagggcattcctcccagagggaacagcatgagcaaagacatggagatgtcaaacagcaaacattgtttagggagctgggttggtatggctggaacagtaagtgttagggagtggtcataaatgaatttatattttgtacggatgtgatctaggaaagcttttttttttttttttttgagatggagtttacctctgttgcctaggctggagtgcagtggtgcgatctcagctcactgcaacctctgtctcccgggttcaagcgattctcctgcctcagcctcccgagtagctggaactacaggcgcgcaccaccacgccaggctaattttttatatttttagtagagatggtggtctcatcatgttggccaggctggtctcgaactcctgacctcaggttatccatctgccttggcctcccaaagtgctgggattacaggtgtgagccgctgagtctggcctaggaaagcattttaagacattatcttctggatgcttaaacttcagtatattctctgactgttatctctggtccttacagctctctgcattgttatttccactttacctgccaggtaacagaagtctgtgaagctctggatatgaaacaatggaagtaatagtggtcatgtctaactggagctttcatggcctacctataggcatttattgaatgaaagacacaaacacagaacacatttgtgcttctccaatgtgaggtctcctcttagtgcagttcaatgattattctttttttgtagccttctgttttagttccatgggtacgattattttttcttagttctctgaagatattaatggtaatatttttgtccaatttgaattttatttcacattaatagaaattatgaaaaaaatgtaccttttcccatgttacagcaaaacatttcaatggaataagacaattcttaccataataaaagatcttagtacccaggtgcagtggctcacacctgtaatcccagcactttgggaggccgaggcgggcagatcacgaggtcaggagttcgagaccatcttggccaacatggtgaaaccccgtctctactaaaaatacaaaaaatagctgggcgtgatggtgggcacctgcaatcccagctacttgggaggctgaggcaggagaattgtttgaaaccgggaggcggaggttgcagtgagctgagatcacgccagcctgggcgacagggcaagactccgtctccaaaaaaacaaacaaacaaacaaacaaacaaaagatcttgctgatttgttttgtattagctgaaacacagtgtatgttcaagtaaaaaatgatttatgagatgattgtctaaaaatttataacggagacactaaatgtctggtttcattactaccactctatacagtacatcactaaattattccattgtcagtaagtacccatttataaagatgcatacataacattgttttgattagctgaattttgatgaatttgggtaagtccaacaatatcaaaccaagaaggcatagctatgttcatatgtaacctaacatgcatgatagtaacaggcatagtcaacatatgtgaggaaatacattggatgtgcgaatttctgatacctgcaaaggcatatatcccgtctatccccctccatgccccatagctcccaatctatgaaggaaacaaaaccacaaaaattgtatttctggtagcagacatgaatagtaggaagtggggcattttcctacatacactaggccctgtccagagcaatctttagaacaagaagggggaattaggtctcatcctaagggttggttctccctctaccgggcatgagcctgtgtgtatgcactttgggctgtgatttttttctgtttcaagctttgtctctgtttcctcatagtttctgtttttagattgtttggtcttttatgatactttttaaatttaaattttattttaattttttttagagacgggggtctcactttgtcacccaggctggagtgcagtggcatgatcatggctcactgccaccgtgaattcctgggctcaagcgatcctccctcctcagcctctggagtagctgggactacaggcatgcaccaccaggcctggctgatttttaaattttttgtagagacagggtctctctatgtcacccatgctggtctcaaactcttgggctcaagcaatcctcccgccttggcctcccaaagtgctgggattacaggtgtgagccactgctcaccaatgcttggtaaagcttatttgttcatatttaaaagtaaaacactaacatgatgattggaaacttgtgtgtatgagcaggacttgttcattgtaggatcttgatgttttgttgaggatcctcccagatgactatgttaatattctcaaaacagaattctcctgtttcctgtcttatgtggttgcacggttgtacatatagaatcaagtgtgtgtgtgtgtgtgtgtgtgtgtgtgtgtgtgtgtgtgtgtgtatttataatattatagggaattggctcatttgatttttttatggtggctggtaagtccaaaatctaccggatgggccagcaggctggagacccaggagggccaatgttccagtttgagttaagtggcagtctactatagaaccaggaagaactgctgttgcaaataaagtctgaaggcagtctgttggacattttcttcttcttctgggacctcttctattcaggctgtcaactgattggatgagacctatccacattgcggagggcagtcaatttgctttattcaaagtctactgatttaaatgttaaacatatctaaaaaaccctcacagaaacacccaaaataatgtttctccaaatatctgggcagcctgtggaccagccaaatcaacacttaaaattaaccatctgatatggtttggctgtgtctccacccaaatctcatcttgaattataattcccataatccccacatgtcgtgggagggacccaatgggaggtagttgaatcatgggggcggtttcccccatgctattcttgtgatagtgagtgagttctcacgagatctgatggttttataaggggcttccccttcgcccagctctaattcttttccttcctgccatcgtgtgaagaaggatgtgtttgcttccccttccgccatgtttgtaagtttcctgaggccaccctagccacgtggaactgtgagtcagttaaacctctttcctttataaatgacccagtcttgggcagttctttatagcagtgttagagtgggctaatacatcatcacagggtgtaaacctggctactggcactctgagacctgagcactagaaaggggtgagaaatggtcttggtatcctcccttggctgtgcctggtatccgagtccagcttcattttcagagtaaagccctaatgttttgccagtatagtgaaggaatttggggttctaactgcttcttatgtagcctttcatgcaatactcctgttttcttgtcccttttgcatccccactttttagagatatgtggtccctcaactcttgatcctttctgggagttgtcaagcatgaatctgatttttttgaggctttttctgttgataccttagatttcattttatctattctgctaacttggttactatttgaccatcttcattctaggttccaaaatcttatttagatttctcatatgctgttatctcctctcttgttctctttgaacttgtgctttgctttatcctttttcattcttcttttatttatttattggagatggagtctcactccatcacctaggctggagtacagtgatgcgatctcagctcactgctacctctgcctcccaggttcaagccattctcctgcctcagcttcccgagtagctgggactacaggtgtgcaccatcacagccggcctaatttttgtatttttagtagagatggggtttcaccatgttggccaggctggtctcaaacttctgacctcaagtgatacacccacttcggccttccaaagtgctgggattacaggcatgagctaccgtgcccagccacctttttcattcttttactgtcttttaaatggggctttgggagaacccagaattaatcatatgttcgatatgccatttttaactggaaatctcccccttaccttttttagtattaactttttaacaaaaaagatagttttaattaactagactataagttctaaaggcctcagcacaactaagtattctctaaaaagcattctagctcaaaacaaacactctgatactcattaataatgggtgtacagaggttaggagatattttcaacatagataaactgggtcattttggttttgttttaataaatttaatttcaagaagctgttataaaatggaaatattgtatttctaagcctcatttgctgcctttgtgcagtattcgattcaataaaattttagtataataaaacaatttggttacttccttagaattcattttagtggtgtgttttctctggatagccagatgtataaaacaggtatctagcagtaatcacatctttcgttgtgaaattagtgcttttgttaagacttgtttcagttatatcaaagctgcttgattatggcataccaattgtaatttcctagataattttccaagaattataataatcaggtattagcttctcttctggtcctgtctccttgaggtctaaatcaaggatgagtaaactttgagtcctgagtatgctaccagtgagaataagctatgctatgctagtaagtatgactggtcagcctaaggtataggaagagaagagaaaaatacaaggaagaagtaaagttggaaaaggtcctaagagagaagatcacagtttggagagggttgttttatggtggttgacttaaatgtctggttactcattccttgatttttgatagcatcttcctatagctatatctcagcgaaattatggtctgaatatacttttttccttcttattggtatttgtttcctcagtttcttaatagccacagaattgaaaatggaaaacttattttatttcagggaatgcagcctcatctccaggctttgttgtcactgtataagttctttgctcctgctctgatttcagtatctttgcctgtaaggaagaaggtaagggattaaggagagagaaatcatattaagattgaaatatgttatttttggtaaagttaacttacagatttcaactaaaatgtttacagcctactgttttactgtctagtattgtggtactgttttgggaaagtttttttttaggaattggtacttcgtgttgatcccatttggtatatttaatagattactaatcagaaaaaaaaatactttaagtgcatttgtatgggtgtaaaggatttcataatatattttcaattaatgaggcattttagactttatgttgcttcagtttatgggtacctactctcttgtactttatatccaaatttatagatatattttaagaattcagagaatctatggaagacggctctgcttgccgtgaagcaaagaaaccggggaccttctccagaacctctgaagttgatgttaggtccagctaatgttcgtcctctaaaaagagtaagtatctaaagctcaaacaacttgcatggctttcttttattaaatccaaataataaccattcagatcttagaggagattatagatatttaagtatatgtcagttacccaggattctgtgtaagccatattcagattcctttaattgaaacaccttaccagttgcttttatatttgtggtttgtagtctgtttagtccattgatagattattttattatctttcttcagaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagaggtatgtgactggaccatgtgcttctttgcattttctatttgaatttcatggcctttgtttttttgtttgtttgtttgttttgtttttttgagatagggtcttacctgtcacccaggcagtggtgtgatcatggctcactgctgccttgaactcctgggcttatgtgatcctcccacctcaaccttctaagtagctgggactacagatgtgcatcaccacgcctggctaatttttaaaacaatttatatcaggctgggcacggtggctcatgccggtaatcccagcactttgggaggccgaggtgggcggatcacttgaggtcaggagttcaagaccagcctggccaaaatggtgaaactccatctctattaaaaaatacaaaaattgggctgggcgcggtggctcacacttgtaatcccagcactttaggatgctgaggcgggcagatcacctgaggttgggagttcgggaccagcctgaccaacatggagaaaccccacctctactaaaaatctaaatttagctgggcgtggtggcacatgcctgtaatcccagccatttgggaggctaagcaggagaattgcttgaacctgggaggcggaggttgcagtgagccgagatcgcgccattgcactccagcctgggcaacaagagcgaaactctgtctcaaaataaaaaaaaaattaaccgggcttggtggtgcatgcctgtggttccagctactcaagaggctgaggcacgagaatcgcttgaacctgggaggcagaggttgcactgagctgagatggagcaactgctctccagcctgggtgacagagcgagactccatctcaaaacaaaacaaaaaaaaattattttaaaaatatattgctcagtctggcctcaaactcctaggctcaagtgatcctcctgcctcagcctcccaaagtgttgggattataggcatgagccaccatgcccagcctatttttgttatatattttctatatgacgattcccttatccacttttcagatacttaactgttgatcggttgttctgtcattgcagctgccttctcagatgggctcagtgctaaacaactctctgctgcttcactacattaactgtgtcagagatgagccagtcttgctgaggttttattactggttgagtcaaacattacaagaaggtaagaattgagtgaggatggaccaagatagttaacaaatgggtttcttttataagggtgccaaattctagacagcaggagccttcatatgctgtaattatgtctgtggtaatcttatatttagagcatgaatgtttctgttgtaattttaaggcagtaagaaggtagagggattttgttaaggaaacactgctagatggccaccaaaactcactgggtggctccactttgatgactatcacaatccaaggattcttcatctttgtatgttcagaaacttgctgttagggccccagaatcatcctgttaatggtaacgaaactcagaagagacaaatgtacaagccagaatgtcagcttattataaaattaattatttctggtaagcgaaatgctcatatctgccaactagagtatcccctctgctatcagcatatatgggagccaaatttgtcattagaagatttcttaattatagaattaaaggaaagggcagtgagaagtctttcatccaagccatagtaaagcctgagcatttcattcctccaatggtgggggtcggtggggaggggcgggtatatttctctagagataatatttcttttgaccaaatttgagtgtttctttactggatactggataagcaactcctgattcttctggtggttaaagttgcttttagttggttccaggccaattcttcttcttcttctctgaatcttttaaacagaatatgatatagtttattagatttccatgtactaaatttgtatcactcttacattatacccagcatactctaattgaagtttagggtattctaaaactttcaattcagatgtttgtactttcttggattgctatgtgatataaagcttatcatattcattatatgtgaattctctccatttctataagcttttccctatatttacactataagcttttccctatattaccaagttgttgaggaatatctcactatcatctccatgtgactgttccagtctacatcatgagttagctaggatgtatgagacttatggcttttttactttgtcacttgtcactttagtgataattatgttttgtgcacttttttattgtggtacaactagatgcttatatttactgtttctgctctagaatgtatttggtacaaggtgaataattatgaacatggaaaagaatttaccaacttcctggataccatcatcagggcagagtgcttcttacaagtaagatttcacttgcttcttccactctccaccactctttactaaaatttatttagatatccattgaaaaccttttcttgcccggctgcggtggctcacacctgtaatctcagcactttggaggccaaggcgggtggatcacttgagcccaggagttcaagaccagcttgggcaacacagcaaaaccccatctctacaaagaatacaaaaattagccaggcatggtggcatgcatctgtagtcccagctactcaggaggatgaggtaggaggatcacttgagctcaggaggtcaaggctgcagtgagccgtaattgtgccactgcactgcagcctgggttacagagtgagatcctgtctcaaaaacaacaacaacaaaaaacccttttttttagtacctgacatcttttgtaaataatatttgttcagtttgaagctcattatagataaagctgagttttatctttgcactgttagatttgaagaaagaatatgttatattatgcaaataaaagggaaaagcctgtaatttaagagaacaaactgaagatgtaattaaatgtattcagttaactgaattagccagtaatgtaaatttcatagggtcactacttatattcttacaatcaacaaacattttttgagcatcagatatgttccagccaatggactatttggtttgggtaaccctgagttgtattttaagctgcagcttgggtatcagcaccatcaagaagccttcacttattgcccagtgtgggttagctccttgttctatgtgctcccatggctccctgtgcttacctctatcgtgacatttttagcatccacacattacgagctcccagcaggcagaaaccatgtctaacttttcttcatgtatagatgttcagcttgattgataaatgtttgtggaataattctttgtttttttttagacaaggtcttgctctgttgcccaggctggagtgtactggcacaatcatggcttactgcagccttgacctcctgggctcaattgatcctccctgctcagtctagttagtagctaggactacaggtgtgcaccaccactcctggctatttttttgtttgtgtgtttgttttttgtatttttttgtaaaaacggggatttaccacgttgcccaggctggtctcaaactcctgggcttaagcattccttctgccttggcttcccaaagtgctgagattataggtgtgagccatcacacccagcccaagttttagggatttggtgtgaaaccatttaattggaagctgggtgcagagatggtagtgaggatagcaatttaggttgacgtttatgtttcctacttgggaagatggatggcattcactgagaaaagaaatataggaggagcagtcttggaaggaaagatgtttcacttaagagatgcctaatgggacatcaaagcggtcatatccagtacgcagtaaaataatgagtctagagctcaggaatgagatttgagctagagatacagatttaggacccctcatgttaaaagtggttttagctatgatatggatgagattgtccagagaattcatgtcatgaaaagaaggtcttaggatagagtcctggtgcatgtcactgtgaaaagcttaggtgacaatggaaaaaagggaagtcccagatcctcactctggtggaaatataagcaacctagacatttgagcctctaaagatggagctgctcagagttgggatttggtctatggcctctaatgaaattctagccctattacataatattgtatacattttattgactgttcaaattactgcatgtaccccaagataataaatcttatttttttaaaaatattctataacttttaactttctttccaattgatgaagttttatggtatttgagaactgtattgataaaaatggtaatgtatgcaaatactaatcatctcatcctttttctgaggaagtctggcacctaacttaaggcttttattatattcatgacaaaaaattagtctaagagtgaagcaactatagcacaaaataaactggttgtttagagcataattttatgactgaagagttccatataaggatttactattcacttgtgttacaggaggggttttattcctgtgaagcattcctgtataagagccttcctctctgggatggcctttgttgtcggtcacagttccttcagcttgtgagctggattccttttagtagcttctctggtatgtatcatgaaaatttggagtcatttgattcaacgtactatgattgaaaggattttgaataatcttttttttgattcctagaggtgaaaccacttctttttgaccatctagcgcagctcttctttacatcaaccatttatttcaaggtaacaaaaacttgtcttgcttagattcaataggatgtattattctattgctagtggtacacaattccaaactgatattacagcaatggttttataacaggattttcttggacctgggctttgaggtactgcatcactcaactcaaagttaatgcatagaatgttccttttttaaggctgtgttgcatacagttttcctgacctgtttccacttgtagcaaatgacatagtgaacgaacaagtggcagatgcatattaataaaaacaaacaaactgagaaatacttagtttgattgttgtggtttatatttttgtagatacatttattcatttcacaaatattttttgagcacctactaaatacccttcttgacactgggaatatagtagtgaccaaagcaaacaaaactccctgtgacattcatattttatatttatagtaatagtcgttttctgctagtaaaattgttccaaccttatatataatatgttactattttggagtggtctccaagaagaccaatatggcttccagaagttctacctgaatgagtttgagagccactttcttatagaatggttattcctattctagaagaggggcaattaagtaatttttcttttataacttttttttttaaccttaaatcacttactgttggccacattgacaggaaacatgttgtcctggttagcgtttgtcgtaattgaatggcacttgattaattacctatcatattaacttggatttgaggtctatttatgctaattgtaacttttacatcctgaccaatatcatcattcacatgacatccacaccaattctcccagctaataagttttcagagacttcagtttgaatttttttttttttttttttttgcaattctgtctcaatcttctaattgggttattctttgtttcttctcttattcttccacgctaaagagctgtttaaacattaggctggaccataggaaattgctattttttgtacgtcagagatggttaatgattggcagttggctgtggttcaacctaatatgcatatacacattcagacacgtatatttgagaatgagaggggtggggagaggaaggaaggaaggaagggaacagacagcaagctaaaaacagaactcgggaatgcacagtatttaattctcaggccaagaaggaggacagtctaaaggaatcttaagaaattgccagaagtataaaaacaaccaggagaataatagttccaaggaaacaaagggaatataggatatcaataaagaatgaaggaatgatgttgccaagtatcccaggaaggttcagaaggatacggacaagaaacgtttcttttagaattgacaatacagaggttttggcttcctttgtgagtagttccagtggaacaacttctagttgttaaggtggaatatggaaatatattcaggggaggtagaagtcagattgtgtgggttgaggagtgagtgaaaagtcaagtcaagacaatgagtatagaatatgtttcaaaatgtttgaccaataaaaagttgtagagagagctgtagggggactggcaaccaggggaagttgtttgtttgtttgttttgcctctaaaatgagagaaacgtgagtgtgtttatagatggagtcgaaggagccagtggagaagagggagaagttgaaaatggagaaaagattgggaataattgatggtacaagattccagaagaaatatgaaggtattgggttaaaactaggtagtgagatttacttgaatgggtggttaggaattgggaggcaccatttatcctctaagactggggagaggatgcatggataggtggatatatagatttatttgtaaagttagaagaaagggcaagacattaaaatactttgtgcctaagaatgttaaatttctcaaaataagaagcatgatttagagaatagaattaagtaggacactccaggagggtgttagctgcttaggacagccagggagaaaaaaagagctggttaaagacaagtaaaaggattattgagcgtcattaagggcccagcagaagttggcaatcatcaatttggaatgatgccaatctttgcagttgtgttttcttccacttagatgttggagaagagaaagcaaattatgagattgaatcagtttgggttttgctggttgaatggagtacaagaaagttgtgatcagctgtgtggtctagtctagataggaaaataaggccaggagaaggctgataaacctgaaaaaggaggttaaaaattaaggaattggctgggtgcggtggctcatgcctgtaatcccagcactttgggaggctgaggtgggcggatcacttgagatcaggagttcgagaccagcctaggcaacgtggtgaaaccccatctctactaaaaatacaaaaattagccgggcgtgcccataattccaactactcaggaggctgaggcaggagaatcgcttgaacccgggaggtggaggttgcagtgagccgaggttgcaccactgcactccagtctgggcaacagaacaagattccatctcaaaaaaaaaaaatttacaaaatttaaaaaaggaattaagggattgaatgtctctgatgttgaaaaacgagtagctatagttggagttgagtctgtgaaaaagctggaataggaagttataacaaagaaaaaaataatagattttggtgtggttcagttcaggttatgacagaatctagtgtgtggctgtgggagtgggtaactaaggtggagtgaaggtgaaggttatttgattcaaagtcaaggaactgtgaagctgaaatgttgggataatttgcatggacactggtgtaactgaggtattgatggcaggacatgatgcagagttctaaggtcctcaatgaatctggataagattccaagtgatagcagagatatgagaagataaaaaaatagagggtagtatagctggatagtatgaacaaaggagaaagggttttttacacaaggaaagaggaataatggtttggaaatagggttgaagataccttttgtgttgtgttcagaaaagcaagggatagtcagactcatgagaaaaactgactgtagcaaaatgcaatcaaatatttagcctaacaaattcagcttttagcagtagcttgactaatgaggttctttctgtagctcacaaattatttgtaaacaatcttaaggcaatttttttccatggcacttgattaaatagaagatccatttgatttttgtatattatggttttttttttcttagatggagtctcgctctgtcgcccaggctggagtgcagtggcgtgatcttggcttactgcaacctccgcctagcgggttcaagcgattctcttgactcagcctccccagtagctgggataacaggcgcccaccaccacactcggctaatgttttgtattttttagtagagacggggtttcaccatgttggccaggctggtcacgaactcctgacctcaggtgatccacctgccttggcctaccagagtgctgggattataggcatgagccactgtgcccgacctgtatattatcttttaaattaaatctgattcccttcttaaagtaggatttatttctgattttatatttaccttctcaaagaaggggcttatattctgttccacattagcagtgggaagcttagtataggacactgcttacttctagttgttaaggcgggatagatatggaaatgtattcagaggaaacagtgtcctggtttggtggtgaaggagagctaggatatgattaaggtaagaagacagagaaagcatactttgtagaatatgaaggtgtatgtttaggttaccacagaacagaggttctggatactgcagttgagagatttggaaaggataggatcaatgaaagaggacaagaagcatagagacaaggaagaataagtgactaaaggggcttacatattgggaggtgactaaggataacaggaatgtgaaatatggtagaattagctaaacgttagtttctgaggcctgtagtaactagttattgccttgttattgtatagcttgattacccagcttagtctaataaatgaatagtatttttaaagtctattaaaatattttcacattttcagtgcgttttgtttgggcctggtcagttatgcctatcagcaaacaacttattttcaccgaagaattttgcatgggaaaggccccacaaatccacactaatgttgttatatttgttttagagtgttaatttttcaatatctgtccttattgatttatcattttccatagagttgcaaacatagtggacataaaaaatcagaatacgtaattaacattgcataataattttcatgtttccacatagtcgacataatgttgttaatagtggcactgtagtccttagtaccataatttatttaataatttattattatttctctctctttttttagagacaggatcttgttctgttgcccaggctggagcgcagtggcatggtcatagctcactgtaaccttgaactcctggtctcaagggattctcccacctcagcctcccaagtagctgagactacaggcatgtgccaccaaacctggctaatttttaaagtttttgtagagacaaggtctcactatgttgcccaggctggtctcgaacttctggcttcaaatgatcctttcacctcagcctcccaaaatgttgggattacaggcgcgagccactatacctggcctctattatttatttctaatttgtttcttttgtcggaatagataacagtctcgagcatcttcatgatatagatttttttcttaaactcttcccttggcgtacatttataggagtgagattactgggtgaaaagtaaggtgctgttccttggctaatgggatgttcactgcaagttcttggaaagaaggaggatgcagtggatggagtgcttaaataacaagagtctagcagccatgggaaaagaattggggtttgggagatgatactagaataagggagactagctaggaggataaaatgacctcaaaggtatgaaggcctggtcttcacagttacagtgggattgggaaggaaatgaataagtaagacattttgaaggaaaaaacattgatagaatatggtgactgaagataaagtgtaaaggatgcaagatgacttgaagctttccaacttgagatagtaaatgaactagggatattttgcctggaggaaaaaaggctaagattttctggttcccttccaatatttgaaggattgttacatgaaaggagatctctgtgtggcttcaagaaacagaggtagatatagggcagtatctcgtaacaggtagagcagactcatgacggaataaaggactttcagaggtgatatatttcttgacagtggagtaggtcaggcagaggtttaatggctgtctattcaggatatttatgtagaaaaggttcacatgtagggtagagctgtgtttctcaaccttgtttgtttgtgttttttctttttttttttttttttaaagatagagttttgctcttgttgcccaggctggagtgcaatggcaggatctccactcactgcaacctctgcctcccaggttcaagtgattctcctgcctcagcctcccgagtagttgagattacaggtgcccgccaccatgcctggctactttttgtatttttagtagagatggcgtttcaccatgttggccaggctggtctcgaactcctggcctcaagtgatccgcccgcctcggcctcccgaagttctgggattacaagtgtgggtcactgcaactggcccctcatacctttctttaatgtggtgacaggggtagggtaggtggggaattaaagattttttttttttttgatacggagtctcactctgtcgccaggatggagtccagtggcgtgatctcggctcactgcaacctgtgactccctggttcaagcaattctcctgcctcagcctcctgagtagctgggattacagacatgcccagctaatttttgtattttcagtagagatggggtttctccatgttggccaggatagtcttgatctcctgaccttgtgatccacctgcctcagcctcacaaagtgctgggattacaggcgtgagccaccacgcccagccaagatttttttttttcctgagatgggatctcattctgttgctcaggctggtgtgcagtggtgcgatcttggctcactgcaacctctgcttcctgagctcaagtgatcctcccggctcagcctcctgagtagctgggactacaggcacgtgccaccatgcttggctaatttttatatttttagtagaggcagggttttgccatgttgcccaggctggtctcgaactcctggactcaagggatctgcccacctcagcctcccaaagtgctaggattacaggtgtgagccactgtgcatggccaagatttttgttttctactttttttttttttttttttagttttagtagaggcggggtttcaccatgttggccaggcttgtctcgaactcctgacctcaggtgatccacccgcctcggcctcccaaagtgctgggattacagacgtgagccaccgcgcccgaccttttttttttttttttttttttgagacagtgtctcactctgtcggccaggctgtagtgcagtggcatgatcttggctcactgcaaactccgccttccgggctcaagcaattctcctgcctctcagcctcccgagtagctgggattacaggcacgtgccaccacgcctggctaatttttgtatttttagtagagatggggtttcaccatgctggccaggctgatctcgaactcctgacctcaggtaatctgcccttctcggcctcccaaagtgctgggattacaggcatgaaccaccacgcctggccaagatttttgttttctaaatgtaacattgtatatacctaccgtgtacccacaaaaattaaaaataaaatattaaaaaaagataatataacattgtaatgttgaatatcttcaaatgataaaattccttggttgacaccaaagtagactattgtcttagatgattccagagttgctttcaactagaacatacttctaacctgaatgtgagttgtcaaaaagtatattaattgaacttttctctgaagtagcagtgagcactctattactggaaacactcaaatgattagtagaccattatgtagtaagaatttttaagaaaggtttgctgtattagattttgggatggtatggattgctttcaaatttatagatattacggtttatcatcataaatgccctggacgaatttatgtcattattgtatgtttttttttttttgttttttgtttttttttttgagaaagagtctcactctgtcacccaggctggagtgcagtggcacgatcttggctcactgcaagctccttctcctgggttcacgtcattctcctgcctcagcctcccaagtagttgggactacaggcgcccgccaccacgcctggctaattttttttgtatttttagtagagacggggtttcaccgcgttagccaggatggtctcgatctgctgaccttctgatccgcccgcctcggcctcccaaagtgctgggattacaggcgtgagccaccgcacccagcccatcattgtatgtttttgtatgtgattgaggcttgggaaatcaaggcaaggcctgagaaaagaaagactagaattgctttttttttcaaagtcacagaagataagataaatttttatgaccatcaaaaaggtggcaaattgtaattgtagaccacaaggtaaaaagggagagaaattcatatctgtagcaacttcaaaagttctctgaggggggatgataaagatgctgtttttatttgatgatgtaatagttgttataaattgatgtaatttagagaaaggtctgttctaggctgataagttaggcagtcctgttgaggtatgtttcttgtagagaaaatggcaaaataaacttgtacttggcattcgtctgtcttctggagactaatcatggtgtagaagcagctgttgggttcaaaatttgatgtggtcatctccatggtccttttcatctctaagcctctgttagttctgaacactgttatgtctgaatgatttcatgaaatcttttttcattttgtccccctcagtgtagtgtgcttcagagtctgaaagagctattgcagaattggctgttgtggctttctatggacattcacatgaaacctgttacaaacagtcctctgtgagttatctaacggtcttccacaagagacgatctgtatacaaatgtttgcatatgtttaatagtgtggcgtgaaacaatttttttcatgtaaatgcttagtagtacttttttggaagacttttttgtgacttttcactcttcttcccccacaatcctgaaaggaaggctaattctctaagttcctattgtgtaaatcagaaagcaacccttatctgctaaatgacttctttcaagagttaatataacaaaacactagagagatgagactagaatttgcaactttgacttccattcagtttaactcattttataaattatattcttatatttaaagccaattttcatgatggctagaaaaatctctaacgtaattttgcgtacaactttgtttttatgtttctgtgctgtattttggttatatgtgttaatttatcttaactttggagtttaaaataagagccctaaattgttaaatgtgtgctttaccttcaaagtaaaagtaaaagactaaatttcaaggaactgcataatcaggttgttttgactctttctacctaaaatctttgccttctcctacatatatatatatattttttgagacagtcttactctgtcacccaggctggagtgcagtggcacaatattggctcacctcaacctccacctcccagcttcaaatgattcttctgcctcagcctcccaagcagctgggattacaggcatgtgccaccatatccagctaagtagagatggggtttatttagtagagatggggttccaccatgctggccaggatggtctcgatctcttgaccttgtgatctgcccgcctcagctttccaaagtgctgggattacaggtgtgagccactgcgcctggccaagaaccactattataaagaaattccacttaaacatttaatctcttctacctaaattacattaagaatagtacgtttgaaattacctccacctgccccccccttttttattgagacagggtcttgctctgtctcccaggagtacagtgacgcagtctttgctcactgcagcctcgacctcccaggctcaagcaatcctcccacctcagcccctgagtagctctgaccacaagcgtgcaccaccacgcttggctaatttttttatttgttgtagagacaaggtctcactgtgttgtccaggctggtcttcaacttctaggctcaagctatcctcctgccttgaccttccaaaatattgggatcacaggtgtgagccaccacatccagtctgaaattcctctcttttacttgtggttctccctaacctgcattcccttctgtgggctgctgagcctggacccatatttgttcgttctctattccctggatcagcaggagatttaacaaaatagtaggtttgcatctataatatttggccaacttgcagtgtaagtctctgatacccctgaaatagctgccttacaatttctgtattatcttttcaaaaatcttcggattcctcttttattagtgtcataagttaaggcagacaatttaaaaaggaattctgttttctaaaattcttataaaaatggtgatacatgtggataattttgcttgccatatcaatatttggcattatatagtatagctcaagttttaaataattctttttattaagtgtaggtataatgccctatttttatcatgtgaccatatgccatatcactgtcaaaaagggagtaaattgtagttatatatcataaaaagagaagggtagaaaacttctcaacagtggttctcgaagggggccatttctggttgtcacagcgactgggaagaggttgcaaccatcatttagtatgtgggagatggggatgctcaatgtgcttcagtgggtgggaagtaggaggcagtcctgaacagtgaattgtttcatccaaaatgccgatagtgtcttgtggagaaacacttcaaaagaggctgttctgagcaatcgtctttgtttcaaattatttcagacacagttgccaagtgctaccaaaaatcatagttaagatacagttatgcctgtaatcccagcactttgagaggctgaggccagcggatcacttgaggtcaggaattccagaccagcctggccaacatggtgaaaccttgtctctagtaaaaatacaaaagttagctgggtgtggtggtgcacgcctgtaatcccagctactcaggaggctgaggcacgagaattgcttgaacctgggaggagattgcagtgagctgagattgcgccactgtactccagcctgggcgacagagtgagactccatctcaaaaaaaaaaaaaaaaagcatatagttttgcaaatagccagctggctatgtgtagatgctcgcctatttgaatggtctcctgatccttccttgattgccttggcactgaagtatcatggtggtgggcagtagtagagtcatcatcatctctgaaactctaagattatacatgttcttttccttatgcgtaaccattgttgactacctagataggagggcaaagctatgaattcaaatttgtaagtcttttcctaatccatttaacattggattgaaggacaggggtgagtagatggatggattgaactaatacccataggtactgtaagagactccattcattgatccagggagaatataaaatagctagatctgttttttgctagaagaataaaagatgccaaaaattttgctaattcccttttagggttgaattgaattcaagtgaaaaaaaaatatacatatatatattttgagatggagtctcactctgtcgcccaggccaggctgaagtgcgatagcacgatcttggctcattgcaacctccacctcctgggttcaagggattctcctgcctcagcctcccaagtaacggattacaggcgtgcaccaccacacctggctaatttttgtatttttagtagagatggggtttcaccatcttggccaggctggtcttaaactcttgacctcaggtgatccgcctgcctcagcctcccaaagtgctgggattacaggcgtgagccactgcccccagccaaattcaagtgaaaatatgtttaacagcattttagctcaggaattcaggcaaaactgagttttgatttgtgtactgtaggtttccttcaatctgtgttgcaatgttactaacagtataggaaacgattcctgaagtcattttaatgtttattcctttaaatcacttttgatttggttgggataaattagttctcattttttctagtttactgtatcattttgtccgttttcacattttatcctgaatattttctttttcttttttttttttttttttgagacagggtcttgttctgttgctcaggctggagtgcaatggcatgatcttggctcactgcaacctccacctcctgaagcaattctcctgccccagcttcccaagcagctgggattataggcacccaccatcacacctggctaatttttgtatttttagtagagacagggtttcaccatgttggccaggctggtctcgaactcctgacctcaagtgatccgactgccttggcctcccaaagtgctgggattacaggtgtgagccactgcacctcgcctgaattttttttttttttttttgaaacagtcttgctctgtcactcaggctagagtgaggtggtgcactctcgctcactgcaacctttgcctcacaggctcaagtgatcctcccacctcagcgtcttgagtagctggaactataggcatgtgccaccaccgcacttaatttttgtattttttgtaaagacgggcttttgccatgttgcccagaatggtcttaaactcctggattcaagagagcccccgaccttcgcctccctaagtgctggaattacaggtgtgagccactctgcccggccctgaatttttcatgtcacttttatgtgaactttttttctccacttaacttttaatggaatacctattttttaatggtttttatatatctcacttgagaattttcatatctgcttggagcttaatactttatttctctggtatttactagtagagtctgattgcttagaatgttctatgaattcgtcttaatggttccctggagggctaagtgtagttttatgattactcactgtgattttttaaaaagtgaattatacgttggagcactgatagtttttaaaatcctcaccaacattttgctttatattattcagctttagcttggaaattgtgaacactattgctactctatatctgaatgttatggtttcttattgcagagagacaactttgggtggatccatgaactctgtgtctaaactgatccactatgtagggtggctatccactactgcaatgcgcttggagagcaacaatactttcttgctgcactttattttggatttctatgagaaggtagtacacattacattttccccatttggatttatgtgaaggctatccactttattggcttattatttaaatttcatgcacaaccattaaggtgggctatgatcttattagcatcattaaaataacctcacattttgaagttcatgattattttctcaccagaataactgactttcataaacaaagtggaaaaacaattgcttttatttagggccaggtaccactacattgacctgtgttaatactggccctagagagaagtctattgttagcattattttttgttcatcccattcccaactcctggcagaaaccaaaaatatcttgttgtttcttcagatctccatttctacctttcagctgccttacttctcttgctacctagtacgcttttattgttttatagtatatgacctggacagaactataggttggtgcaaaagtaattgcagtttttgccattgaaaacaatagcaaaaactgcagttacttttgcaccaatttaatattatccatgaagtatccattatagtctcacttttcccagcttcctctctttactaatacctagttgtcttgtgttatgcatttgcttagaagcatgctcctttgttttctaggttgacagctaactcacatggtaagtaaatattatgggacttaaggataaagaaatacttccttaatctaccctgtccccctaactttaagacctttccccccaaaaaatgaaagatttgagtaatggccttctggaaataatcctctatagtgtggctgatgtttggtgaagtatattttaagccagcttgtagatgtttatttaggagtcaggcatgtccaaagctaatgttatgttattgcttatcttgtactgatgattctttgggtgaacttagttgaggagttctggggaatactctgtatactgatgttatcattcttcctccaaggtgtgtgacatatatataaattataaccttccattagtggtattgtttcctcctgggatcttctattctgcactcctcagcctggataccagcatcctgaaccagctgtgttttattatgcacaggtacaaagcctttttaccattttatgaaacagtgtattataattctctcttcctctttcagctataatacaataaatattcctactcgtcttctgccagggcctctggaaataggaaatgtggcttgcttttggacatgaccttccgatatggggccatggtagctgtgttttttaaatcctccactgctgtggctacagaataaaaaaaaattcatagttaaggacttgttgtgcaatggtactgttgcactcagcattgttcattctaattgctgtgtcttcaggaaaaattagtcatttggtgataattgcttgaagtgtttgtagcttctctggtaaaaataacattttctgggcgataaggggagctattgccaattatatgaaactgtaagtattatttctggtctcctctaattctttcacttgtggactgaaattactttcttcagtccataagcgtagactttttttttgagatggagttttgctcttatcaccctggagtgcagtgacatgatctcggctcactgcaacctctgcctcccgggttcaagcgattctcccccctcagcctcccgagtagctgggattacaggcgcccgccaccacgcctggctaattttttgtatttttagtagagatggggtttcaccatgttggccaagctggtctcgaactcctgacctcaggtaatccacccacctcggcctcccaaagtgctgggattacaggcgtgagccaccatgctcagcttagtgtagaccttcttggcataacttgtaggactatgtcaaggttaaaatgtttaaaaactaattagttgttaatagttctcagacaagaatttcctgtttatcctttctgctgcaccttttttttacattaggaaaacatgttctatatcagtgactgactgcttttgagcctctgttaattttttttttattattttactttaagttctgggatacatgtgcagaacgtgcaggtttgttacataggtatacatgtgccatggtggtttgctgcacctatcaactcatcatctaggttttaagacctgcatgcattaggtatttgtctcaatgctcttcctccccttgacccccgacccccgacaggccccagtgtgtgatgttctcctccctgtgtccatgtgttctcattgttcaactcccatttatgagtgagaactctattacatttttaatagtgaaacattgaaagcatttttcattgcttattttttatttagtcaactacacatcttaagtgtacaacttattgagcctctattttcacttgaggagaatgtatcacaaaaggataaaatccttaactagacaactggatatttgtgtatatgcacatttgcatatatttacatttaaaatgtatgttttttttaaattttaccatttcaaaggcattatattcaaaggcatgttaaatgtttcattctgtttgttttttctgttagatatcgtaaaaatttgactgccgcaaagaaaaatgagttggtacaaaaggtatgaatgagaaagctctgtgttaaatcactgttgtttaaaaattaagtctagatatatatgacctgatgggagtaagaaggaaagggagaataggtgatagtgacaattttttatttctttcccattagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggtaagggtatttaaagaatttttagattttgtatcttaatactgtggtggcagaaataggaagtgccataaatttaatgtgtctgaattgtaagacgtgtgtttagtaattttttttaagtaacaactaaattttgggcattgtgctaggctcagggattccagttaatttaagtaagtttctgtcctctaagagagcttgagcttgtaacagagacagacttgtaaacaaattactataatacagtgtggcaaaatgagaaaaggttcagttgtaagaaagatgggggagtgattagtccagtcctgcctgggtagaggtggtgccatgtaaggaaacgcttcatagatgtggaagctctcataaaatccttctagacaagatagaatatgtaggttagttaatagtacaattagagtcttagtcaaagactgctgatttaatggattgatatcaatatgcaggcaggtggaggagggtttatgtttgtgtgtgtcctttcaggacttcattctcagccctgtcactttcaacattatgtgtgtgtgacatggagaagaactcaaatggtggtatctgaaatgcatggatgagacaacagggtggaattacaaataccctgaaagaatttggactcaggattcccttaacagacgggaacattgagaaatctaacaaaatgaaaaaaaagtgtgcagggtgggggagatattcattgaataaattttaatatatgtatacaatgaaccaggcactacagtgaataagacactctgagtgttgtcctcagagagcttaacatctagtcagggaggcagtcattaaacagacatcttagaaaaaacaataataagtgatgtaataggggaaagtatagaggatgatgaaaaaatataaaggggcgctaagttcaggatttgcagaaatgatgctgattggaattttgaagcacgaacatgagcttgtcaagataggagcagagtttgaggaaaagtacaaagatgcagagcaaagatagaacagaagtcagcagacttttcttgtagagggccagattgtaaatattttagattttacaggccacgtggtctgtgtcaagagtactcaactttatcattgtagcatgaaagcagctgtagacaaagcataaacagatggctatagttgtattccagtaaaaaatttatttacaaaacaggtgttgagctagagtttgggctttgggccgtggttggctgaactctgtgttagagcctgtcatgtttgaggaacatgaggcagaattgtagggctagagcagtgattctacactggctgagcagcagaattgtcagtggtgcttcttctttttttttttttttttgagatagagtctcgctctgtcgcccaggctagagtgcagtggtgcgatcttggctcactgcaacctctgcctcccaagatcaagcaattctcctgcctcagcctcccgaatagctgggattacaagtgcccaccaccacgcctggctaatttttatatttttagtagagacagggttttgccatgttggccagggtggtcttgaactcctgacctcaggtgatctgcctgcctcggcctcccaaagtgctgagattataggcatgagccaccgcgcccggccagtggtgctttttcaaagtgtacatccttggctgctcccatgctgagactccgatttaataactctagggtgacattcaggacccaccttttaaatagttctgatatacaacaagagttgagagccactgggctagactataacatgataggagatgaggttttgaaatgtagtcaaggactagatgctgaggaaaataatacataagcctctgaaaccatattgattgattagaatatttgaataagaattatattttttaactacgtagaagaatttcagagacattatagtgattttctgatatttcttgtctttttctcttttcttaccttcataataacttgatttatcatacaatatacaataacctgtgtcaaattaataatattaatgttactactaatatgaggctactagatgaaattttaaatgtttgcaggtctttttccccctgcactaaatccttctacaaacgtaaggtgcacatactgtattttacatgcagttaggtacatttgttgtttctgtttgttttcatgttttacagattgccttattattttttttttttaagacaagttgtcattctcactctctgtcccccaggatggagtgcagtgtcgcaatctcggctcactacagccttgaccttgggggctcaagtgatcctcccatctctgcctcccaagtagctgggactacaggcgtgcgccaacgctcctggctagtttttttgtatttgtagggatggagtttcgccatgttgtccaggctggtctcaaactcctgagttcaagcgagatgcctgcctcagtctcccaaagtgctgggattaaaggtgtgcgccactgtgcctggctactttttttttttatttaattttattttgaaatatgtaaaaatttacataattctatactatgaaaatctcacttctgtcctttcctcttccatcttttaccatcttctgccttgagataaccatttctattgctttttgttttttccatccagtgttttcctttctttaaacttagtaagcattgttttataatctgtatttgataattccaatgtctgaagtttttgaatgtctgtttctgttgcctgcttttgtgtgtgtgtgtgtgtgtgcttcttcctcatactgcttagtttctttgtgtgcctggttatctttgacgatgtgctggatacttggaatattattttatagaaataatttgaacactgaaatgatatatttctgcacagaggacttttctttgcttctcactggtacccagtggtgttctttgtctggtactaccctaatccaagttctgtgtctgagattccctgaactataggaggttagactgcaagcttgtgagaggactaatttacttctggttatgtcttatcttgaaggtatagcccattgggtttccaagtttaaagtggggcatgatttataagagttcccaattttggaaaaccctgtgctctgaatttaattaccttagttctttgagaccgtggaagtacagttcactttggtagcaaattcctctggattggcaaattccctcaggccaaaagtgattttgagtattagacttacttctttgggttatcatcttctatattttggccttgtaactccttaccgtagcattagcaccttgttactttaaaaaaaaatctaccttttgttatggaaaatgtcaaacataacaaaggtagaatagtatgatgaagccaggcacggggtggctcacgcctgtaatcgcagcactttgggaggccaaggcgggcagatcacttgaggtcaggagtttgagaccagcctggccaacatggggaaagcccgtctctactaaaagcacaaaaaaattagccgggcgtggtggcacgtgcctgtagtcccagctactcaggaggctgaggcatgagaatcgcttgaacccagcaggcagaggttgcagtgagccgagatggcaccactgcactccagcccaggtgacagagcaagactccatctcaaaaaaagaaaaaaaaaaaaaaaacaagaacaacaaaaaacaaatatacagttcaaaggcttttagtttattcatagagctgtgcatccatcaccatcatcaattttagaacattttcattattcccaaaagaaacatcacaccccttagccatcattccccagggcctcccacctcccagtcttaagcaaacactaatctactttacatatctatgtatttgcctattctagaagtttctttttttttgagatggagtctcgctctgttgtctaggctggagtgcaatggcgcgatcttggctcactgcaacctccgcctcccgggttcaagctattctcctgcctcagcccccgatagctgggattacaggcacgtgccaccatgcctggctaatttttttgtatttttagtagagacggggtttcaccatgttggtcaggctggtctcgaactcctgacctcgtgatccaccagcctcatcctcccaaagtgctgggattacaggcgtgacccacccggcctggcctctagaagtttcaaatcaatgaaatcacacaatatgtggtcttctgtgactggcttctttctttttctttttttgagacagtcttgctctgtcgcctgggctggagtgcagtggtgccatcccggcttactgcaacctctgcctcctgggttcaagcgattctcctgcctcagcctcctgaggcatgtgtcaccatgccccgctaattttttgtatttttagtagagacagggtttcaccatgttggccaggctggttggtctctaactcctgacctcaggtaatctgcttggcctcccatagtgctgggattacaggcatgagccacagtgcccggactggcttctttcacttagcataatgttttcaacattcagctatcttatggcatgtatcagtactttatttgtttttactgataaataatattcctatatatatatatgacacattttattcatttatcaattgatggacatttttgttattttcactttttggtgattatgaataagtattcttataaaaggttttgtgtggacatatgttttcatttctcttgggtatatatacctttggtatatatacttaagagtgggaatactagatcatatggtaactctatgtttaaccactggaagaacttccagactgttttccaaagtagcagcaccatttcacattcccatcagcagtatgtgagggttccattttctccacctctttcctaacactttttatctgtttttttggttctagccatcctggaagtgtgaaatggtatttcattgtggtattgatttgcatttccatggtagctattgatgtttagcatcttttcatgtgcttattgaacatttatatattttctttggagaaatgtctatcagactctgctcattttaaattttttaaaaagtttttatatttcttgttctttttttttttttgagacggtcgttctgtagctcaggatggagggcagtggccagtggcacaatcacaacttactgaagccttgaactccagagctcaattgattctcccacttcagcctcctgagtagctgggactacaagcgcacgccaccactcctgaccgttttttgtagacagggtttcaccaaattgcccaggctggtctggagctcctgggctcaaatggtccatccaggttggcctcccagagtgctggggttacaggtgtgagccaccatgcctggccctttgctcattttttaatgagtttatttgtgattttattatcaagttataatggttctttttatattctagatacaaatcctttatcaaatatgtaatttgcaaaagttttctccaattttgtgggttgtcttcacttttttgttaatgtcttttgatttacaaaggtttttaattttgatgaaatgaaatttcacttttttttcctattgcttatgcttttgttgtcagagcttaagaaatcactgcctaacccaaggttacaaagatttactcctctgttttgtctgagaattttatagttttaactcttatatttgggttttttaaatcaattttatctcttgtatatgttgtgatttaagtatacaacttcatttttgtgtgtgtgagtacacaaatgtacccacaccatttgttgaaaaggctactctttcccattaaaatgtcttggcacccttgtctaaaatcaatggaccatagatgtatggactcttaattctattttatggatctatatgtctatcctcatgccagtaaatgctgtcttgatccgtatagctttgtagtaagctttgaaatcagaaaatgtgagttccccaacttgttcttctttttcaagattgttttggctattgttggttctttgaaattccatatgaattttaggaccagcttattaatttctataaagaatccaggccgggcatggtggctcacacctgtaatcctagcactttgagaggctgagatgggtggatcacctgaggtcaagagttcaggaccagtctggccaacatggtgaaatgttgggcatttctctactaaaaatacaaaagttagccaggcgtggtggcatgcacctgtaatcccagctaccagctactcgagaggctgaggcaggagaatcgcttgaacctggggggcggaggttgcggtgagctgaggtcgtgccacttcactccagcctgggcgaaagagcaaaactctgtctaaaaaaacaaaacaaaacaaaaaacggatccagctgcgattctgatagataatggcttgtaatctgtagaaatttgggtagtattgccatcttaataatattaagtcttccaatgcatgaacatcatatgtcattccatttatgtaggtcttcagttttttcaacaatgttttgcagttttcagatcataaattttatacttctttggctaaatttattcctaagtactgtgttttttgatgttatcgtaaatggaatatttttcttaatttcagttttggattgcttattgctattatatagaaatgcaattgatctgcacccgtatattgatcttatatctcataatgttgaactcatttattagtttttatagctttttggtatattccttaggattttccatatacaagattatgtcttctgcaaatagagaagttttgttttttccttttaaatttgaatgccttttctttgtcttgctaattgtactgcctagaacctcaggtactatgtcaaaaaaaaatggcaagaatggccacttaatcgtagggagaaacatttcactttgtcgtttgtcaggttggggaactgcccttctatttccagtttgttgagtggtgttttttgatggaatcttgctcttcttgcccaggctggagtgcagtagtgcagtcttggctcactgcaacctccacctcccggtttcaagcaattctcttgcctcagcctcccaagtagctgggattatgggtacccgccaccacgcccggctaatttttgtatttttagtagagatggggttttaccatgttggccaggctggtctcaaactcctgacctcaggtgatccgcccacctcggcctcccaaagtgctgggattacagatgtgagccaccacacctggccgaatgttttctattatgaatgggtgttagatgttgtgaaaccatttttctgcatctataaacatggttttgtggtttttgtcctctattctgctgatatggtatattccattaattgaggttcatatgtttaaccaaccttgcattcttagaataaatcctgtttggtgatggataaaaattcccttttacacattactgggtactttttttgttttgtaaccctctatagcacacaggcttactaaattcaggaaaggcaaccaaaaactctttttacaagtcttatagattcttggaaacaaacagatttgactattgaagaaaaatgttaaagcatataagtgaccagtttagtttggaaaatagctcaggctagattgtcatgtaagacttttatgatgtaatgttgaacttcatgaagacaagtgagtcaagtgcagtcataaatatttgcaatgataataattattatgatgatgctaatgttttgccttgcctttgtttaataacttatcctcttttttttttctttttttttgagacagagtttcactctcgtcacccaggctggagtgcaatggcatgatcttggctcactgcaacctctgcctcctgggttcaagtaattctcctgtttcagcctcctgagtagctgggattacaggcacccgccaccacacccagctaatttttgtgtttttagtagagatgggtttcaccatgttggttaggctggtcttgaactcctgacctcaggtgatcctccctctggcctccctaagtgctgggattacaggtgtgagccactgctcccgccttatcctctttctttaagtaccacaatatacattgactctttgattatcaaagcagtcctgtgaggttgtaaggttaggcaccattattcccatctggaaggtgaaaggaatagcctcaggaagattgatttattgctaaaagggaaaaataattaacaattatttatttatttgtttatttatttattattttcaatgttttatttccataggtttttggggaacaggtgctatttggttacatgagtaagttctttggtggtgatttgtgagattttggtgcacccatcacccgagcagtatacactgtacccaatttgtagtcttttatccctcacccccttcccaccctttccccgagtccccagagtccattgtgtcattcttatgcccttgcatcctcacagcttagctcccacttatgagtgagaatatacgatgtttttttttttcattcctgagttacttcacttagaataatagtctccagtcccacctagattgctgcaaatgccattaattcattcatttttatggctgagtagtatttcatcgtatatatatatgccacagtttatttacccactcattgattgatgggtgtttgggttagttccatatttttgcagttgcgaattctgctgctataaacatgcatgcacaagtgcctttttttgtataatgacttcttttcctctgggtagatatccagtagtgggattgctggatcaaatggtggttctacttttagttctttaaggaatctccacactgttttccatagtagttgtactattttacattcccatcagcagtgtagaagggttcccttttcaccgcatccacgccaacatctattttttaactttttttattatggccaggaattaacaattattgaagacttatgactcaccagacttggactataatgtacatatatgtgttaggcctctaaactagttatcactatccctgttttacaggagaagaagcttaactcaaagaggtggagtaaattgaccctagatcagtaacaagcaagagaggacactggggctgggcactgtgatgcatgcctgtaatcccagcactttgggaggccaaggtgggaggattgcgtgagcccaggagtttgagaccagccttggcaatatagtgtgatgctgtctttacataaaattttaaaaacttagctgggtttggtggcatgcacctgtgctctcagttacttgggaagttgaggtgggaggattacatgagcctaggaagtcaaggttgctgtgagctgtgattgctccattgaactctagcctgggtgacagagtgagaccttgtctcaaaaaaaaaaaaaaaaaaaaggacttttttttggttgtttcatttttttaatatggggtattcgcatgatattttgatacagcatacaatatataatgatcaagttagagtaaatgggatatctatcaactcaaacacttaccattttttcatgttaagaacatccccaatctcttctagccactttgaaatatacaataaattattacttatagtcacactactgtgatattaaacactagaacttattccgtctatctgactgtattttggacccattaaccaacctctcttcatacctgtcccccacccgcttctcccagcctccaatgaccatcattctactctctacctccatgagaaccacttttttagctcgcacatatgcatgagaacatgcaatgtttgtctttctgtgcttggcttatttcatttaccataatgtactccacttccatccatctagccacaaatgacagaatttcattattttgtatggttgaataatatcccattgtgtatatctaccacattttctttatccattcatctgttgatggatacgttattgttagtttaacaagaatagcattgaatctgtaaattgctttgggcagtatggcttttttttttttttttttttttgagacagagttttgctcttgttgcccaggctggagtgcaatggcgcaatctccgctcaccacaacctccgcctcctgggttcaagcgattctcctgtttcagcctcccgaatatctgggattacaggcacgtaccaccacgcctggctaatttttgtatttttagtagagacggagtttcaccatgttgaccaggctggtttgaactcctgaccacaggtgacccacctgcctcaacctcccaaagtgctgggattacaggcatgagctactgcgcctggctggaatgatttttaagtagggttgtaaagtggtctgagttgatgtgatagagatcacttttttttttttttttgagacagtgtctcgctctggcacccatgctggagtgcagtggcatgatgtcagctcactgcaacctccgccttccaggttcaagtgattctcatgccttcacctctcaaatagctgggattacaggcttgcgccaccaagcccatctaatatttgtatttttagtagggacggggtttcgccatgttggtcaggcgggtcttgaactcctgacctcaagcgatccacccgcctcggcctcccaaagtgctgggattataggcatgagccaccatgcctggccaatagagatcactttggcttctttatggagtatggggttataagaagaggctcgagtggaaacaggaacaccaattaggtggctactgctgaagtctagacaagagatattgacagtgatttgtatgaaaggggtagtaatggaaattgacagaaatggactgctttgagatatattgcagtggtagaacagatggaacttgatgatagtttgattggaagtgggaatgagaaaatgacccttttttttgagacagagtctcgctctgtcgcccaggctggagtgcagtggtgcgatcttggctcactgcaagctccgcctcccaggttcacgccattctcctgcctcagcctcccgagtagctgggactacaggcacccgccaccacgcctggctaattttttgtattttttagtagagagggggtttcaccgtgttagccaggacggtcttgatctcctgacctcgtgatcagcccacctcagcctcccaaagtgctgggattacaggtgtgagccaccgcgcctggccttttttttctttgtgagacggagttttgctcttgttgcccaggctgaagtgccatggcatgatcttggctctctgaaacctccgcctcccgagttcaagtgattctcctgcctcagcctcccaagtagctggaattatgtgcatctgccaccgtgcccagctaattttttttgtatttttagtagagacggggtttcaccatgttgaccaggctggtctcgaactcctgacctcaggtgatccacccgcctcggcctcccaaaatgttgggattacaggcatgagccaccgcacctggctgactctttggttttttgacttgagcagttgggttgatggtggttccatttattattaagaggaatactgatgagagaataggagaggttattttgttttgtgaggaggacaatttgagaatcaagttctgtttgacctgcgtaaatttgagatgcttgttagatatccaagaaaaaaatgtaagtagtcagttggggcttggtgttcagaagagatgttcaagctagagaaataaatagaatatggaattcatcagtgagtagtatattcatcaatttcaaaaactttttgttcactttcctgcttctaagagatcagatacatcgttgtgatcattgtcagtcaggtaggagtcatggcatatttgtcatttgctattggagtgtgcacaggcagactgccagaatcagactttgcaggatggatgtcagcagcttggggaaaaaatctggagacaatattggagcattgttgtaatcctcaaaaacccaatgatttggagggagggagggcagaagcagtgattcatacttgttaatggactttcctgaagcaggagccaaaagtagttagctttacataattgagaccccagcacccttagcttttagttctttttttttttttttttttttctttgatggagtcttgctctgttgcccaggctggagtgcagtggcactatctcggctcactgcaacctctgcctcccaggttcaagcatttctcctgcctcagcctcccaagtagctgggattacaggtgcacgccaccatgcctggctaatttttgtatttttttttgttttagtagagacggggcttcaccacattggccaggctggtctcgaacttttgaccttataatccacctgcctcagcctcccaaagtgctgggattacagatgtgagccaccatgcccagcctagcttttagttcctttaagaaatgcattgtgtatttccaatagccaagagaggacttagaatgttcccacagcaaagaaataatgtttacagtgatagatatgctaattaccatgatttgatcattaaacaaagtatacacatattgaaacattgcactgtaccacatagatatgtacaattattatgtgtcagtgaaaagaaaaaagaaatggtacataaccaacattctatggcacagaggatgatgtgtgaaaaaatacagacatcccacaactcagaggagttgtactctgaatagaggggtttactctgaatatgaagttttagaagtactttcaccagtttattttgtttatatttactatcttatgtttataaaaatgatatatgataaaaacctgcctacatctgaaacaactattttaatcattataacaattctgttaaaaaggcattgtgttatacatagtttatttatttaaatagagacaaggtctcatgttgaccaggctgatcttgaactcctggtctcaagagatctgcccgccttgtcctcccaaagtgttgagattacaggcatgagccactgcacccggcctgttttacatagtttaagagttttcacttagcaataatttttaaaatgttatttcttaaagctgatggatatttgaaaggaatccaagagtgatggtaggaatagaactttgcaaatgagcaagtgaattgccatcttaattttctgatgatttgtactaaccaagtatttctatcaccatatctccccacttcttttttgttttgctttgttttgttttttgtttgtttgtttttaaggaaagcccagaagaaaggacagtaaatgtgagctctattcgggtaaataaatttactttcatcgtgttgagggatttcatacagcttaatttcatcaagagaatttatacttttccttttttccaaaccttaagcctgctgcctccacaaagtcaaaatgaagtgtttgccttccaaattcattccagtgactttaatgtgaatttattggcacttattctttctagtcttatctaggatataacttttgatagttacagttgcatgtatataaagtatgattgtaatgaaataaagtatgatttgttactggcgtaacaaagccatacataggctgggcattgtggctcatgcctgcaatcccagcacttggagtggttgaggcaggaggatctcttgaggcctggattttattttattttattttttttgagaaggagtcttgctctgtcccccaggctggagtgcggtggtgtaatctcggctcactgcaacctctgcctcccgggttcaagtgattctcctgcctcagcctcctgagaagctgggattgcatgtgtgtaccaccacgcctggctaatttttgattttttagtagagaagatgtttttccctgttggccagctggtctcgaactcctgacctcaagtgatctgcccgccttggcctcccaaagtgctgggattacagatgtgagcccccgcacccggaggcctggaatttgagaccagcctgggcaacatagcaagaccatgcctgtactaaaattttaaaaaattagccaggcatagtggcacgtgcctgtggtcccagctacttgggaggctgaggcaggaggattgcttgaggctgggaagtcgaggctacaatgagctgtgatcactgctgcattccagcttgggcaacaaacagagcaaaaccgtatctcaaaaaaaaaaaaaaaaaaaatatatatatatatataattatctcattatcaaaaactgctatttacacatttaatataggcagtaatataataatatctgctcctatgttatctcctagagtgtgagaatgatgacacatttccattgcacagtacttaaatttttttgccaacataataaaatggacgtttagcccttggaattgggtactttctggtttaaatgttacttagtgactgagctcatttcccccccgaactaattttgatatgtgcatgcgggatgctgcaaactcttcctagggaaagaggaggaaatagagaaaaagcatagtaaaatattcgataagtaattttcctttttctgtgcctgcagggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtggtaggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaaggaattctgaagttttaaaaaagttaataatagctagaatatcttgctgaaaatgtactataaaattttgcctgctgggcgtggtggctcacgcctgtaatcccagcactttgggaggccaaggtgggtggatcatgaggtcaggagttcgagatgaggctggccaatatggtaaaaccctgtctctactaaaaatacaaaaaattggccgggcatgccggcacgtgcctgtagtcccagctactcaggaggctggggcaggagaatcgcttgaacccgggaggcggaggttgcagtgagccaagatcgcgccactgcactccagcgagactctgtctcaaaaaaaaaaaaaaaaattacctcaatgctattgaataattctcccttctagtaaaattcgtatcatttgagaagaatcaagctgaattaatttttgtctttaaggatgcatacttggggttcttttttttccccatttaaaaaacaaaccctaaactatattattggatggcgttcagactagaaatcccactcgtccattgactcattaattgattcaataaatatttattgagctcctttctctgtgccaggtactcttctgtgtgctggttatacagttgtgaccaatacaaagtacccgggtttttgtttttgtttttgttttttgagatggagtctcactctgttgcccaggctggagtgcagaggcatgatcttggctcactgcaacctctactttctggttcaagcaattctcctgcctcagcctcacgaatagctgggattacaggcacctaccaccacgcccagccaatttttgtatttttagtagagacagggttccgtcatgttgaccaggctggacttgaactcttgatctcaagtgatcaacccgccttggcctcccaaagtgttgggattagaggtgtgagccattgcacccagcccaaagtacctgtttttatggagtttacattccaatggagaagacagacaataacatatatcaaatgctataaagaaagggcagggaatagggatacaatgtgttgaattttgtcaaatgctttttttgtatcttttgagattatcatatggcttttgtccttcattctgttaacatgatatatcacatttactgatttgtgtatactgaatcatctttgcatcccgggatgaatcccactgggacagaatgtggagagggttgaaactttagataagatggtttgggaaagcctgtttgaagagatgacatatgcagaggccccagtgaagtaagcatatgagtcatataaatatttg

SEQ ID NO: 13103 - DNA, 6728 bp, Human
  misc_feature (1)...(6728): n = A,T,C or G
ctggctcagtgcccatctgcaccctccccgtggggcctcacagctgcccttctggacgtacgcaagggctgtccctcgcccggcccgtgggctgctctgctgtgtgaatgccccgtcatttgtgtcaccggtgagctgctcaataagatgaacaagtcacctccagcctcgcagcccaaggataggagtcacggggagccggggaggggccttctgcggcgagagggatgggagggtggacgtcacacccctgcagcccctccggggaccaccctgtgtggcaagctgctctccggctgttcaaagtgtcagctgcgccacggggcgggggggaggggctcctctgcccgctggccgcctcccacttggccccataaactgctcgctcctctaactctgtccctgcctctagatggatgactcacaccgtgtggtctgatgagcattctttattttttgtgatggagtctcgctctgtcacccaggctggagtgcaatggtgccatcttggttcgccgcaacctctgcctcccaggttcaagcaattctcctgcctcagcctcccgagtagctgggattacaggcgtgcgccaccacgcctggctaattttttttgtatttttagtagagacgggctttctccatgtgggtcaggctggtctcgaacccctgacctcaggtgatccgaggcccacctcggcctcccaaaatgctgggattacgggcgtgagccactgatggcgcctctttctatccaggggcccagaccccctcccagcctcggggctgaagatctccaggcctctcaaaggcccccaggcccagctggccccacccctttccttccgagcgtcggggcggcctggagctgcagagaccccttccttctctgcagtgtctgagggctgcctctccaaggcaggctcctacatcttggatttgagaactccggggtgtcacaaacagctaattcctgtcatttaccttggaaaaggaggaaccgccttacggggtgaggcggtggctgcaggtctcaaaagggtgttgaaccacatccacgctcacgttcccgagagcccccacccccagcattcatgggggtctccacctgtgctggacggcgcagaagcagggctgggcaatccagggaggcttcctggtggaggcagggtcccagaacccctcggtgcccacaggggaaactgaggctcagaaagacataggacagtctcccaagagctctgcgaggggctcctcctcaactccctccgggacctggatctgtctggtgtgacggatgaaggtggctctgagagaccgggccctgggtgcccgcgggggcggctgacactgtcccgaggaggcgccagcaccctctcgtctccccaccagctcctcctggtgcccctcccaagccccggggaacttcccaggttggcctgaggggggtcctggagagctgcaagcaagggggaggggagcccacaggcctgcagcccatggtgagtttcacacctgaagccagccaggtggggtgtgctgagccgaggggtccctgtccccattctgtggggttccccagcacggggctccatggttgaggctctctgggggtggccagaatttgtggagacctctcggggactcgcagataccacccggaggcagtgggatggaggagtgattggctgacccccgccctccaaggggcccccatgggacaaggtgctataaacgccgccccctgcactggggacaccaatgtggccgcagactttgcatagaaaacctttctgatccccgccagcctggtttccccgcccctgccggcgacctgcgggggaccgggctgtgtccgcagtgtctacaccccctcctcacacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggtaagtaaaccgcgtttacttaacgcggaccggccaaggcgtcccgcggaagccgggatgggtgggcgccccccttcccgtgctcagaccggcgttgctgaggtctaaggagggtgggcacagagccgccagcagcgggagccttccggagggaggcaggatcccagagggaggcggaggtgtgccagctccagccagtggccccggccgggagcaggggtgagccaggtgggagcgccctcaagaggggtctggggtctggaggtggaggacggctgttccaggtcctgctgggcgggtcgtgagcccttggccatcgcccagccccctcctgcccagttgagggcccccctgcaccaccgtctggcctgctgcctgcctctgacctgcacctggggatgagggttcagctgacacggctggtctggagaggaagctggcagggaagtcaccccagagcttcttcctccagggcctgtgggttgggaagggaggctctgtccggaggcccagtgtggctggtggtggggacagcagcgcccagacaccaggcaggcggcctctgaggtgtcgacgggcctccaggggactgtgcactgttgggggccacccctgggtcctgcaggggcagctcctggttgcatatggagttagcacctgggcaggggcagctgtggggcgcaaagggggagtagccaggccacatggccccaggagaaagagacagctggataaacccagggtccagactcccagccaggagccctctgctccctggagccaactgtgggtggagaacggacaacctcactcccctggagggccgaggggaggcctggggaggagggggcctcagcccagctgctggggggctggcctgtctcctgcccaggcgaggagtgctgttccgagtgggactgcatgtgtgtccagcctgaattccactgcggagacccttgctgcacgacctgccggcaccacccttgtcccccaggccagggggtacagtcccagggtaagtcctggaggtgcctctgggagtccacacaggccaggggttccactagggcccgaggcagagctcgtgggcacaggtgtccggcgaggacatgtggtgtgtggggtccggagtcctgtgaggccgggcaggccaggccatgctcaggcaccacaggccatgaagctctgggggtgtcctgtccctgctttctcagcctgggcttctccatccagcacgagggctgtgagaaccctgcggggaggtgggggcgggttccaggagctgtctggctctcaggcccgggacacccatcctgtctgtcctcaccacatactgaaagagcctgccctgtgccccccggagtcctgtctggggcctggggctgcaccctgttctggaaggagcagctcaagtcctcttagcggcttgtttacctgacaggagaggtcaggctgggcacatgagagctgggagaaggtacaactggggaggttgtgtcaggttggacggggcagggtctggggtcaactgggacccagcctcactctctctgggaccctcactgttctccaccctctgttctactgggtcctgcctggcttctgcccaccctcagcccccaatgggcaggcctttcccctccctggcaggcccactgcactctgcgcacctcccccaggtgccctcactgggccccaccccagacgccccacctgggacgggcagacatgggccccagtcctgggccatgaagaactctgttgaatggatgatggggggggcattctactcagcacccagaccccagatggacccctgcactggcctgacgccctcctcatccatcccagcaactccaccagcctccctccctccctccccccacaccccacaccagggaaattcagttttggcttccagtgtatcgactgtgcctcggggaccttctccgggggccacgaaggccactgcaaaccttggacagagtgagtcctgggtgggccctgccggtggccgggtggtccaggcccactctgaggaagggtcctctcctgtcccttgccccagacagcacggagggcagcagccgggggctgatcggaggccgtgtccgggggctgataggaggccgcgtccatgtattccagctgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgaggtctgtcacagcctggtgcggggaggtgggagcatggctgcctgctgaccgtggcccccctgcagagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtgacctgagtggatgcatgctgggtgctgggggaggacggggcacccggggctgggctttggggcaccgtgctcatgcctggccgtggtcccctccacagggggcaaagcggagggcagccagggcccattctgggaactcctggctgggtgggggtggggcccgaggaggggccattccagtcctgggcccagcgctcctcagggatacaggctcagcggcttcccccgttctggggctcttctctggtgcccctgggtctctggtttctggccacacagcctgccggcccccgggtgccatccagcactttctggtgctgggcggccccgtctccaggccagccctctctcctcaccatcccaccctcggcccgcccagcctcccactccaggctccaggtgagatctgatacaggctccctcagctgccggggagtggcgggcaggctggtgcaggcgtctcagcagcaccctggaggcacagcacacctggcccccagctcagctcccagtggggcggtgggcccagctcacagtaggtggacggggcagaggggacgtctgctcccctccccccccaacatgggacctggagtgtggagagcccaagggtggcacagggacactggggaaggtgctcagccctggaggcaggacccggcccttcggcgtcgtggagtactgggctcggggctgggtactgggcttggggatgggtactgggctggaggctgggtactgggctcggggatgggtactgggctggaggctgggtactgggctagaggctgggtactgggctcggggctgggtactgggctggaggctgggtactgggctcggggatgggtactgggctggaggctgggtactgggctcggggatgggtactgggctgcgaggctgggtactgggctcggggatgggtactgggctggaggctgggtgctgggctcggggctgggtactgggctcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13104 - DNA, 16672 bp, Human; identical to SEQ ID NO: 12322

SEQ ID NO: 13105 - DNA, 16672 bp, Human; identical to SEQ ID NO: 12322

SEQ ID NO: 13106 - DNA, 28555 bp, Human
ctcgggaggctgaggcaggagaatcgcttgaacctgggaggcggaggttgcagtgagcccagatcacgccactgcactccagcctgggaaatagagggagactctgtctcaaaaaaaaaaaaaaaatctgtccccgctaattactgtgggagtctaagtcctttccttctgccccttggaggggctgactcctggagcagcaccccctccaatccatctatccagtaacccatactgttaagttccctgaagtagaagggggttggtgggaggagcacggctgtgctggaccctccccgctaactgatgggagggtgaggggagttggcagtgagaggaagggcccctcccagccatcccgagggcccccaggagccagacaggaaacagctcaggaaagacagcagccgcagccgcagccccagcctcaggggtcatggctgcgggcggcggggaagcccccccaaaacacgagagtgagagtgagaagggcgatttggagatctagccggacccctcaccctctcggacacacccaccttttttttttttttttttttttttgagatttcgtctcactctgtagcccaggctggagtgcagtggcgcgatctcagctcccagctcactgcaacctccgcctcctaggtcccggttcaagcaattctcctgcctcagcctcccgagtagctaggattacaggcgcgcgccaccatgcccagctaatttttgtatttttagtagagacggggtttcatcatgttggccaggctggtcttgaactcctgacctcaaatgatccgcctgcctctgcctcccaaaatgctgggactacaggcgtgagccaccgcgcccgccacacccaccttttctttaccgttgtttcctcgatttttctctactccctagcgcagcttagtgcgcgcctcctctggacatttttcagggcttggttgcgcgcacagtaggtccccaacactgaatgtttatggggtgactgtgtgaacgttcgctgcaaggctatccaaactgggattgctccttgaggccccctgggcggccgtcaattctccaaagcttctactcccttttccttccttttcccccaaaacgcagtccctgcgcccactagagggtggtgggcgcatccaagagcggcatctagagtccgcagcaaggtcagagcgggctttgtgtgcgcggtgaacatttacgtgcacgcctgggcggccctccgtgttgctgctgggtgtgtgttttctctgctccctggtgccagccgggttcgggcctgtcccgggggtccctgggccccagccccgacatgctcggtcctggacagcgcgcaccgccacggcgcacatctgggcggtcccggggttcctcacccgccgcccctcccccttctccaaactttctctcaacttcccgacctgctccactcggtgcccctctccgcttccctcatgaattattcagtagcgtgagctccaatcagcgcgcccggggctcactcgcggagcccccgcgttgggagagctgcccccgccccccgcgcgcccctccctcccgggcccggcgccgcccggcccagttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaaggtgagtttccttggggggggggcgcaccccgtcactcctgggacctcccccccaacatctgggcctcggagtggaggggccggcctctgactacccctacccgggcactgcagtcccaaacacttcggaccgatagtgctggaacgggaggggggcggggaagaggcgcccgacgggtagtggagttttcttttgtttgggaaagagatggagtctggctacgacccgggacattcccctgcccgggctccccgaactctcactgctgattacatacgcccctggctgcctttcctttcctccctaccccactattcaaaactatctgcaaagtttctgtcccagtcccacctcccgccgtacatgagggaaggtttctggagaagcaacagcagacaaggcacaacttttcgtgctaggccctaaaacgacccccagcgccaattccttagcgatcacaccttgatcctccagttccacactcctgcaacaggatggcctcctttgcattcacacagcaaacccccaaaccgctctcccgcccactgctcctgcccctggtatagggtggctccttggtttctacaggctgcaccccatccctttaaatgcggtctagaccccggccccaggtgagtcccgggcttcccttgagacctaggagcgggtagaaactgacctacacagcccccaggtagaaactgacctacacagcccccacatcgccctaactaacccagtctatctcccacctcctgatctctccaagcatttctttggccatggatcgctgtccctcctggtcccctaaagggggagccaagagccctagaaactctcctgtgtccctaatgtcctttcagtgagctgccaacacccccctttctctgtctggtatgaaagtggttatggggcggtaggctatgagggactcccaaagggaaggattcagcggcgttagaaaaaccctctccccctggctgggcaggactgccctgggctggggatcaaaggctaggtgtggggttgggagtgaggggaggcttgcccagctcagagaacggagaagggggaacaaaaaccatgaacgaggggaagaggaaggccaaaggggtggaaaaaccacgaggacgaggtgtggtgagaaggaaagacgcaaagaggaaatggtgattgtgacacctattacctgagtgtttccaagcaccaggcctgtgctgagcgccttacaaatgttaatttcacccatccagcaacgctaagggtggtgctattattgcccccatttttcagatgaggaggctggggcttagttaaggttaagtagtttatccaaggccctgtgccgcgaggaacagcgagaagtggaggccgaaagcgaaggagagatagtgactgtcagaaagagaaacggaggtggacagagagtggaggagagataggtgagagacatgcgaactgacagatcaaagcgtggctgcagctgagctgggacgcagaaagggagcctgcgcttgctctgggctgcggacagcccgaggcagagacagtgtgtaaattggagacaggaaaacactatcccggctggaacaatggagggtggagacggcagcctctatccacccccttcccagaacccgggcatcctgtccccagtgagcagggctgtctcttgccacccatggggaccttgcgcctctcacctcaggctggctggcttcccatctgacccctagctggaggacatcatttggtccccaggaagaggctgcctcacccaccctctttctcttctctcctgcagctcccatggggtgggagccaggtgttctggctcccctctccacccttcccagcgcccaatgccccccacattgccggcccccgaggggattcctgtaccctccctcctccactctccactgccaggggctgtgcagtttttcctaatccccccgcttcctccagtgcctgtcccctcccccgatgatccgagccaagccaggtgtgttcacccctcccattcataccgccccccagaatctcctcccctctgccttcccataaccaaatccagatgtgaggcctcggcgggagcctgggaaccctagcatcccgacctccagtgcttcctgatcagggcactcgtggggagggaggtactgggatgggggccagggctatgccccaggcacggagcgctcccttcaaggagggaaggacggggtgtttggtctgaaagcagagaggggtcttggacagggaatgaaattgtggggtagagaggctgattctgggacttaggggaggaaacgtggaggctgagacaagaggttcccctcccacaccagcagcctctgctcgtgggggtcaggaccagggcgcagctctcattttaaccctttctgagctgccgccccttctccccgtccattttgatctccctccctcctccagggaggcctagatctggggtatcccaagggagccccatgcctaccagatgttgggggtggggttggcacttagcagaagaggccagaaatcaggcgggtgcagagggcagggcttgctcccctcttggccccccaactcctctagctcagagctaagaggatccacctgcctcggttcccagggatctggtcttcctgacctccctcccccaccccaggcactgactctgtctctctgtctgtctcagagaccctgctgaacacaaaattggaaactgctgatctgaagtgggtgacattccctcaggtggacgggcaggtgagagctgcacccaggagctggagctctggagggaaactgagggaggagagggcgcctgtgccgcctgctttctgtgtgccactcctctcccctgtccccccagatgacagcagccccagcagtgtcgtctgagcccttctcagaggcgccctcctcgcagtaccagcagcccccctttctcagtccctctcactttataggattcaccccatgcagccctctccctggcggctccccagcccccttgctgacctccttctctgcacagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtacctgggtgcccccagggctcagccacagccaaggtgggattccagccagcaggcccgtggcctggagggcagccgatgtagttgcgaggcctctggcccgcgcgctgggggctggaagcaggaggcttaggtctggggagggaagggggtgatcttctgggcggaggagcagaatatacgggggctgcctggcccggcccccagggaggcccaagggtcaggcttctcctccagtcacctcaaccaccctaccccactgtgctccagccacactgagtttctcccattccctgactgcacctggctggtttccagctcgagactttgcagcggtgatgtctccacctgggggcctctctgcctctcacacccctacttgtcttcagagttccagctcccgagatcttgcctgtgccaccttggctgactctctcctccctacaatcctgcatacctctgtccacctgcctgtctcggcactcattttactttatttatttttcttttatatctatatttttaaagcggggtcttctacgttacccaggctggtctctaactcctgggctcaagagatttctcccacctcggcctcctaaagtgctgggattataggcatgaggcactacgcccggcctcatggtactttataacttccccaggattcattcatcgctgtctccttgactctgaggtcaaggcctggcatggcgtcagtgtcagtaaatgtttgtagaacgagtgaataaaaagggggagaggtgcaggccagaggccgggcatatcgcaggagctttgcaaggctgaatggacagtgtgggggcctgcagaaagtgtgccctggggaaggtggagggaagattctggaacgggaaccaaggaggtccgggagggtgagctgggaagaacacaacagtccgctgggtcctcagggagtggggacagcagcggtgtgcctcccccccgccggcaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgaggtgagagctggagcttcccctgcgactgctgctcatccgggggagagtcctgaactccactcaggacccacttcttaagtttccattttgtatagttagatgttgaaatggaggcttgctctgtcacccaggctggagtgcagtggcacaatctctgctcaactgcaacctttgcctcccgggtccctgttcaagcagttctcctgcctcagcctcgtgagtagctgggactacaggcacacgccaccacgcccggctaatttttgtattttagtagagacggggtttcgccatgttggccaggctggtctcgaactcctgacctgaagtgatttgcccgcctcggcctcccaaagtgctgggattacaggcgtgcgtcaccacacccagctggaaaaaaaaaagactttattttcacctgaaattcattaatttccacttgaaattccacctgcagttgtagcaggacctgacacttgggccccatggaaatcacaggtattgcctgacacagtggttcatgcccatagtgccagcactttgagatgccaaggtgggaggatcacttgagcccaggagttcgagatcagcctgggtgacagagcaagaccccgtctctaaaaaaaatttttttttttttttcaagacagagtcttgctctgtcacccaggctggagtgcagtggtgcgatctcggctcactgcaagctccgcctcccaagttaacaccattctcctgcctcagcctcccgagtagctgggactacaggccccgccaccacgcccggctaatttcttgtatttttagtagagatggagtttcaccgtgttagccaggatggtctcgatctcctgacctcatgatctgcccgccttggcctcccaaagtgctgggattacaggtgtgagccaccacacccggattacaaaaactttttagataattatctgggcgacctgcctgaccaacatggagaaaccctgtctctactaaaaatacaaaattagccggacatggtggcgcatgcctgtaatcccagctacttgggaggctgaggcaggagaatcacttgaacccaggaagcagaggttgcggtaagccgagatcatgccactgcactccggtctgggagtgcactccaacaagaaggagtttcgctctttttgcccaggctggagtgcagtggtgggatctcagctcaccgcaacctccacctcccgggttcaggcgattctcctgcctcagcctcccaaggagtagctgggattataggtatgcatcgtcacacccggctacttttgtatttttagtagaggcaggtttccaccatgttggccaggctggtcttgaactcaagtgatctgccctctttggcctccttctcaggaaaaaaaaaaaatcacaggtatttacaggccattccaagtgccaaaagattgtttttgctcatggtgacttcagtatcacagatgttaggagacttgctgctatatgttaagaaagaagcacaaatgttgctgtagcccaaacttttttcctcatgtttcattgcatttcagcttaattggtttccctggtattcctatgtattttgtggagtgcttttaaaatcataagttggagtagaggtctttctgtgggcttcaccagactgccgagatcagggtcgaaacaggtgaggaccccttctctggagagagtctcctttctcctctaagaggaaaggttttgagatcttttgtccattttcccaccttagcacttcatcagccttaaaagaagctggaatttttttttttttttttggagatgggatctcgatatgttgcccaggctggtcttgaaccccttggctcaagcgatcctccagcctcagcctcccaaagtgctgggattcgaggcatgagccaccgagcccaccgtgcagatggatgtttttgtgcatgcttttgatgaatgctttctctctctcagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccagtaagtgaccagcacccaggtgcagttcactggggaggggtcacagacctctgaggtggaccctcacatggcccccatcctccctgggcttcttccctttgtccctggcatgcttgtccctagcccggaggaacatgtggagcccactgtctccaaggcaagagtccagcatggctgctggtgcctccattgccctctccccaccaccgcagagcaggtcggcctctgcctgactccctggtctcctgcagcccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagagggtgagacttgggggctggggcggctggtggtctggcgggagagatgtcactgagggcctgaaggggagaggcaggggctgtgaagttgggtaccccggaagtgtgaggggctaaggctttgggggcaagaggcagaaagagggcaatggctgggcgcagtggctcactcctgtaatcccagcactttcagaggctgagacaggcggatcacttgagccctggagttcaagaccagcctgggtaacataggaagatcttctctctacaaaaaataaaaatattagccaggcgaggtggtgcatgcctgtggtcccagctactcaagaggctgaggcaggaggattgcttgagcccaggagtcggaggctgcagtgagctatgatcgcaccgctgcatgccagcctgggtgacagagcagtgtgagatcctctctcaaaataaatgaataagaaagagagggtgaggagctcgtaaagctgggctggagagttaagtacaggaaggcccccagtgggactggggccagagagaatcagaaggaattctcgaaacagccagggggaaattgagacaagtgtagccagcagaggaagtgttggaaaagataagggacatggccaggctgatcacaaggtcaggagttcaagactagcctggccaacgtggtgaaactccatgtctactaaaaataaaaaaattagccaggcatggtggtgggcacctgtaatccacttgggaagcaaccagaagaattgcttgaacccaggaggcggaggttgcagtaagctgagactgcgccactgcactccagcctgggtgatagagcaggactccgtctcgaaaaaaaaatttttttttaagttaagggacagagctaccatgcacaagggttccctgtgtctctgcctctcacagtacctcctgcagtgtccgacatccgggtgacgcggtcctcacccagcagcttgagcctggcctgggctgttccccgggcacccagtggggctgtgctggactacgaggtcaaataccatgagaaggtaaggccatcccccagccctggggtgggtgggcaatgggttgtgctctcctggctgggacacctgggttgcaggcacctggcaggcatttgaattccagctctgccatggattccctgggcagccttgggtaagccccttggcctgtctgagcctcagactcttcatctataaaatagttactgtaatagttaccagcagctggacacagtggctgaggttgggtgcggtggctcacgcctgtaataccaagcactttgggaggctgaggcgggcagaatgcttgagcctaggagtttgagaccagcctgggcaacatggtgaaacttcatctctataaaaaacttaaaatgggccgggcgcggtagcttacgcctgtaatcccagcactttgggaggccgaggtgggcggatcacaaggtcaggagtatcgagaccatcctggctaacacggtgaaaccccatctctactaaaaatacaaaaaattagccaggcgcggtggcaggcgcctgtagtcccagctactcgggaggctgaggcaggagaatggcgtgaacccaggaggcggagcttgcagtgagccgagatagcgccactgcagtccggcctgggcgaaagaacaagactctgtctccaaaaaaaaaaaaaaaaaaaaaaaaaacgcaaaaaatacttaaaatgaaaaaaattagactgggcacagtggctcatgcctgtaatcccggcactttgggaggccgaggtgggtagaacacctggggtgaagagttcgagaccagcctggccaacaaggtgaaatccccgtctctactacaaatagcaaaatcagctgagtgtgttggcgggcccctgtaatcccagctactcaggaggctgagacaggagaatcactggaacccaagtgattctcgacttgaggtcgaggctgcagtgagtcgtgtttgcaccattgcattccagcctgagaaagtgagaccttgtcttaaaaaaaaggaatgatattatgaatacagcacatggcttgcatgcgtaagttctcccaaaggcctcaccagttgcaaggcaggctagtgatgggagtggagggcgagggaaggaggcaggaagagcaacaggaacttgggttcccgggtgacggccaccccactacctctcccggacagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatggtgagcctggggaagggggtgagggtgggggttggaaagacccccaaagttcctgggaagaccccaggtctccaaagtcccatcatctttttttttttttttttttttttgagatggagtcttgctctgtccctcaggctggagtgcagtggcaccatctccgctcactgcaacctccgcctcccggattcaagccattctcctgcctcagcctcccgagtagctgggattacaggcgcctgccaccgcgcctggccgattttttgtatttttagtagagacggggcttcaccgcgttggccaggctggtctcgaactcctgaccttgtgattcgcccgcctcggcctcccgaagtgctgggattacaggcatgagccactgcacccggtcaaagtcctatcttcatgtccttcttcctgtggatcacgtggcatgccctagagaggagagaacgtaagatgtcgaaaccaaaaccaacagctgagttttgtgaagtctggcctgcttcactctgtacccccaggctggagcgcagttgctcgatcaaagctcactgcacagccaggcacagtggctcaccctgtaaccccagcactttgggaggctgaagcaggaggatcacttgaggtcaggagttcgagaccagtctgaccagcatggtgaaaccgcgtctctactaaaaatatagaagttagctgagcgtggtggtgcacacctgtaatcccagctactcgggaggctgaggcaggagaatcgcttgaacctgggaggtggaggttgcagtgagctgagattgtgccagtgcactccagcctgggcaacagagcaagactctgtctcaaaaaaaaaaaagctcaccgcaggcttgacttttagcaacaacctgacccctgagctccccattccccatccaacaaaatgggaatatcatgaagcttcctgcagggctttgaggattggaggtaacaggttatttttaatatgctaggccagtggctttcttttttctttcacatttttttttttgagacggagtctcgctctgttgcccaggctggagtgcggtggcgcgatctcagctcaccgcaagctccacctcctggtctcgatctgctgacctcctgatccacccgcctcggcttcccgaaatgctgggactgctggcgtgagccaccacgcccggcctaactttttcttttttttaagagacacggtcttttttatcacccaggctggagtgcggtggcaccatcatagctcattgcagcctacaactcccgagctcaaccaatccttccaccttagcctcccaagtagctggggctataggcatgtgctaccgtgctcaactaaatttttttttatgttttgttgagacagtttccctatgttgcccaggctggtctcaaattcctgacctcgagcaatcctcccgcatcggcctcccaaagtgctgggattacaggcatgagccgccacacccagcattggaccagtggctttctaaaccttgtaattttctgtaatagctttactgaaatacagttcccctgccatacaatttgcctgttcaaagtgtacaatcgatgacttttgatacattcacagaattgtgcagtcaccaccacaagtaattttgggacattttcagcaccctcaaaagagaccctatagcccttagccatcaccccccacccagatctttctgttgccttagtccctggcaagcactaacccactttctgtcttgaaatcttccagtgtggtcttttgtgactgttcaccgagcagaatgttttcaaggtttacgtatgttgtagtatatatccgtgggtttttttggttgtggtttgttttttgtttgttttggaaacagggtctcgctctgtcacccaggctggagtgcagtggttcaattacagctcactgcagcctcaacctcccaggctcaagtgatcctcccacctcagcctcccaagcagctgggactgtaggcatgagccaccatgcccagctaattttttttggtattttttgtaaagacagggtttcaccatgtttcccaggctggtctcgaactcctgagctcaggcaatccacccacctcagcctcccaaagtgctgtgattacaggcatgagccactggacctggcctgttttttgtttttgttttgaacacacgattttgctttgtcacccaggctggaatgtaatggtctgatcatagtgcattgcagcctcaaactcctgggctcaagcgatcctcctacctcagcctcctgagtatctgggaccacacgtgctcaccaccatgcttggctaattattattattttttgatagagacggggtcttgctatgtttcccaggctggtcttgaacacctggcctcacacaatcctcccacctcagtatctcagagtgctgggattacaggcatgagccactgctcctggccaatatttcatttctttttatggagacgtaataatcagttgtatggaaatagctgattttgttttttattgtatcttttggtgaacatttcaattgtatcgactttttggataaaaacctgaaaatgtttcacctttagaacgtttcattgaatggagatttttttgtggactctggtatttatactagaaccaaatcaaaaccactctggcggctgggcatgcctaggctggtttgagactagcctgtccaacctggtgaaagcccatctctactaaaaatacacaaattagccgagcatggtggtacacacctgtaatcccagctactcaggaggctgaggcaggagaatcgcagaacccgggaggcggagattgcagtgagctgagattgcgccactgcactccagcctgggcgacagagtgagactgcgtctccaaaaaacaaacaaaaaattactctggcagtaagaaaagatttcgaaacttcctcccttgccctgaggtacttcagaggagcctgctggcccctgggggagagtttgaaacccactgtttgttccctgaccttgcctgcttgtgtcctctccctccacctgtcccctgtactggggacctgttctcaggagatcacagttcattgctcaaagccggggctggggcctcctacaggaccatcagtttctcctgatcagcagcctttccttccgcagagagcgagggctggcgggagcagctggccctgattgcgggcacggcagtcgtgggtgtggtcctggtcctggtggtcattgtggtcgcagttctctgcctcaggtaagggctctgacacccagaggcccctggaagccctcagttgatggccacctgcctgggtgctacaggacaagcctttctggctgtccccagcctctttttacttgaaatcttctccaatccctgctccttcctttggtgtgtgtgcctcataaagatgtgtgactcagtttaccttttgttcctttcccatcggctacaggaagcagagcaatgggagagaagcagaatattcggacaaacacggacagtatctcatcgggcatggtgggttgccctaatttgatgggaataggggcttggggccgggtgtggtggctcctatctataatcccagcactttgggaggcagaggtgggcagatcacttgaggtcaggagttcgagaccagcctggccaacatgttgaaactccatctctataaaaaatacatcagtcagccaggcatggtggtgggcacctgtaatcccagctactcaggaggctgaggcagaagaatcattttaacccgggaggcggagattgcagtgagccaagatcgcgccactgcgctccaggcctgggtgacagagcgagactccatctcaggaaaaaaaaaaaaaaaaaaaaaaaccacggagacaggggtttggggctaaaagctatgagccgagcctccgagtccagtgggagttaattcccagctgacggggccctgcctgatttctcaggtactaaggtctacatcgaccccttcacttatgaagaccctaatgaggctgtgagggaatttgcaaaagagatcgatgtctcctacgtcaagattgaagaggtgattggtgcaggtgagagccgaaggctgcccgggcacctgggaacgaagcgggggtgggcagggccacaccggagcgggagagctgatgacctctgcgtccttgtttgaaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcgggtgagcaccctccctggcttctgcggccacccggagttcccacttacacccagaggccacttgggttaagaagccaggacagacagtgggtcccaggtcacctcctccagccttttcctcttgggctaagccctggtcctctgccttttcttttttttaagacagagcctcgctctgtcgcccaggctggagtgcagtggcgcgatctcggctcattgctgtctccacctccagggttcaagcgattctcctgcctcagtctcccaagtagctggtactataggcatgcaccaccatgccgactaatttttgtatttttagtagacacagggtttcaccatgtaggccaggctggtatcaaactcctgacctcaagtgatctccccacctcagcctcccaaagtgctggtattacaggtgtgaggcaccacgcctggccagccctctgcctttaattttccctctgggaaaggctgggctcctgggaccttcctttcccactgccccatacagctgaaggttgtcattccttctttttttttttaattttgttttaattgaattttttttttttgagatggagtttcactcttgttgcccaggccggagtgcaatggcaagatcttggctcaccgcaacctccgcctcccaggttcaagcgattctcctgccttagcctccccagtagctgggattataggcatgtgccaccacgcttgactaattttgtatttttagtagagacgggggtttctctgtgttggtcaggctggtctcgaactcccgacctcaggtgatccgcctgcctcggcctcccaaagtgctgggattacagacgtgagccaccgcgcccggccaattttttttttttttttttaagacagagtctcactctgtcctctaggctggagtgcagtggtgcattcatagctcactgtagccttgacctcctgggctcaagtgatcctcccgcctcagcctcctgagtagctggaactacactcatgtaccaccatgctcagcaaatttttaaaattttttgtagagacaggatctcgataggttgcccaggctggtctgaactcctggcctcaagcgagcctccctcctcagcctcccacagcactgggattgcaggcatgagccactgtgcctggcctgtcattccttcttttgacaaatatttactgagtgctttctacgcaccggtcatcctcccagtccccaggaataaagctatacacacggcaaactggatttctcctcttggggagcagagggtctaatggggcagggggactgaaaattagcaagtaaatagacaggctttttaaaaaagtaaacaaatcatttcaaatgtgaaaaaaagcaaacggggtccttcatgcagatgtggctagagaggaaagagaactgcttaatttatttggtcactttaccagattttactgactttttttttttttttaactttattaggcttttcttttttcttgagatggagtttccgtctgtcacccaggctggagtgcagtggtgcgttcttggctcaccgcaacgtccacctcctgggttcaagtgattctcctgcctcagcctcctgagtagcttggaattacaggcatgcaccaccatacccagctgatgtttgtatttttagtagagacagggtttcatcatgttgcccaggctggtcttgaactcctgggctcaagtgatccacccatctcggcccctcaaagtgctgggattacaggcatgagccaccatgcctggcctaggcatctttttaaaaaaatcaaaacatttttctatgtagcaaaataacattgcattgaacagagttatagcgattccctagcgtcattgaatacccagttgattttcacgtttctctagttgttctaaagatgtccttcactgctgctttattccaaccaggatccagttcaagaccgggctttgtacctggttattatatatattttatttatttattttagaaacaaggtcttgccctttcgcccagtttagagtgcagtggtgcaatcatagctcactgcagcctccaaactccttggctcaggtgatcctcctgcctcagcctcctgggtagctggaactacaggtgcacaccaccacacctggctaatttttaaattttttacggagatgggggtctcgctatgttgcccaggctggtctcaaactcctggactcaagcgatcctccctccttaacctctcaaagtgctgggattacaggcgtgagccaccacgcctgctgattattatattttcgagcctctctaaatcttgagcagttcctcatgatgacactgacacactgaagggttaggtcccttgtccgcctgaatgtcttgatttctggatttatgaaattcttcttatgggatcatttagcttgtctctctgtatttcctgtaagagaagctctatctgatgtggggtttttttggttttgtttgtttgttttttgagatggagtcctgctgtcgcccaggctggagtgcagtggcacaatctcggctcactgcaacctccgcctcctgggttcaagagattcttctgcctcagcctcctgagtagctgggactacaggcgagtgccaccatgcccagctaatttttgtatttttagtagagacagggtttcaccatattggccaggatggtctcgaacttctgacctcgtgatctgcccaccacctcagcctcccacagtgctgggattacaggcatgagccactatgcccggctaatttttgtatttttagtagagacagggcttcgccatgttggccaggctgatctgaaacccctggcctcaagccatccaccctccttggcctcccaaagtgctgggattaaacgcgtgagccaccgtgcctggtcgaagagacagaaagggtcttaaaggttcagtgacacacacctgtaatcccagcactttgggaagctgaggctggtggatcactcgaggccaggagttagagatcaccctgggcaacatggtgaaaccccgtctctacacaaaatacaaaaatgggcagagcatgatggtgcatatctgtagtcccagctactcgggaggctgaggcgggaggatcacttaagcctgggagatcgaggctgtagtgagccatcattgcactactgcattccagcctgggcgatcccatctcttaaaaagagagagagatgggaagaccagcacaggtgaaactggtgaacagaggagagatggtagatgctgcattgggcagtgtgacgggaacccgctggagggctttggcaggagagtagtttaagaggatcccagctgggcacagtggctcacacttgtgatcccagcacttggggaggccggggcaggtggatcacttgaggtcaggagttcgagaccagcctggccaacatggtgaaaccctgtttgtactaaaaatacaaaaaccagccaggcatggtggtgcacccctgtaatcccagctactcaggagactaagacaggagaatcgcttgaactcaggaggcagaggttgcagtgagccaagatcacgccactttactccagcctgggcagtagagcgagactccatctcaaaaaaataaataaataaaaagacctctttgctgggtgctagggagcaagagcaggagctgggagaggcctgcagcagaagcctgttgccagcatccaggccgtggggtgaagggaagggtttggatttgggacatgtcttggaagcatcaccagcagaacttgctgatggattggaagtggctggtgagggagaaaagggggtcaaaggaaactctgaggtctataccctgaccatctggcaagtggtggtgttgccacaaactgagcggggagtagggcaggtgcaggtctggaggatggattcaaaattcagtttttggagtctatgtccctggttctgtagggctgcagatggtctgccaaatcttagcggaacccagaatacgggatttgtttactgtctgtgacttgttggtttccctggtgagagcaaactctttaaaggtcaaggttgggcttcagaccttggtttttgcaccgatcattggtcatactgcagttcctcactcttctcttgcaaatccatacacagctagtccaagagagctgaacagctttgtggttggatcagcaccaatgtatctccacctgtagacgggtcgctcaggtgactcatgcctgtaatcccagcaccttgggaggccaaggtgggaagattgcttgaggccaggagttggagacaagcctgggaaacacagtgagaccccatatctaccaaaaaaacccctttgttttaattagccaggtgcagtggtgtgcacctatagtcccagctactaaggaggctgaggcagaaggatcatttgagcccaggagtttaaggctgcggtgaaccatgatcgtgccactgcactccaacctgggggaaagaaagagaccttgtctctaaaaaaactaaaaaacagaaaagcatttgttgagtatttcctgggtataaagcagtgtaccaggttaaatggaaggaaaagttgaaataatttttcaactcataatccgattgggagagactgaatgcttaccattgaagcaggaaccattgtaagcaatgtgttgtgatactgtagcaagagctgagaaaacttgggaaaagagaaaggaggaaggctcacctgagggagttggggggcttgccctacaggtgagttgtgaggtgggtctggaagtgacagatgcagtttaggaagtggacgggaggctgggtacggtgactcaacatctgtaatcccagtgctttgggagacccaggcggaaggatcgcttcaggccaggagttaaagaccagcctgggcaacatagtgggaacctatctctactaaaaattaaaaaattatccaggcataatggcacatgcctattgttccagctactcaggaggcttgcctgagcccaggaggttgaggctgcagtgagctatgatggcaccactgcactccagcctgggcgacagaacaagaccctgtctctaaaaaaaaaagatgtggatgggagggggaacggtgggtgggctgtcctcaccaagcccccaccctatctgctctccagctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctggtaatgctgggggtaatactgggtgtgagcttcttagggccaggtgggcagggcaggttggaaaggtgggaggctgagggtttggcagccctgctccagggagaggatacaggagcaggctgtgggtggggggacagtcagctccaggaagccgacttccagatgtctaggaaaataacagttggataacctgggcaacatagcaagaccccatctctacaaaaaaattaaaagattagccaggcgcagtggcatgcacctgtagtcccagctacttgggaggttgaggcaggaggattgcttaagcccaggagttggaggctgcagtgagctatgaatgtgccactgtactgcagactgggcgacagagcaagaccctgtctcaaaagaacagtggccaggtgtggtggctcacgcctgtaaatccagcactttgggaggctgaggcaggaggatcgcctgaggtcaggagttcgagaccagcctggccaacatgggaaaaccctgtcgctactaaaaatacaaaattagctgagggtggtggtacacgcctgtaatccgagctactcaggaggctgaggtaggagaaccagttgaacccgggaggcggagtttcagtgagccaagatcgcaccactgcactccaacctgggcaaacagagttggagagtaggaggcttggggcctgagctagggggaaaaagcagaggcaggtgggggactggggggcagtgtgctgggtctggtgagtccctcagtgagtcccccagctcaccttttctcctttttctgcagggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtaagtgtcccgtggtcctaccaagctttcctcgagtgttctctcacctgggatttggggtgaagggtgggttcccagagagtcatcactgctgggttcttgagaccatggagatgacaaaaaggagaattgatctttgtatcaaagagttgagatacagggccaggcctagtggctcatgcctgtaatcccagcactttgggaggccaaggtgggcagatcacctaaggttaggagttcaagaccagcctggccaacatggtgaaaccccgtctctaaaaaaatacaaaaaattagcccagcatgatgggcgggtgcctgtaatcccagctactcaggaggctgagacaggataatcgcttgaacccaggaacagaggttgcagtgagctgagatcacgccattgctttccagcctgggcaactgagcgagactctgtcttaataaataaataaaagagttgggtacagcatatttgggtcgcagaaggatgcagagatggagggcagggttgagaggtaacatgtctgtatcatagcccaagagctgctggggccttcagccacagagagcttcaactccggctaggaggattcctggatctgttattttttggggggctgtggctcctatcctaccatcttccaagtcaccatttcctgggcctgttagcatctttgcttttcctggacagcctcacccagagcttcttcccctctttccaggtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcgggtgaggactgcagagaatgggccctccttcccgctctctgcccccactccttgcccagaagtgtccgttcattggtgttgggtgggagggcctctgtccgcctctgcaaggctgggttccacctcctcccccggacctgggcctggtactcagcattcctccccatccttgccccctagggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgagtaagcagtggcaggagctggagtggggctgggagagcggggcagctggagtcaggcccacggggtctccaggggcttttggggtcagcttcgggtgccaatgctgtcttcttgcactgcgctcatgccatgcctagaagggccccagaggagcagtcacagccccatggagctgaggacccaaggactctttggggccagcctgcccgcctcacctcctcctgccatcacagccctgggccatcgcgcttccgcctctcacttctagctatctttgtgcatctatctgcattccaggcccggctctcacggtaacaatgtgtcaactcgggttctctttttccacccataaaaggagaagattgggctaggttttggagatcctcttcagcttttatgtgaaatggttttatgattccttgcctcccaaaggctgcgtatccccacttggcctttgtctgctactccccctttctgccttcccgttcctctcccaagatctcctctcaccccaggttgaataacagaaatagaaggaatagaaatctgaaggccgggcatggtggctcatgcctgtaatgccagcactttgggaggccgaggtgggcagatcacttgaggttaggagttcgagaccattgtggacaacttggtgaaaccttatgtctactaaaaatacaaaaattagctgggcatggtggtgcgtgcctgtaataccagctactgaggaggctgaggcaggagaatcgcttgaacccgggaggtggaggttgcagtgagccgagattgcaccactgcactccagcctggatgacagagtgaaattccatctcaaaaaaaaaaaaaaaaaaaaaaagaaatgtgaaggccaggtggtggctcacgcctgtaatctcagcactttgggaggctcaggtggaccgattgcttgagcccaggagtttgagagcagcctggccaacatagcaaaaccccatctctacaaaacaaaaacaaaaaaattagctgggcatggtggtgcgtgcctgtggtcccagctactcaggaggctagagccagagggtctcaggccagtctgcccctgccccacggggcctgggcacatccctccctaattcttcccagcctctctctgacccagggggcctcctctcccttttttccccttatctcagcctccagccatcagcaacctcctcttcctctccacccagctcttcctctcccacttcggccttttctttctcacactccatttccctctacggcaatctgtgcagcctcttcccccagtctcattttgcgggcttttctctcttttctttccttccctggcacccaagccaaaggccctgcctctggcctccagccctacccccttctgcggttgcacagaaggatggctgcccagctcttaaaaaaactgcccgggaactgttgacatctgttctccctcccccgctggcttttctgattggcttacaatcctgaggctaggaccgtctcaggagccaagcgaggagagcggccacagggaacctagggtctcaccaagctctcctttccttctgcagggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggtgatgggggtgatggactagatttctaaggagagtggggctgggtagggagggctttgtggctgaccgagaggtgtcagaggtctggaggctgcagggctgtaggggctggaacttggttatcagccccagggtatgtttgaggtggtggggtgggggccgagcgagatgaatcattcgcagctgcttctaacgtctccagctggctctgccaagagcctggggcacctccggggtggggctgtcccctccctcccctgtcctggttcctcagtcctggccagaggctgctgcaggagagggagggaaggccttgagctcccagccctgcccgacagccactggagagggaggctggggcaggagctggagcagggggttccgtggatggacacagatgggggccagatgttgacagctggggtagatttagaggcagtgcggggagagtgtctgcattggctgtgggggaagggaagaagggacccccccacgtgtgtacacaagcgataagcgcgcgccgaggacaattctcccattcaagatgctgcccgggcaggttctccctgcctcttggaaaggggagggggaacctcctgtcttcccccaacttacccctccaaatgccccgctttctttcttgccattttctgtgtccttttctccagggatctttctggcctccccccgggcacctgcaggggcaggtcttgacaaggaccagcctggcttaacctggtccattgctttttctttttcttttttttttttttttttttttgagacagggcctcactctgtcactcaggctggagtgcagtggaatgatcatagttcactgtaaccttgaactcctgggcgcaagggatcctcccatctcagcctcccgagtggctgggaatcctccaggcacacactaccacacccagctgattttttttattttttgtagagacgggttggggggggtctcacaatgttgcccaggctgatctcaaactcctggcctcaagctatcctcccctctcagcctcccaaggtactaggattacaggcgtgagccaccgcgcccaacctttttccatttctgcacttgagtcgccccctgttgacgtgtttgggtcagtgctggaccccaaatcacagctggggcccttcccggtccagggaggcttgtcctcaatttcccacctctacagccctcttctggagtccctcaggctcttctctgtcccctttcccttggtgacacatcacccatgttttgtacccctgaggaggtgtgggagggactcggggggtccatccagaggatgttgcccaggcccaccctcttcccctgccaaccagacatccgggctagataaggtgtcctagagagctgtagctggagaaagaaaggttaatgggcattgcagaggtgcagcagagaggccaagagtgaagacccggtgtggggagctggggtcagggcagggggctgcagaagccccctgaggtccagccccaagagctccaggctgccctgagccttcctgccacatccagctccccaccatgaatgctcttccagctagggcaagggagagtctcgctgggcaggaccctcccttcccgggtttgggtcttgcttcattcccataaaggtgacctcagggcatgtcatcccagaggataagcgcagagtataacacatttctagaactcagtatcctccctggttggttggttggttggttgtttctttagagacagggtctcgttctgttgcccaggctggagtgcagtggtgcagtcatagctcactgcagcttggaactcctgggttcaaacaatcctcccgcctcagtcacccaataattctttacatttttgtagagacagggactcgctatgttgctcaagctggtctccaactcctgatctcaagcaattctccctcctcagcctcccaaagcactgggattacaggcgtgagccaccacacccagcctgtcctccgt

SEQ ID NO: 13107 - DNA, 9308 bp, Human
ggccaggcttgtctcaaactcctgacctcaagtgatccacccgcctcggcctctcacagtgctaggattacaggcgtgagccccatctcgttctttcttatggctgcgtgttttgatactttcaaattacaaggactcagtgaaggctattcgttgccttgaacttcccaaagcatttccacaatcgatggggttctcagtaagaatccgggacttggagggcagatgctgtcaacatccccatttaacagatgtggaaactgaggcctagacctacgttcttgtccctttacaggcaaggtccctggaggaaggggttcatctagaggctcatacagataaactggaatgtacagtaaagttttggctgcctgggttcatatctaaactctgcagcctcaggtctctttccactattagaaaatggggagaaggctgggcgcggtggctcacgcctgtaatcccagcactttgggaggccgagacgggcacatcacctgaggtcaggagtttgagaccagcctggccgacatggtgaaacctcgtctctactaaaaatacaaaaaaaaattagctgggcatggtggcgggcgcctgtaatcccacctactccagaggctgaggcaggagaatcgcctgaacccaggaggcggaggttgcagtgagccgagatcatgccactgcacttcagcctgggcgacagagtgagaccctgtctccaaaaaaaaaaaaaagaaaagaaaagaaaatggggagaatgttagcacttaatttcccagtattgtgagacttaacatatgtcagcctgggcagcatagcaagaccccacctctaccaaaaatttaaaaattagctgggcatggtggctggggcacgcctgtggtcccaggtactagggaggctgaggcaggaagatcacttgagccgaggagattgaggtggcagtgacctacaatcgcgtcactgtactccaattaaaaaataagtgtcgggccaggcgcggtggctcacgcctgtaatcccagcactttgggaggccgagacaggcagatcacgaggtcaggagatggagaccatcctggctaacaccgtgaaaccccgtctctactaaaaatacaaaaaattagccgggtgtggtggcacacgcctgtagtcccagctactcaggaggctgaggcaggagaatcgcttgcacccgggcggcggaggttgcagtgagttgagatagcactccagcctgggcgacagagagagactccgtctcaaaaaaaaaaagtgtggctctcaataaatgagttgttatttcagtggcaagccctgaaagggggtctacaaaggcccagtgggcgaggctgaggaaatgcctggacacgacccttctcatggcattcccggggcgcccgcatcagcccctacccactcccgctcggggactttctcggaatcgcgcttcttcttccagcagcctcgaggccggccccgtccaggtctctttagctccgccccctggtgaggggcgtggcctcctcagggccggggcgtggcccaaccgggaactggggcgtcgaactccccttcccagtctggagccacccattccaggcggggcgggaggctgatcacgtgaccagcgagcggtctcaccctcctcatatgccagtaccacctcctccagtcccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacccccgccgcagagtcccaccgccacaggtaccttcgctggcaaaaggagtcctctcgccccccagccccaatttcccccaggggaacctctcttccttcggtctcccggggctggcctcctgggagcggacgtaactccccagacctccgctcccttcccctcttgcccggtcgctcccaaacccggaaggggaactggggaaccctcgccccccaccgtgcgtgcgcttccccgcaccatcagcgaagtttttgcccgaccccagaccccagcccagccccgactgcctcttgctccctcggaagttggggggctaaattccgggcttcctctaggccccgccccgccccctttccccaccgccaccctcccgcctgcccccggggagcacccctcgtgtcctccactgtcgcacccctgccggccctcgccttgcacaactccaaaatcggggagaagcaggcaaggccgcgcgccacccttcctttcgtctccaccctacccacgatttgggtgctgcccgtggtttctggccccactcgccgaaactggagccctcggcgccctattccctttacagatcctcaccccaagcccagctcccaggcgcccgccccccgcccagctttcttttaggcaaaatggaggtcgtaggggctggagggccaggcccactgcgcttcgcagcgccgcaccagcccgcgccttccagctgccagatccagggaccctcccgtcactctcctgagccccgccagacctgcggaggcggttgcaccctcatttctctatggagcgccggctgctatatccctagagtctgggggctgctgagggccctggggggtgatggggaccgagggctgagaacgtcgcccccgcccccagtttcttcctccagccgtgcttccttctgccctgggcctccggcggtgccgccaggcctgggctgctagtaggtggaagaggctttgtgcgggcctgggggttgggtagagtaaggagttctgcccgcaccccccatcccccgattttgagggtcaccccttggcactggcgtagaaagctgaacttacaaggaggggaaatgtcagtggggaagaggaacgccctgcgcctgggggaagtgggagctgggtgggggacgcctgggccggccaagtgcagtgtgtacggccggatcgcacaggtgtcccgcgggcggggaaggactcaggctcccggagcggagccagccgggcccctggggcccgggcgccgagcctgcgggctgggccccccgggtgtccagggcgccgcggccaggccgcctggggccgcccgcccgcgcctgggagagagcacctccgcgcctcggggccggggacctcgttgcggagccgtaattactcgagagcggctcccacgggctttctgcgggcgcggcggggcgggcggtccctgcgctggagggagcagcggctcggggctgccttccccgccgctgtcacccccacccgcggcggacggctaatggggcgcagccggaccggggattatccggggtgagccgtccagaacctattagcgcccaatcggcttttcccaaatcctgtaaacagccacccgggccggttctggggagggcgggaggctgggtcgggcgggggcgatggggccgggggtggggtcacccaccctacaggtctctgccgtggatgcggttgccttggcaacggggctagggtgggggcatttcaccaatgaggtgctctcggtccgggtgacggttgcctaggcaaccccacgaacagcccagctttcccctctggtctctccccccacccgccaccatcgaagctgggggtgtgtgtggagggtgtgcgccttgtggggtgaatttcaagaggcaccgccccttttaaaattaggtgcttggagggcggtgcctgtgcgggctggggcagaagccaggtctgttttcgaagggacacccccgccccccccgccccagttcctgccgcgggtgtcctgcccgggctgtgtccgagggaggggtttcccctgcgcttcctcttgcacttcccgctccgtttccggggggcgggaggaagattggggaagtcggctcttactcggcgacgtctctggtgccggagaccctggttgtgcccggggacggcggccgcgccgccccttccccctccccttgcttaccccttccgggccgcgctgcaaccccgcctttctccccacttccccggcggcctcgggcctgacgtcagccctgcatcccccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggtgagggcctggtgcggggcgggcgattcatgtgtacaccgcccggtgccctggaccgggttgggtgagggtgttggtgggggaagggggagggagggccccttaatggctcagaatctgaccctgtccactcctgtcttctgttctcttctctccctttcctccccaacctgtcttctctcgcgtctctctggctctgccatcccttacaggatgcccgaaaagcatgtggggactcaacactgacccaggtgagggcacttggtggccagagcgtaactaggggttgaaggggcaaggatcagaggccgctgccctctgcagtcctgctgcctgggcctccccgagcgcattctgtctctacctccagatcacagctgggctggacccagtggggagaatccagatgaggacccggaggaccctccgtgggcacctggcaaagatctatgccatgcactgggggaccgactcaaggtgtgtgtgtgtgcgcgggctggcgctgtgggccgactttctagcaggccgtgggagcagcctcagatctggcggagtaagcaggccaccaaaatacccagcgtacgtctggaaaaacggtgactcccagacatgtccgccagacctggacaggcaggaccatgctggtgagaacttgtgggctgcagctggagactgtctctcaggtggctcacgcctgtaatcccagcacgtggggaggccagggcaggatcacttgagctcaggagtttgagaccagcctgggcaacatagtgagaccctggctctactaaaaattgaaaaatgagctgggtgtggtggtgctcaccttgtagtcccagctatgcgggggaggctgaggtgggaggatcacttgagcctaggagttccaggctgcagtgagctgtgatggtgccactgcactccagcctgcacaacagagagagaccctaccttctcccacccaaagggaagggggtgtgtcttgttttcacgccacccttctgctctccctacaccgttccccaccaggctgctggtcagcgcctcccaggatgggaagctcatcatctgggacagctacaccaccaacaaggtagggtggcgcgggctgcggggtggggcagggccacagggccctggctggctctgaccccggcgcttcccctgctccgcaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactggtgaggggcctggcccagttcgggccctttttggggttggggggtgcactgccctccgtgtggagacctggctgaccagctccttccccagggtacctgtcgtgttgccgcttcctggatgacaaccaaatcatcaccagctctggggataccacctggtgaggctctgccagggctgggcagtctgggcaaacccacacttcctgcctcaggggccaccgtcccagtgctcaacatgcagcatgcaccgtagcctccctctcctggtgggcgctaagggggtcagggagggatgcgtcccctccccacctaaggctctgagaagagcctccctggacccttccacagggttgggctcacgtggtggggcggggagaacagggactctgttcttcgccctgtctcttatcttttctttcttcctgtcacctctccagtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctgtgagttttggggcgagctaggccaggccctccccaccaggctcccggccctgctcctcaccctcaccctcaccccatctgggtcccgtgtcctgcagttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggtgacagctggggcccaggctgggtgggcagggacctggagcccaggcccaatgggttctgacttctctcttcttcacaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctggtctctgcccttgctgtgttctccttgtttctggactttgttgcctgagggctgctgagggggtggatggtggggaaggtatggggcctgccaggcagctggggctgggggtggggtccccactctccctcagagcaaagctgaagccccagcccagagccttccgtccagaggttctcggataagcagccctcaccatggtttcccccgtcaggctgctgaccagagccagcctgaccaggcgggcactgctcagagctcctagttcccagctctgtgcagagccactcatccccatggctctccccagataacgagcagtggaggcggaacgggagaacacacaccaagttttattgggagaagggagtatttacaggagcaggtaaaagagagggaagtcacacagggtggagagggggcggggagactgtgggtacaaggcagacagggaacacggtgacccctgcacccaccccaaccccaggaagggcaggggagcagcgagggcccaggaagaccggggccggggaaggacagcaacagggtctgagtccctgggcaggggggctcaggggcttgtaaacattgaccactctcagaaggggatgggggtgggagagggctccccctatacttcctcacagggttaaggcctctccaggctcatgggccccctaagtccaaagtctctttagctggggagaagagacaggaagagtgtcccccttcccctgcattggctgcggcaggggtgggggggttacattcagtcacaacaggagtctcccccacacctggcaagagggaaggggagctgggggccagcagcagcaaacactccccccggcccgtcaccccttattgctttagagagaatattgtcttttcagggacgctaacactgtgggaaccagggagaggcaggtgggggccccccaccccgaggccagcttgatcccccaacactgacctagttgccactttggtgcaaaaaaaaaaaaaaaaaaaaaaaaatccaacaacagaaaaccaaacaccatctttctgggactagatggggaaagaaacgggccactccccatgtccccagggcaggagggagaaatacattcatggagggaggcagtggcgaagccttgccctaatactgcactctgagcaatgaggtcaatgggaggagctggatgagaaacccaaaagacaaaactgttacaaaacccaaaatgggcggagacgaacccaagtaggggaccgggaataagaagtgggtgagcaatagaaggggcagcctcctctgacccaggagccgcacacttctcttcaccccaaccttacccaacggtaaaaagcgcatcatatcagacccggaaggccacctgctcctctcccatttggtcagcggaagggtcaggtgcagagctgggtggtccacatcttacgagctggctacaggttggggccccgggcggcagcccctctactccaaccctaagcccaaagccacccactccttgcctttgaggcccctcctcctgcccccttcactggagaaacagctcagccttctctctgcagcctctggagcaatcatccacccccgccgctcacaggggtgaggcagctcaggcaggggtgaggcgggggcttgtggcccaaagaatacattcacgtggcaaggcagagagctggggctttcaggttcaaacccagggtgtcccccaaaatggcagcagtgggagacgcccctcaccagagccagagtcctgctgccccaccctgccagccagagaggttggcacggcttggcccctcccgtctactcggccagcacaagatggcagccagagagctggggccgctcgtccaatttgtgcaactgtcccccaaagcagcgaagccaaggggctactttggccccaccccggacacctcagccagcctcagtgacaggagctgctcacaacaggtctggcgggtggggctcagacaggc

SEQ ID NO: 13108 - DNA, 24818 bp, Human
ttattgattgaatgatatgaagaggatactctccctctgaatatgaaaggggacagaccgaggaggggaggatgaggtggggaggggcttcagagggatgtgaacccaaggggtggttggggcctgttggaggattcccaggggctgcacctgcctgtccacacctccctccaaggccaccctgaccctgatattaccccctccacccagggcactttccagcagatgtggatctccaagcaggaatatgaggagggcgggaagcagtgcgtggagcgaaagtgcccctgatggcactcctccccacacacctgctcccaagctcagatggaagtcccttaacccccatgccacattgcccccctcctcctttccctcttgtcctcataaatggtgatgtttctgggttgaaagaagtaaaaatgttttaagaaaaaaaagtttggcctccgtggggtggggagtgggcacaggggtctggagggaggtgaggggagggagtctcacttctacacccatgccgatcccacagtgggtgctgggacacagccccaggggccatggattcctcaggtttcctaggggttgtgacccagggagggccacatgacgaggaccgggggttgggggagttgctgggggctaacagttgtggtgggaggtgggaggggctgcagggtgcagtggaggggcacggcctggggtgagtgtggcaggaggtgggtggagcaggaggtgaagcctggatgggcggaacaggaggtggggcctggtgggcggggcctcagcgtaggccttaggtctcaggggagcagcacgcctgagcaccccaggacctgcgctcaggtgagatgcgctatgccctccttcctggggctcttggtggtgacagacatggggcggggactagggcgctggtgcatcccagcagctcggaacttctctggacctgagtaggagctgatgttccccaggggaaacccgaaagggaaacttggtgggaccctgagccctcctcttcagagctacttgtcttggggccctcggaagggtttggggacctgcgccccctgcctgtttagcagtttatgcctgtgacatgtttctggggtgaggctaactggcctttcatcagcctcagaacccaaagaggtagaaacccatgtgatccaagtccttcggtgaccaaacgggccggtgcccagggaggaccatgacttgtccagggtcacccagctctgcccacaccttggcggggactctgatcactcctccccactgacccacatatccctgaccccaggacccctatctgggagctctcgctggtctcatctgaccatgtgctcccacctgtgcccctccttctccagcagccagcaggagtctgagaacgacctttcaaaagagacacacatgcacaccaccagaccagacccccaagtcacaccactgtggtgcctccagcttagaatgccactggggcaagtgtcaggacagggaggacagctgatatgtcacaggaccggggcactgggggactctgaaggccagatgaggaaggggcagatgtcttaggggtgaatcttccacctgggcatggcggggcttaggaaggggtccccaggatccagggaggggtaaaagcaggagaggggagggggcacccatgtctctgccctcccccactatcggcccccttcccccacccctgatgggaactaggaggccaaagtccgccccaaggtcaaaaaattgattgttttgcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcggtaagactagtgggattgggaagaccccttaggccttctctctaagtccctcagccccctcccaagcccctgaggctggcccctcctggaccgtgtcctgacctcgcttcttcccacccctgcccctcccccacgcccccaccaccatgctcatttgacacccccaagtcactgacctcattattgccagatgcctccccaccccccaggcctcttgccccaatctcatgcccacctcgcctgcacagcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactgggggtgagagccgtccccctccccagaagtgaagggcttgggctgggggagatttctggggtccagaggtgggcataaagagaatccccatcttgccacccgccagccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggtagggatggccctgccccatcctgttctcgagtgtccctcccctcatccgctcagactgggcctccctgcctcctggcccaggcctctggtgtctgggtccccctcctgagtcctcccatctgccttcctggcccccctgttcagcggtcctgggaaggatggcaggcattcggagctgaggttccaggggactgaggctctgagggtggcatatttgggaggtgagggagctgactgtctgagatcagaggggtgcagcatccagtatcagactggacagacccagaaaagccttgaatgcctcacccaggcgcctagatttggagcagggagcgctgaggggttctgagaagccgcattctagggaatcagaaaaccaagcaagcaagcctgggcaatacgatgaaaccccgtctctaccaaagaaaacacaaaaattagctggggatgatggcgagtgcctgtagtcccagttacttgggagcttgacgggggaggattgcctgagccggggaggcggaggttgcagtgagccgagattatgccactgcactccagcctgggagacagagcgagaccctgtttcaaaaacaaaataacggcagggtgcggtggctcaggcctgtaatcccagcactttgggaggcggaggcgggcagatcactaggtcaggatatcgagaccatcttggctaacacggtgaaaccccgtctgtactaaaaacacaaaatattagccgggcatggtggcgggcgcctctagtcccagctattcgggaggctgaggcaggagaatggcttgaacccaggaggtggagcatgcattgagccgagatcacgccactgcacttcagcctgggcaacagagcgagactccatctcaaaaaaaaaaaaaaaagaaaagaaaaaaagaaaaacaagtaagcaaatgcatttgtgggtgcagatccagaagctaggtccacccatagccctcttttgggacgggagtaatttttcagtggattcgcctgggttttctaagtaggtaatcagctaagctacagatagtaggagatggagattctcttttccaatgcttataccttctacgtttttttttttttcatttctcattgcatttgagaggacatgaatttaaggtaaccgtggcagtaggtatccttgcctatttcctgactttaatagcaatgcttttataatactttgccattgacaatgaactttgctgtgctccagacagctttttaaaattgaattaaggaagtttcctttcactcctagctcactgagacttttattgattgattgattttttgagacggagtctccctcttatcacccaggctggagtgcagtggtgcaatcttggctcactgcagcctccgcctcccaggttcacgcgattctcatgcctcagcctcctgagtagctgggattacaggtgtgtgccatcacgcttgattaatttttgtattttttagtagagacagggttttgccatgttgcccaggttggtctccaactcgtaagctcaagcgatctgccaaagcgcttcggcttcccaaagtgctgggattacaggcatgagccacagcacccagcctcttctttaatgtttatatagtaatttgtgttaatagatttccttatcttcctgagctcaacgctaaccttgatcaaggtgtatgattactcttttgatatgttgctgggttcacctgctgaaagaccttgagtctgtggaatcaacaatgttcagggctttatttttttgagatagggcctcactgtcacccagacagtgccgagatgatagctcactgcagcctccaactcctggacccaagtgatcctcccaccttagcctttcaagtagctaggactacagatgtgtgccactatgcccggctatttttttttttttactttttttgagacagagtttcactgttgcccaggctggagtgcagtggtgcgatctcggctcatggcaacctccacctcccaggttcaagcaattctcctgccttagcctcccgagtagctgggatcacaggtgcctgccaccacacccaaccaattttttgtatttttagtagagatggggtttcaccatgttgggcagactggtctcaaactcctgacctcagatgatccacccaccacggcctcccaaagtgcagggattacaggcatgagccaccatgcccagcctaatttttaattttttttagtagaaacgaggtctccctatgttgcccaggatggtctcaaactactggcctcaaacaatcctcccacctcagcctcccaaaatgctgggattataggaattaggtaccgcacccagcctgctcagggcttttaaattaaattacaggtcaggcatggtggctcacacctgtaatcccagcactttgggaggccgaggtgggcagatcatgaggtcaggagatcgagactatcctggctaacatggtgaaaccccgtttctactaaaaacacaaaaaattagctgggcgtggtggcgggcacctatagtcccagctacttgggaggctgaggcaggagaatggcatgaacccgggaggcggagcttgcagtgaaccgagatcgcgccactgcactccagcctgggcgacagagcaagactctgtctcaaaaaaacaaaacaaatacaaaattagccgggcgtagtggcgcatgcctgtaatcccagctactcgggaggctgaagcaggagaatcgcttaaacccaggaggcggaggttgcggtgagtcaacgtcgtgccattgcactccagcctgggcaacaagagtgaaactccatctcaaaaaaaaaaaaaattaaattacattaatttttttttgagacagggccttgctctgtcacctaggctagaatgcagtggtgcaatctgggctcactgcagcctcgatttcccaagctcaggtgattctcccatctcagcctcctgagtagctgggtctacagggaggggccaccacgcccagctaatttttcatttttcttttttcaaaattattattattatttagggacaggatttatttatttttatatatttgcaaccaattctcactctgttgcccaagctggagtacagtggcatgatcttagctcactgtaacctccgcctcccggcttcaggtgatttttgtgcctcagcttcccaagtagctgggactacaggcgtgagccaccatgcccagctaatttatgatttttttgtttgttttttgtttttttcttttttttttgtgagacagagtttcactcttgttgcccaggctggagagcaatggcacgatcttggctcactgcaaactccgcctcccgggttcaagcgattctcctgcctcagctccccgagtagctgggattacagtcatgcgccacgacacccagctaattttgtatttttagtggagatggggtttctccatgttggtcagtctggtctcgaactcctgacctcaggagatccacccacctcggcctcccaaagtgctgggattacaggtgtgagccactgcgcccggcaatttatgtattttttttagggacagggtttcatcatgttggccaggctggtttcgaactcctgggctcaagcaatcctcctaccttggcctcccaaatttcttggattacaggcgtaagccatggtgcccagcctgttcagggctacttttatttttttgagcagtatttggtcatctgggtacaggctgagcaggtagatagtttgacaggtctagaagcggggtgtggcactgaggcaaaagtagcagttttggggagagagcaaggatgttgcagtgagccgagatcgcgccattgcattccagcctgggcaacaagagtgaaacatggctctcggtgggatggagagggaagagaaagtggggggagatgatacatgtggagctataggacatttgtcatgttcaatggggttgaagagcaggtacagcgaggataactgggggagttggaacctgacagggtctactcagagagtaggattctggatccttgaaaacttcctgatacaatatatcctgtctatctcagagtctccagcacctaccacaatgcctggcacttactagatgttcagtagatcctcaatggataagtattccagagatggagtgcgggtaatgacaagatgcaggatacgggccaggcacagtggctcacgcctgtaatcccagcactttgggaggtcaaggcaggtggatcatctgaggtcaggagtttgagaccagcctggccaacatggtgaaatcctgtctctactaaaaatacaaaaattaactgggtgtgatggtgcatgcctgtaatcccagctactcgggaggctgaggcaggagaatcacttgaaactgggaggcagaggttgcagtgagctgagatcgcaccaatgcactccagcctgtgaaacagagcaagactccatctcaaaaaaaaaaaaaaaaaaaaagatgcagggtgtgaccagggaagtggagtgcctggactggaggtgacaatgatgaagtaattaattcatttatccaacaagtattttggggcatctactacgtggcaggtactaagctaagcaggtggtggtgagatagagactaaaacagtctaactttgttctcatggtgcttacaatccactggagaaaaccaatactaaactaacaatcattcacgactacataattatgactggaatcattgctttgaaagaaaagcaaaggatgtgaggctcagtgtggtggctcacacctgtgagcccagcactttgggaggctgaggtgggaggatctcttgagcccagtttgagaccagcctgggcaacatagagagatcctgtctcttaaaaaaataataataatttgaccaggcacggtggctcacacctgtaatcccagcactttgggaggccaaggcaggtggatctcctgaggacaggagttcgagaccagcctggccaacatggtgaaacactgtttcaccctttttaggctctactaaaaatacaaaaaaaattagctgggcatgttggcgggcacctataatcccagctacttgggaggctgaggcaggagaattgtttgaacctgggaggtggaggttgcagtgagccaagattgcgccattgcattccagcttgggcaacaagagtgaaactccatgtcaaaaataataataataataataataataataattttttaaaaaataaaaataaaaaattagcccagtatggtggtgcatgcctagagtcccggctattcaggaggctgaggcaggaggatggcttgagcttaggagctgaaggttgcagtgagctatggtcatgccactgcactccaggctgggtgacagagtgagaccctatctccaaaaaaagaaaagaaaaggggccgggcgccatggctcatacctgtaatcccagcattttgggaggtgaaggtgggctgattgcctgaggccaggagtttgagaccagcctagccgacatgccgaaaccctgtctctactaaaaaaatacaaaactagctgagtgtggtggtaggcgcctgtggtcctagctactcaggaggctgaggcaggagaatcacttgtacccaggaggcagaggttgcagtgagctgagattgcacgactacacaccagcctgggcgacagagcgagactccgtctcaaaaaaaaaaagaaagaaagaaagaaaaaagaaaagaaaagtgtgtaaagaaagactataaccaggatcctgatttagattgcagttcagggaaggcttcgttgaggaactgacgagtctaaactgccaagatgagtaatttgccaggcaaagagactgtggaaaaacattcaggctgagattcaccatttgcgaagggtctgaaatgtgaagatggtggcctcttggaggaagggaaagatggtccatgtggccggtgaggtggatgtagctcaggccctaaagggccttactggctactttaactgttttgaattgaattttcctgcctcatccctgagtgatcctccccactcccctccccataagcaccttatctcacgcttttgatgtgtagctttaaatacacatatggggcgggtcgtcatggttcatgcctgtagtcccagcactttgggaggatcgcttgaggccaggagttcaagaccagcttgggaaacacagcaagacttctcgtctacaaaaaatttttaaaaatcagcggttggtggcgtacacctgtagtcccagctgctcaggaggctgaggcgggaggatggcttgagcccaggaaccggtgattcccctgagtaccttggtgtaaagtgtctccatgaggcccacgtggaggatgggggagatgaggagggtctgctgcctgcccagttagctctttcgaaggaaagtgtttgggtgctgtgtgtgtgtgtgtgtgtgtgtgtgtgtgtgtgtgtgtgtgtgttgacgtcgggaggaacgaggttgggggagagagtttggcttgagccgggaagaacctacaggatgatgggcaggacccccagctatgggaagtcaggttttaagcagagtgaggtcctgagagtctccggcgccgccctggtggtgatgggagaaaatgggtccgcggagggccctgcactgcggctcgcgcctgtaatgccagcactttgggaggccgaggcgggcagatcacctgagatcaggagtttgagaccaacctggtcaacatggtgaaacccgtctctactaaaaatacaaaaattagccgggcgtgatggcacgtgcctgtaatccctgatacgagggaggccgaggcaggaaaatggcttgaaccaggaaggcggaagttgcagagagccgagattggtccactgcactccagcctgggcgacagagcgacactccgtctcaaaaaaaaaaaaaaaaaaaaaaaaagcgtccgcggggagcgctcttttcctaaactcaggaacccctcgccgcccctgcccctggcgaccccacgtctctggcatccttccctcttccctccctctcctccgggcgcccagaaaagtccccacctctccccgcttaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccgtgagtgcgcgcgcgggcggggggcgcgcggggagggggacgcggctcggggcgctcaccagccccgctccccagggctcaccccaacaccctgcactgggtcgatgaggccgggaaggtcggagagcagctgccgctggaggaccctgacgtctactgcccctacagcgccatcggcaacgtcacggtgagcaccccctgcccgctcctaggatggggcgcggcacgagccctttcctgggtctcgaaggagggacgcggggagcgcgcctcaccgtcctcgtgtccccagggagagctggtgtacgcccactacgggcggcccgaagacctgcaggacctgcgggccaggggcgtggatccagtgggccgcctgctgctggtgcgcgtgggggtgatcagcttcgcccagaaggtaagtgtccctggacagagggagggcttgagcccgggaaccggagggtcggactgccagtgagaatcgttcagggtgctgtgagagggagacaggaaagaaccatgtggctggatggtaagaaaatataagctgggcacgatggttctcacctgcaatcccagcactttaggaggccaagacaggaggatcgcttgaggccaggaattcaaggcaacacggtgagaaccccctctctactaaaaaaaaaaaaaaaaaaaaggttctttttttttttttttagttagctgggctggtggcacatgcatgtggtcccagctactccggaggctccggtgggaggatcgcttgagcccaggagtgccaggctgcagtgagctatgatcgcgccactgcactccagcctgggcaagagagactctgtctcaaaaagaaaaaaaaaaaaaagagagagaaacagagaagggagggagggagggaggaaggaaggaaggaaaatgttggctggtctgggaattgaatcagaaggaaaaaagaaaatgttggctgggaacaaattgggtgttgggggaaatcagatggggaagggaacagaaacatggggtaccctggagcccggtggggtttgagggctgcctaggagctgctgaggttgggaagacacaggccaggtagtgcccccacatcctctccgtgggatggacagttgcaagcaaaggccttgccatttcctggtttctcctgcccttatgaatcgggtttttttctgggaggagtcctctagtcaccttcctccccaggtgaccaatgctcaggacttcggggctcaaggagtgctcatatacccagagccagcggacttctcccaggacccacccaagccaagcctgtccagccagcaggcagtgtatggacatgtgagtctggggaggctggtcgtgctgttcccaggtcccgaggccacaccttcttgctcagaatagggctggcatgtttttcgtttttcctggaagcccagctcgcagctttgcgtgggcacccctttccctgcaggtgcacctgggaactggagacccctacacacctggcttcccttccttcaatcaaacccagttccctccagttgcatcatcaggccttcccagcatcccagcccagcccatcagtgcagacattgcctcccgcctgctgaggtgaggggagtgttggggaccagaagaggaggaagcagagagaggaaggctgcagcgaggccacagggtgattgtgggtgaactagaaaaaggtgactcttgtttaagcctgcagtgagccatgactacaccattgcactccagcctgggagacagagagaccctgacctttttttttttttgagatggagtcttgctctgtcttccaggctggagtgcagtggtgcaatcttggctcactgcaacctccacctcccgggttcaagtgattcttctgcctcagactccagagtatctaggattacaggtgcccccccaccacgcccggctaatttttgtatttttagtagagggtttcaccatgttggccagactggtctcgaactcctgacctagtgatccgcccatctcggcctcccaaaatgctgggattacaggtgtgagccaccatgcctggccgggaccctgactctttaaaaaaaaaaaaaaaaaaaaaaaaagtgactcttctggatggacacagcctttctccagggtctactgtctggcaactaaagttcccactggattgcacacctacctcagctgagaaccatccaaggcagccctgactgcactgccctacccaggcagcgtccagaggcagcgatctggagccagaaagggtgggagggaaagaaataaggaaaagagtgatttggactcttctgggtctctctacaacttccccctttctgccttcctcctctccaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccaggtatgctgtgtgtccagtatcactcacagctggtggtgggctgggggaatttctgcccatacaccctggcaagatagggggctggtgcaggaggccccaagaggggacaggagtggtgcccagaggagggaagctggcaagttgaggctgaactgggtctgatggtggcagcagtgaacagacctcaccttccagcctgtctagtgatggaatgggggttgttgcccagtagtgagctccccagcactggaagtgagtaagcctaagttggatgatgttgtaatagaaactcaagcatgggccgggtgtggtggctcacgcctgtaatcccagcactttgggaggcccaggcaggtggatcacttgaggtcaggagtttgagaccagcttggctaacatggtgaaaccccgtctctactaaaaatacaaacattagctgggcccggtggcatgcatctgtaattccagctattccggaggctcggacaggagaatcacttgaacccaggaggtggaggctgctgtgagccgagattgtgccattgcactccagcctgggcaacagagcaagactttgtctcaagaaaaagaaaaaaaagagaaagaaagaaagagagaaagagaaagaaaaaaagaaagaaagagagagagagaaaggaaggaaggaaggaaggaaggaagactcaagcatgaaagaaagatcagatcagattagatagaagcatagatggccctttcaagcatagctagatgtggatggcagtggagaattaaaataagtaattgacagatggggcaacaaagccaagacttcacaaaaaatttaaaaataagagaaattggctgggtgcggtggctcacgcctgtaatcccagcactttggaaggccgaggtgggcggatcatgaggtcaggagatcgagaccatcctggctaacatggtgaaaccctgtctactaaaaatacaaaaaaattagctgggcatggtggcaggcgcctgtactcccagctactcaggaggctgaggcaggagaatggcgtgaacccgggaggtggagcttgccgtgagccaagatcgtgccactgcactccagcctgggcaacagagcgagactccaaaaaataaattaaataaataaataagtaagtaagtaaaagaaattagccgagcatggtggcacacatctgtggtcccagctacttgggaggctcaggcaggaggatggcttgagccagggagtttgaagctgcagtgagctatgatcacaccactgcacactccagcctgggtgacagaaaccttgtaagtccagaatgacctcaggcacccagctgaaggagcacaccatccaggaagggccaagtggggaggggcgccctctttagggactggagggactgcagggctagggttgccggaattgtgatgggctgagagacacaggcagatggaggatgcccccagggtgcagggtgcagtgtcagaagtgggtcccaaacatcccctccccagatcactacgttgtcatcggggcccagagggatgcatggggcccaggagcagctaaatccgctgtggggacggctatactcctggagctggtgcggaccttttcctccatggtgagcaacggtaaggtcagggccagggcctgggcctgggctaggcagcggtgggcctgtggcccgaggaggatagggcagagaggcagtgagggacacagactggccagtggtcacttggacctcggcatccacattgtacctgagtggccctgggccagtcacttcacctctatttcgtcacctaaaaatgaaagtgaggccgggtgcggtagctcacacctgtagtcccagcactttgggaggccgaggcagatggatcacctgaggtcaggagtttgagaccagcctagccaacatggtgaaaccctctactaaaaatacaaaaattagccaggcgtggtggagggcgcctgtaatcccagctactagggaggctgaggcaggagaatcgcttgaacctgggaggcggagtttgcagtaagccgagatcgcaccactgcactccagcctgggcaacagaatgagcctccatctaaaaaaaagaaagaaaagaaaagaaaaaaagtgacatgaatgataatcatagtccatgggtctgtgtcaagattaagcatgttgggctggacgtgatggctcatgcctgtaatcccagcactttgggaggccaacacaggagaatcgctggagaccaggaattcaaaaccagcctgggcaacatagggagactgcatctctacaaaagttttttaaaaattggctggacttagtggtgcatgcctgtaatcccagctacttgggaggctgaggcaagaggatgacttgaacctgagaggtcaaggctacattgagccatgattgcaccactgcactccagcctgggcgagagagtgagatcctgtctcagagagagagacagagaaacagagaccctgggggaccaggacagaagaagacaaggggagggtctttgcttggcccctgctaagcctgtcctccttcccctctgtccccaggcttccggccccgcagaagtctcctcttcatcagctgggacggtggtgactttggaagcgtgggctccacggagtggctagaggtgatacggggtcccgggcaggtcgttaggcattggggagaggtgggggtggggggttcccactccacactggtcacccacccacagggctacctcagcgtgctgcacctcaaagccgtagtgtacgtgagcctggacaacgcagtgctgggtgagctggggcagtgccaccacctggccccctggggtccacccttgcctctggggctgagccctgagcctggcatccctcccctcccctttttccaggggatgacaagtttcatgccaagaccagcccccttctgacaagtctcattgagagtgtcctgaagcaggcaagagcaccccaggaatagggggtgaaggggagtaggttgcggggaggagcagagcctgatcagtgcccttccccaacccccaggtggattctcccaaccacagtgggcagactctctatgaacaggtggtgttcaccaatcccagctgggatgctgaggtgtaagttgggggggtagggagagctggggagggatgtgggggagcctgaacccacagatcgctccaacccacctgcccccaggatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggttcaagaggcccaccccgctcttggtctctgggagtgggaggcactgcccaggccagggggtccagccccttctctctgcattccctggggtctaggtcctctctggcaatccagcccattaaccccctgcctccagtctcccagcccccagcatgtgccatcgcccaacctggcaggtgcaggatcttctccccactcccttcatcctgcctccagcactctgtcctcgtctacctcctccctcctgcggccaggggtcccagcccccttccccatgctaggcgggggtccttgtccccatgctaggcgggggtcctggcccctgccgccagccccagcccgcgcctccccaccccaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtgaggccccgccctcctcgccccgcccccagtgtcccgcccctcccctggggctccacctcctggacctggccccgtctgcgcgctcctctctctccccgcctacacagtcccggtcctctggatgctctcttcccagtcctggacacgcagtgctcatagatcggtcaggctggaggacccgagcgatcaaagtgatgaaatggacagggagggccagcctcttggccacagtcgcctggtttacgcctggcagaactgggacaatccaccctcccccacccctccccgctgactcccctcctatagctcccactgcctcctcgacccttctggaaagaaaaagcatgtccacactggtccacaatacgaggttacaggctgggaagtgcagaaggctaaagatattcagagtaagagagctgttttccttctgataatgaaatgggtgaaatccagaaaggctgcctggaggaggtgtcacgtgaaagttaaacaagagcttattccctcaccaatcccttctgcttagctttgaatcctttgcagcccacaccccacctccagttccaactcctccacttccttccattttcttactccaagaactcaacccctcaaccctttgatgtcaagaaatgggtgagtagggactgtggccatggggaaaggtctgcagggcaaaatagtaaacaggatcatcctcaatgagtgtggggtgagctgggaactgcagtgtacacagagccacttgtgcacacacactcacggttttcagagccagcatggctaccccttggaggctcatgttatctctcctccttgcattttcctgcttgtgccctctgcctgtcccccttggccatttacaaacctattgctcttgctcgttctcccttgcccagactagagtgcagtggcaccatctctgctcactgcaacctccaactcctgggctcaagtgatcctcccacctcagcctccctagtagctgggagtacaggcacgtgccatgacgcccggctaaatttttctattttttgtagagacagggttttaccatgttgcccaggctggtctcaaactcctggcctcaagtgatcctcctgcctcggcctcccaaattgctggggttacaggcgtgagctactgaacctggccttctcctctccttcttatatctctttctccattcattcttctttaacctttgcctcctctactggaacaggggtgaccctggggtgaggcaataggttgggtatggttcattctcattcacagatcttggtttaacctcagctgtgtcagcatgcagaagacaaaaagacacccacctttcaaagttgccatacccctgtccccaccagggataaaagggacctgcgtgtaagatgcatgacttaggccaggcacggtggcttacgcctgtaatctcagcactttgggaggctgaggtgggcggatcacctggggtcaggagttcgagaccagcctgaccaacatggagaaaccccgtctctactaaaaatacaaaattagctgggcatggtggcacacgcctgtaatcccagctactcaggaggctgaggcaggagaatcacttgagcctgggagatggaggttgcagtgagccgagagcacgccattgcactccagcctgggcaacaagagcgaaaatccatctcaaaaaaaaaaaaaaaaagaaaaagaaaaagaaaaagatgcatgactcaggctcagggatggagagggaaggactcaggacttcagagcctgcaatacaggattgggccagacccagtgaattttatggctctagaccaggggttggtgaactactgcccattggccaaattcaaactgccgcttgtttttttgttttttttttttctgagacggtctcactctgttgcccaggctggagtgcagtagcatgatctgggctcacggcaacctccacctcccgggctcaagcaatcctctcacctcacctcagcctcctgagtagctgggactacaaggacacactaccacactccgctaatttttaaaattttttgtagagatgggatctcactatattgtccaggcttgtctcaaaatcctgggctcaagcgactctcccacctcagcttcccaaggtgctgggattacaggcgtgagcctctgctccctgtttttgtaaataaagttttattgaaacagccatgcttattggttttcacgctctctatggctacttttgtgtaatagcagcaacgttaagtagctgcaataaaagcagcatggcctgcaaaatctaaaatatttactatctggcatttcacagaaaaagtttgctgaccttggctttagactgtgacttggatcttgaagaacaggcaggatgtggattgatgcaaagtaaagaggacatttcagggtggagagaccagaattcgggtgtggcagtgaaatcagtctggttttacttggaagcggggtgtggaccagcagagccagaacaggggccccatggagaggcagaggggagggaaccaccaaatgtggtgttatcgatcaactgtggggagcctcgaacaccaggattagaagtttggatgttaagggtcttagcatcaaggaaattagagaggtttttgagcagagaggtgatgtgagcaaaggggagtttttatttttatttatttttctttctttattttttggagacagtgtcttaatgtcacccagactggagtgcagtggcgcgatcccggctcactgtaacctctgcctgtcgggttcaagtgattctcccacttctgcctcccgagtagctgggactacaggcgcgcacaaccatgcctaatttttttttttttttttttttttggtagagaaggggtttcatcatgttggccaggctggtcttgaactcctgacatcaagtgatctgctcacctcagcctcccaaagtgctaggattacaggcgtgagctactgcgcccggctgggagtttttgtttttgaaatgaggtctcactgtgttgcccagactggtattgaactcctgggctcaagtgatcctcccaccttggcctcctgagtagctgggactataggtgcacaccaccacacccgactaattttttatttttatttttgtagagatgagggtttccatacattgcccaagctggtctcaaactcctgagctcaagtaatcctcctaccttggcctcccaaagtgctgggattacaggcaggagccaccatgctggacaacaaagtagagtttttaggagtgattttggtcagattgcaaatgtcttgagagtggcaggtgggagcaaatgctcataggtggggactggaccgatgtcaggtgtttagaaggagaaattgacagatttgatgttgagggaagaggaggagaataataataatagttgtcttagaatagaagaataataaaatagcagttgccatttgtttttgtttgttttttgagacggagtctcgctctgtcaccagactggagtgcagtggcacgatctcggctcgctgcaacctccgcctcccgggttcaagctattctcctgcctcagccttctgagtagctgggacaacaggcatgtgccaccacacccagctaatttttgtatttttagtagagacggggtttcgccatgttggccaggatggtcttgatctcttgacctcgtgatctacccaccttggcctcccaaagtgctgggattacaggcatcagccactgtgcccggcctgtttgtttgtttgtttggttttgttttctgagacagagtcttgctctgtcacccaggctggagggcagtggcacgatcttggctcactgcaacgtccgcctcttgggttcaggctattcttgtgcctcagcctcctgactagatgggattacagggacacatcagcatacctggctaaattttttgtatttgtagtagagacagggttttgccatgttggccaggctggtctcaaactcctgacctcagatgatccacccgcctcagcctctgaaagtgctgggattacaggcatgagccactgtgcccagctgcagttaccatagtagaaggttaccacatgctagaggatttatttcatttgcttcccccagcgctgaggttgctagtattatatccagaaactggggctaggagaggctaagaaacttacctgaaatcatatagttagtaagtggaagagccgaaattggaggccaggtagtctaccttcaaagcctgtgctcaccccatgctcactcccctttgagggtgacagcttgacacctgcagaaagccatgggccacatgagtgtgggcccaacgcccaggtttgggaagagatcggtactgatatgtccaggtgctcccaaacccagtggggaggtccagatggctggagggcaggattccagtgggtcattgggtggggagatttggcatctgtccccacagaggtcctggttgacatcaggggcacagatgagctctgtgagtgaatgatggaggccttaaaaagatgtgagcatctgaaaatcagctgggtatggtggcacgtgcctgcactcccaactactcaggaggctaaggcgggaagatcacttgacctctggggtttgggttgcagtgagctgtgattgcaccactgcactccagcctgggtgacagtgagaccctgtctctaaaaataaaagatgtgagcatctgagatcaccccctagagattctgattttactggggcggtgcccaggcaatgataatttaataggtacagagaagagggaggtggaactttgagacctgcccacgggtggaagcagaacaaaccagagatggggctaggagaggctaggaaactaggagaggctggcagaaaggagggaggagattaggtcaggagcaaggccgtctcaggaaagacggaacagcagctgcgtcagagggaggaaagccaggcttttcatgaggactggactgtccccttgaccttcgtctctgggctgtggacattggtgggggtggagaatgactcggtgtggggaggtgtggtgttaagaagggaacagcagggcgatagattgttctttgaggctttgagcattcactgaatgggtgaggaaggaagactcgggagaactacatgcaggcttaggggttctagagatagaaggggaggcctagcgcggtggctcacacctgtaatcccagcactttgggaggccaaggcgggcggatcacttcaggttaggagttcgagaccagcctggccaacacggagaaaccccgtctctactcaaaatacaaaaattagccgggcgtcgtggcgggtgcctgtaatcccagctactctggaggctgaggcaggagaatcgcttgaacgctgaaggcggaggttgcagtgagccgagatcgtgccactgcactccagcctgggagacagagcgagactccgtctcaaaacaaacgaacaaacaaaaaacaaacacaaaaagaaaacaaacaaacaaaaaaacaaaaagactggctggcgggaagggtgactcgggcctttgctcccgagccagagcccccaaccctgacctgatccccctctctgcgcaggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagccacctgttgacatctgttattgataagcgccttcatgcttcttcctcaccctcatgcccatcccatcccatcatcccttcctagagacctagggaattgggcagaagggaccagagagggtgcacacaggaatgctgtctccacggggaaaaccgagctgtttctatcactcaaggaaaatgcctaaggaaatactgaaggccccttctccaaagaccaccataaagcaggtggtctttggagaaggggccttcggtatctttttttatttttgagacggagtctcactctgtaacccaagctggagtgcagtgacacaatctcggcccactgcaacctccacctcccgggctcaagcgattctcctgcctcagcctcctgagtagctgggactacaggtgtgcaccaccacgcccggctaaatgttttcgtattttagtagagacgggggtttcaccatgttgcccagggtggtcttgaactcctgagctcgggcaatctgcctacctcaacctcccaaagtgctgggattacaggcatgagccaccacacctggccagtatcttgtcctgggatgaggaatggttacataatttgcaagacctgctgcaaaatgaaaatgcaggaccccttgttcaaaagcagaaacaagctgggcacggtggctcatgtctgtaaccccagtgctttgggaggatgaggcgggaaggtcatgtaaagccaggagttcaagaccagcctggacaacacaggggagaacctgtctctacaaaaactaaaaaactttagttgggcatagtggtgtgtactgtactcccagatactcaggaggctgaggcaaggcagggataatttgagcccaggaatttcaggctgcagtgagttatgatcgagccactacactccagtctgggtgacagaatgagaccttgtctcaaaaaaaaaaaaaaaaaaaggaacaaagcttttttttgtttttgttttctacaatttctcaacctgtcatggtattcttttatttgatatttaatgttgcactcctttggatatggggacacactttcaaaacataaattcatgcttgaacccgggaggcagaggttgcagtgagccgagatcatgccactgcactccagcctgggtgacagagcaagactctgtctcagggtaacaaaaattattaggaatttcaaggttggcacagtggctcacgcctgtaatcccagtactttgggaagccaaggcaggcagattgcttgagcataggcgttccggagcagcctgggcaatatggtgaaatcttatctctacaaaaagtaaaaaaattgctgggtgcgctggctcacgcctgtaatcccagcactttgggaggccgaggcaggtggatcacgaggtcgggagatcgagaccatcctggctaacacggtgaaaccccgtctctactaaaaatacaaaaaattaggtgggcgtggtggcgggcgcctgtaatcccagctactcgggaggctaaggcaggagaatggcgtgaacccgaggggcggagcttgcagtgagccaagatcgcaccactgcactccagcctgggcaacagagcgagactctgtctcaaaaaaaaaaaaaaaaaaaaattagccaggtgtggtggcgtgcacctgtagtcccacctactctagggtgctgaggtgggagaattgcttgagcttgg

SEQ ID NO: 13109 - DNA, 9805 bp, Human
ttagcagactgtgctggccttgcccaacctcacacacccctgggacttagccggctcagggctggtgtgagagggaagaatgcaataggcagattagcccgggcaccctgggaaaccctgcaaggaaagcaccactcagccatgccccctttctctcctcctccaaggtccctctgtgtgcctgtgccctctgtgccaccagggagtgcctatacatcctgtccagccacgacattgagcagcacgccccctatcgccacctgccagccagcagggtggtggggactcctgagcccagcctgggggccagagcaccccaggaccccggggggatggcccaggcctgcgaggagtacctcagccagatccacagttgccaaacgttgcaggaccgcacggagaagatgaaggagatcgtagggtggatgcccctgatggccgcacagaaggacttcttctgggaggccctggacatgctgcagagggctgaaggaggcgggggtggtgtagggcccccagcccctgagacctaatccccctcatgctagcctagtccctggaggagggagtccggccccaggccagggactaaggagcaatgaccattgtgcacatgcgtgtgggaaggggttgctagggggtggggacggctaaccagggtaagaatgttcagggggctgcccaggaggggcccccaacctgactatcatggacaagagatttgatggatagaataaaaggctgcagcgaggcctggtgtggaagccttgggggctgggagggacaggggcagggatggggtgggtgggtgcccggcttggtgggtgcaggagggcaggagcccaggcaggggcaggcagcacaagcagctccaggtctcaggtgcagcagagctgatgctgcctgaacccttcacattgttgtccactccctgctcccaagagcacacctggtcgtttggactgggaagttctggccctaccttctggaacaactctatgcacagatgctcttggctaccccactgggatcccctgcccactagacttgtccccatcctgaggcagcctgttcctcctgacccccgaaagcttcccacccatctcccttcggcctgaagccagcccccctcctctctcccttctgtttacctcccaggtttgggctctattttctactccttccacctcttcctgagtaacaaggacactcccttcatccacaccccatgcctcctgccttgcttcctgtaccttcaagtagttggaagaggtcatgggtgagaattccttctccttggcctagtctggcccaggtctggagagaaggcaatggagatgtgaagtggaggccaggtgtggtggctacgcctataatcccagcactttgggagtccgaggtgggcggatcacctgaggctaggaatttgagaccagcctggacagcatgctgaaaccctgcctctactaaaaatacaaaaattagccaggtgtggaggcatgcacctgcagtcccagctactcgggaggctaaggcacaagaattgcttgaacccgggaggcggaggttgcagtgagcagagatcgcgccactgcactccagcctgggtcacagaatgagactctgtctcaaaaaaaaaaaaaaaaaaaaaaagaaattgaagtggaaaatgagctggcaggggtggtcaggcagggggtgagcaatgagggctcctgagctgaggaagcaggggcggggggaggatgggggctagggagtcctcagaagttcccggagatactccctcactggacagagtggggttcccgatgacgttacttgaggcctgggagacggcctctgcccctcactgctcctccccctcctaaggtcaacatttatgtgtcctagacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccaggtaggtctcttggcatcttccagacagctccagtgaacttcagacccccgattcctttggggttatgcctggagatattttgggttcccttgctgacacaccactccccagattccccaccgcctcacccttctctggcccccaaatcctccccatctgctgcaagaccttggtctcctgcaggccaccactgctcccattcccccaccttcgtcctctggtctcttaagtctccccacccacccagatccttgaccccccatagaacccaagagagagccaagctcctgaacttgcctggtagctggattccaggaaggaattcgagagggattgtagggggaggagggggcagtgagtggagacttgggagtcagaatctgaagtagtttggaacaggggcagggctaaggtgtggagctcgcggagcctggcctccaggttcaatcagagggccatcgccactgcagctccctccatctctccaccccctcccccctaccgcctcgtggctgtgtccacatctggaagtagttaggcggctcctgtccctggactgccaggcagagtgaggcgggagtctggaaggggggccgaggaggattccgggaattcctgttggggtgggggtggggactcttggggttggagggatggtcgagttgccaggcccacttttcccttatctttgtgggagtctgggacaccccagccctgtcctggctggtggaagctgccccaggtctctcaaggcctttccatttcatcccccagcttccctccttggagtttcatcctcatcacctcatccccatcttgccagtgctcccccgtcccacccgtccctgctctttcctgaccccttttctgttctccagacccgtgttcctgtgcggaggggatgtgaagggggaatcaggttacgtggcaagtgaggggttccccaacctctacccccctaataaggagtgcatctggaccataacggtgagaaacccctctgggcactaccccttgttaaagtctcagaggcaaaaaggcctgactgcgaagggaccccccccccgtcccccccgcaccaccttctcaacctggggcagctccaagtgtcttccctctgtcactgaaggcatcattcccaccgtaacacgcatcatcttaacccttccctcaaatcttcattctccagtccccggccctccctcctcttccaaagcctcagctcttgtcccctgcacaggctaccagcagagctgcagagaccaggccctctgctctgcactcacatggaggccccttcccattcagtccgtttctgcaagaaacgcttggggcaggggagctgccctctggctgggttgtgtggggcctgactctgtgggtccccgcctctgtccccgctatcaggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactggtgagaactccctcacctccgccttccccccctccaggccccgccccggccgcagccccgcccccagccctaacctccgccccgcccaccccgcgccccagtgcctagggccccctacctccctgacccattttcctcactaaccgccccttcagtccctcctccccgtcttctctcccctcctcccgcacccacccatccctcttccagggccccccccaggcgcgaggcggaaatgggtcaccgacccgcgggtggaatgggcggcctggggttactgggacggtgagtaactgccggcccccgtccgcaatcgggctccctccgtcgggcgcgagggggcaccccagggctggggggactaggttcctccaaccccggggggcccctacacccagccctgggctcccgattgcggtcccatcaccccctcctggcggcagaagtctcccttgcaatgtttcaggcggggacctccctaaaggggtcctcgggggctgtgccccaagtcgaggacaccctctccagcctgaaaggggactctgctgcagggccggggagatgggatctcctaggggaagaggcgcggtgcggccgcgggtcggggaggggccagaagggggcgtccagccagttcctcctcccgcttccaccgcccgccagtgcgccctgcggccccagacttccccgagccgcgctcctcccggccgctctctgttaacctgcccccatcttacctccccttcttctcgtcccctcatcctgagccccagacatccgagctgcctgccggggctcccagcctagagttctcctgaagctgaccgagggtctccaccgccccccacccccgctcctctctcccctccccagagcaccaattttgcggggggcggctggagaaggcccagggaaccctgaccacgcccaactggcccgagtccgattaccccccgggcatcagctgttcctggcacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccggggtgaggggcgggacctgggcgagtccgggagagagtcggcggaccgcacgcacgcggctgtttggaggggcggggttcagctaaagggacgggatctgaaccccagggctccaaaccggcgaggggagcaggttggaggccaggcaaagaggagatttggccccgggtctggggtccgcggatagagaggcgactggggctctgcgaagttgggacgaagttaaaaggccacctggccaggggtagtggctcatgcctgtaatcatagcactttgggaggctgaagcgggaggatcacctgagcttaggaattcgagaccagcctgggcaacatggcgcaaccttgtctgtaccaaaaatacaaaataattagctgggcatggtggcgtgcctgtagtcccagcaacttgcggggctgaggcaggaggattacttgaacccagaaggtcaaggctgcagtaagcctagatggagccactgcactcaagcctgggagacaaagtgagaccctgtctcaaacaaacaaaaaaggtcatggggctgagaagagtgtggtgcacgcccgccctgacacttcccccaatgctcggtggccacctgcagctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctggtgagtctgggataggggaggaaggggaaacagactgaagggggccatttcaaaaagttctgacctgggctgtggctcacacctgtaatcccagcattttgggaggtccagacagcaggatcgcttaagcctaggagtttaccatagcaagaccctgtcttttcaaaaataaaaaattaggctgggctggtggctcacgcctgtaatcccagcactttgggaggccaaggcaggcagatcacctgaggtcaggagttcaagaccaccccggctaacatggcaacaccacatctctactaaaaatacaaaaattagccaggtgtggtggtacacacctgtaatcccagctactcgggaggctgaggcaggagagtcgcttgaacctgggaggtggagattgtagtgagccgagattgtgccactgcactccaacttgggttacagagtgagattctgtctcaaaaaaaaaaaaaaaacttagccaggcgtgtggtcatagctactccggaggctgaggtgggaggattgcttgagctgggaaggtcgaggcttcagtgagccatgactgtgccgctacactccagcctgggcaacagagcaaaactccatcttaaacaaacaaaaaagttcttccttggctacattcactcattgattcatctggtactcactggtgcctccttcctgccgatgacccctactgggtgctaggaccggaagcctgacagagctctgaacagttcaagtcaatgaggctgttatggggacagtgctccctcctacctgctgagcaggtcaccctccaccctcctccctcctagatgcacccacctgcccaaagcagtgccgccggacaggcaccttgcagagcaacttctgtgccagcagccttggtaagaatacccccaaccccattccagctcctcgaaccacctcctgcttctgtttccagtcctgccatctggaacctcccatctcctcatctctcactcccattctcccacagtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggtaacagagatgtggggaaatggggatgggtcaagctaagccacacagaaatgatcaaggtgtggaatcttgagacctgctgacaggtctcaagaataagagatctcaacccctccctccttcttccaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattggggtccatcttgaggatttcttttcattaattaattaactcaacacatatttactatacagaataatcgtttaagaatgtggccaggggtggctgctcacagctgtaatcccagcactatgggaggctgagtcaggaggattgctgaggccaagagtttaagaccagcctgggcaacatggcaaaaccccctctccacaaaaaaaaatacaaaaattagccaggcgtggtggtgcacacctgtagtcccagctactcaggttgaggtgtgaggatcgcttgatcccggggaggtaagactgcggtgagctgtgactatgccactgtactccacctgggggaacacagtgagaccctgtctcaaaaaaaaaaaaaagaatgtaagtcacaggccaggtgcagtggctgatgcctgtaatcccagcactttgagaggctaaggtgggaggatcacttgaggtcagaagtttgagatcagtctgggcaacatggccagattctgtctttacaaaaaataattagctgggcatggtggtactcatctgtggtcccagctactcaggaggctgatgtgggaggcttgcttgagcccaggactctgaggctgcagtgagctatgatcacaccactgtactccagcctgggcaaaagagtaagactctgtctctaaaaaagtaaaaagaaaagatgtcatgtcttggcggggcgcggtggctcatgcctgtaatcccagcactttgagacgccaaggcaggcagattacttgaggtcaggagtttgagaccagcctggccaacatggtgaaaccccgtctctactaaaaatacaaaaaaattagctgggcgtggtggcgggcacctgttactcaggaggctgaggcaaaagaattgcttgaactcaagaggtggagattgcagtgagctgagattgtgccactgcacttcagcctgggcaacagagtgagactccgtctgaaaaaaataacataaaataaaaaagaaaagaaaatatgtcacacccttttttttttttttttttttttttttttttttgagacggagtttcactcttgttgcccaggctggggtgcaatggcgcaatctcggctcactgcaaactccgcctcctgggttcaaatgattctcctgcctcagcctcccgattagctggaattacaggtgcgcaccaccacacccagctaattttgtatttttagtagagatggggtttctccatgttggtcatgctgctctcgaactcccaatctcaggtgatgcacaccccttggcctcccaaagtgctgggattgcaggcgtgagccaccatgcccggccgattatgtcacatcttgtccctcctttactcaaaactttcctgtagtttcctaagtcttaccaagggttcaaggccctatatcatctgcattctctctcctgcctcgtagcttcatgtctattatctcctatgtatcatctgttccagtcacattggcaacttcagtttgttgcccatttctttttttttttttttttttttgagatggagtctcgctctgtcacccaggctggagcacagtggcatgatctggctggactgcagtgcagtggcgatatctcggctccctgcaacctccgcctcccagattcaagcgattctcctgcctcagcctcccgagtaggtgggactacaggcatgtgccaccacgcccggctaattttgtatttttagtagagacggggtttcaccatgttggtcaggctggtctcgaattcctgaccttgtgatctgcccgcctcggcctcccaaagtgctggaattacaggggtgaaccaccgcacccggccttgttgcccatttctagtacacttctgttttaggcctttgctatttcctctatccagaattctctcccatagacatatctcatggttcacttcctaaatccagtcagatctctgctcaaagttc

SEQ ID NO: 13110 - DNA, 10959 bp, Human
cagctaaacatctgagctctgatcattatgaaggcaaggtggaatggatgttggggtaagcagccaggagcctagcagaaaacctgctgctgtccagatggctcagtaactgggctctaatgtaatcatgggaagtagtgctaagaaatcctctgcctgttgatttgaacttatttcatcaataattactgtcatttactgttacaatatcctagatatatatgctaagtacttttcatacattatataattttcacaacactgctgtgtggtaggcatggtctattccatgttacaatatgagaacactgagacacaggttacataacttgcccaagttctgatagctattaagtggtgagtcagacattgcacgtgcttaagaccaatggtaataaactggccctgtgcctctgctttttaatctgtctgcttatatatctatccatcagttcctattgtcacccctgcctcactcctcatacgtaaaaattatttgaggtagctcaaacatgcacaaataacagaaaaacaaaaagatacacagattgaggggaatatgggaatacaagagtgaaaaaatataatgaagttgaggtacaattgatacacagaattgaatgccatatggtcttatagaggtgtcagaagtcttggtctggtttgccactgtgttctatcagaaactgaaaggcagagaaacaagaccttctttatttagactcttggccccttcactgttttagttatataataatttgaatccttattataaagaatactagttttttacattgtggctgcaaggaattttaaaaacaactatagtatgtttttatcattttctgatctttttgtgagttaagtcaaattgccattgtttattttttgaagtgtgaaaatgcaaagagagaattttttagctgggtcatgagtcacgtacttagtaaaaactggggcttgtttgtttgtataaatcataggagtctcggcaaatacatgttggaagattctgatcttgataaaaatggtattatgcaaattacttggtagagctcctcctgtacacccaagtttgcaaactccttgaggacaaaagactttgccttaatcatttttttccctccattatcttcagtgtataggtgttcagaaagaaaataatgaatgaatggttagtaatgagaaaagtctgttagtaaatgttattcatatttttgctgctttaaacttaagtcagttactctgcttgaaatagaagtatgtcatattttttatagtaccagcaagttgcatgagaagggttatatgccactaatggttagacattggaaccagagtccaacccttgaacgtggtgcatttggggatttgtcattactgtggtacacctggaacgtagtgtttgtagaggtgaatagcaggagataagtctggcaagctcctgtcaagtaaaagttactttttagtttaaggaatgaaagttaggcctagattttgaaatatattagatgtcatgttagcttttttaaaaatgacatttttagtggggaaaagaaaggacatgatttggtttgtttgttttgacagagtctcactctgtctcacaggctggaatgcagtggtacgatctcggctcactgcaacctccgcctcccaggttcaagtgattctcccacctcagcctccctagtagctgggattacagacatgcaccatcatgcccggctaatttttgtatttttagtagagaccaggtttcactatgttggccagtctggttttgaactcctgacctcagatgatccaaccaccttggcctcccaaagtgctgggattacagacatgagccactgtgcccggccagggacatgatttgattctagtaacatttgaaaaataaataatatagattcattttttacatttcaatttcaaaattgtgaaaagtgaattaacaacatttaagtttaatgactttattttgttttatttctcaggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggagtaagtatctgagttttcgtatttgtactacatagcctaattttatagttctatgactaatactaaaatgtattcattctacagatagtttatgagcaccttaccatgtgctggttgtcctggatacagaagtgagccctgtaaaagcaatccctcctctcatggaggtgcaagcttttgtacatagagtgctggtacctgaatcagcaaagaactcattggttacagagacattttattgctctctcaatttattttaactgaagaaagggacctttatattcgcacatgtacctattcaaatatgattatatttgaattatatttgaatgatgccttaatatatattataatttttataatattttaattgtcatattctttaacaaaggtagatggttttctttcataacaaactgctgaaaataatatgatttatatcttaacctggacatcttaaattttagtttttgttaaacctgtaatattttaaagcctgaatattaataagtaataataaaaccttagtgttttgagattaacattataaaagacattggatgtcattataaaccaaagattgacgagaggaatatgtattttacacatttgttatgaaaattaagaatgtatctcaaggctctatttagctttaaaaattagatgccaggatacctatgtaaattgccattaattaattaattttttttttttttttttttttttgagacggagtctcactcttccgccaggctggagtgcaatgcagtggcatgatcacagctcactgcaacctctgcctcccaggttcaagcaattctcctgtctcagcctcccaagtagctaggattacaggtgcacaccaccacgctcagctaatttttgtatttttagtagagacggggtttcaccgtgttggccaggatggtctcaatctcttgaccttgtgatccacccacctcagccttccaaagtactgggattataggcgtgagccaccgtgcctggccgtcattaattcttagtactagaaactaagtaaagatgaattaaattcaattaaaaatttcagtgactcacaaagattttcaagtttgtcagcaatcccatccttcctttagaaaagtaataaatatgtctgctcaaaagtttagagaggaatatgcctaacactgctttggtacttcagcatgacatatggaaaggaagtagtttttttaaggcaggttaattgaaaattctgagttgatagacaagctggtgatggtgagagacaattaaatgtaggataaactcagtcaagtgtttctcagtcacttgtatatgaaattttataatgtattttagttcaaattttatcttgatctttggtgaattttgagtctgcccagatttaatagctttctagtttgataatatggcatatgacagagaatgaagaacacaaaatgtaacaaaaattttaagcagaaacatctgattcatttatgttagtcagtgagcatttatgtctttcttacatagaatgagcatctaacaaatatttccattaatgaaaagttggaatgaaaatttaaatttgcatattttcttggagcttagtccttgacctatttatacacactctgtagttatttcattgtaacccatagctttaaatgaatttccaattacatctccagctccaacatttctcctttattcaagatgccgatgttgaacttgagtatgtaataagcatctcaactctaggatgcaatataaagtagtgatgggtaccatgaagcagcagaaagcagaattaggaattagaaagcaatgaagggatgggtgtttcagggaaatgattagggagggcctctcttcaggaggtgacatctggtaagagacctgaatgaagtgagaatattgaggggataatattccaaatgaaagcaacagctactgcaaagcttctgaagcatgaacagatttggtgtgtgtgaagaaccatgcaagttccagttatatgactggggtggaatgagagttgaattgtttatatacttggagtacattgatttcaagtatatagagtgagagatttctatacaccttgtatttttaattaatcaaatgtctttttggattaatatgttctttgtgtttggtattgtacttgatttcagaatggtagatttggagagcagttattgcagtcttggataagcttggagagtagtatttggacattaatatgactatatagaacagaaccttatgtgaaaaataatgcttatgaggtaatcagattttttttccccccagaaagtattaatgaagcttagaaaacctagaattacagctacaatttggtcctcaggaaaaattatttgcactggagcaacaaggtaaatgctacttgggttttttgtttttattttttactttttccctcatggaaaggacattttcctagacttaacagcaaaatcatatgtaaagtttgttatgttcctcagtataacatttatttcctgtgtaactgataatctttttctttccttaaaaccgtagtgaagaagaagctaaatttggtgccagacgcttagcccgtagtctgcagaaactaggttttcaggtaacgttttcaaatagtatctaaactacaaatattcaaggacttatttttatagaattaaaaattgtaatagactcaagaaatcactatgcgtactattcttatgattaaactttttctaggttttttaatactgcccttcagtgtgaaaattagtagcaaaatttggctatgtgggtatttgtaaaggatcctagctttttccctaattcctttcccataaagagacttgtttcctcacaagttaatttccttttcaactcttttttaagtgttttcacctctgacgtacacaaacaaaatggtttttggtcatctcaagaatgccaggtcagaatggtgaatagagaatggcagaggccgttgacatggacacaccagctggcaggctctcacacttgtaacgtgactgtcactggcatgtcagcctcatcactataacttgatagaggtatacctttgaataaaacgattacatattatggacttgctaggtcacttgcaaatgatgaataaatgaaagataaagatgagaatggtccctgaagatgagggcaaggctgtttgggattgagacaagtttgtagaagtggggataggaagttacctttccctctgatgactcagtctctctgaagtagagggtgataggaagagactgaacggctggtggggagtgggggttggtgcttgagaagggtggcagtagagagaggcttgagttgtactgtgatttgagagtgctgccactttgcggtttcctggctttgcgcaactgctgtgtgcaaggctgagttgaaggatagttcgctcacccaaaattgtggttttaggaggaatgtttgaaaagataatgagatgaaacgaagatgttggttggagtggccaaagttattaatgttaacagcattattttcagccttggaacttcttttcttagtgtaacattagaagtgttgagagaaatcccaattagttagaaacaaatttatcactctatccccagaaagaaaataaacatctagctaatctcacagaaatgtcattttgccttattgcatatgagaaaaacatctgacttttggagcccagtgtacactctgtatttactgactttaaagtgacatcttttccatttttactctagcaggatgacctggacttaaattttttttccctcactattctctctcctttctcagtagttttaaatatttcacttaaagtattaaaaaattaaacatatgattagaaagacccatactgttttgatcatgcaaatacctcagtttttaatttttttaatggagtttttgagctttttaaaaaactgaattaaagctttccatgctacacaacttacagtactaaacatacacttaaaatgtttttgttttatcttgtttgctcttgtttttaaggattgccattatgagcagattttttgtttgtttgtttcaaaataaatttattgaattttacttctctcctaaaggtaatatttacagattttaaggttgttaacgttctggcagtgtgtaacatgccatttgaaatccgtttgccagaattcacaaagaacaatagacctcatgccaggtaagtctttgaagcaatttatcttgagaaattaccaaatttgaaattactagtcagggtataaatatttatattaattgtggcttattttgtgtagttacgaacctgaacttcatcctgctgtgtgctatcggataaaatctctaagagctacattacagattttttcaacaggaagtatcacagtaacaggtattctatgatattgaaaccacacttatcaattatggattgaatgatacaagatgctcataccaagatagaaataatgtgtgatttgttcctttcagtcacttctgccctttagaggaaccagtctcctgacttttaacactagatgcattttgcctacttttgtactatttataaatgttacacttactattttgtgtcttttttcactcagcattatcttagtgagtttcatctatattatattctatgtagctgtatgtagatcattcgttcttattgggcatttgagtagtttccagttggagctttaaaaatattctggtaggccaggtgcattggttcatgcctgtaagcccagcacttggaaggctgaggcgggcttatcacaaggtcaagagatcaagaccatcctggccaacatggtgaaaccccgtctctactaaaaatacaaaatattagctgggcgtggtggtgaacgcctgtagtcccagctattcgggaggctaaggcaagagaatcatttgaacccaggaggcggaggttgcagcgagctgagatcgcaccactgcactccagactggcaacagagtgagactctgtctaaaaaaaaaaaaaaaaaaaaaatatatatatatatatatatatatatatatatatatatatacacacatatattttctggtatatgtatccatagtatgattttttttttgtaaattcatgatatcttacatttaaaattctcatgagaaactcataaatttcacagaggttttacataagcaaaatattaaatataattggtacctgtttgttatgtttgtcttgctatatcttttaatctttatttggagaaagggtggtttcagaaaactaggcattcatgtcagagagtagcattagcatgctgtgtgacattttaatggtactatgattataaattgtacagaggcattgcttgggagtcaggcccaaccttaggcaaaaaagaattaaagaaaatgtctttaatgtccttgagctttgttttttctttcttcaatccacagaggaaaataatttagtctctcaacaaataaactttagttttgactcatcccatgggtttttccatcttccttggggactttcaaaacgtattcccaagatcccacctgcatcttaaatatgggatgataggagacgagtctgtttgttcccttctttcagctctctgtttctacactttggagcatggatgtctgagaagccacaaagcctattgaacaatctctactaagtatataataaaacaatgcatatgtaaaactctgtatttactgagttactagatattaaacaaaacaataacaaactgaagacaattcacctggttaagcagtatgcattatttacttagatcaggaatagcctatgaaatgttactgaattggttcccatgaacaaagcatagcaaggtgggggtaaagtgagtcaggaaggacctgaccaagataggatgtgtggttaggactttcagagagtttacagtgggtggatttgttagtttcctgggtctttcaaaagaggttaagtgtgtattggtgaagccatttttattcaaaattttatgagaatagttttcattgtccttttttatgtttctttttagcgatttaaatgaaagattacatttttataaagttgttcaagaattagcataatgcatggtcacctcgtagccttgtgctttttttgttttctattgacttgtatacgctctgagggtgaaatgaccagattggtaataaatatgtggatacccagtggtggtaaatctgtggggatttttaaaccagcattctggtttcccaacattttggtagcagctttgtttcactctgctgtgttcctccatatccctgagcctctgttgtagcctaaccagaagccagatgatagtgacttaaaggatagctgttatttagtcccatttgttactccttcctttcatgtacatattatattacagtgctttttatattagtccatgatagtttgtatgccctaaaacaaagtgaataacctcattttgtgtttcatatgtcctttaattgcccagaacaaaatctgtattacttttacttattatggctatgtgtataattatatgtctagttttcttttttttaacagttaacttgatattctataccacttgaatatttttaattctggaaaatcagtttttcctagtgctcccttttccaactcttctcactccttcctccattgtgtttattacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttcctttttttttaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaaggga

SEQ ID NO: 13111 - DNA, 10183 bp, Human
gctgggattacaggcataacatggcccggccctggccatgtttttaactgtgtttctctaatagctaataatgccgagcatctttttatgtgtttcttagccattagtagatcttttttggtaaaatgtctttttttttttttttggtccatcttaaaattgttttttgttttgttttgagacagggtctcactttgttgcccacgctggagtgcagtggctcaatcatggctcactgcagcttcgacatccctgagctcaggtgatcctcccacctaagtttcccgagtagatgggactacaggtgtgtgccaccatgcccagctaatttttgtattttttttgtagaggtggggttttgctatgttgcccaggcaggtcttaaacttctgaggctcaaatgatcctcccacctcagcctcccaaagtgctgggataacaggcatgaaccaccacacccagctaagattgtttttaaaaatctttttcttgagttttgggagtttttatgtgttagggataccagtcccttatgaggtatataattagcaagtagtttctcccactctgtgactgtgacctttctttttttgaggcagggtctcactctgttactcaggctggagggcagtggtgtgatcatggctcactgcaacctggaactcctaggctcaagggctcctcccacctcagcctcccaagtagctgggtctacaggtgtgttattgtgccagggttaatgttttaaattttttgtagagataatgtctctacaaaagacaccatctttgttgcctaggctggtcttgaactcctggcttcagggaatcctccagcctcagcctcccaaagtgctgggattacagcatgagccacatccagcctatgatttttcttcttttcttttcttttctttttttttttttttgagatggagtctcgctgttgcgcaggctggagtgcagtggggcgatctcggctcactgcaggctctggcccgcggggttcacgcctttctcctgcctcagcctcccgagtagctgggactacaggcgcccgccacatcgcccggctaattttttgtatttttagtagagacggggtttcaccgtgttagccatgatggtctcgatctcctgacctcgtgatccgcccgcctcggtctcccaaagtgctgggatcgcaggcgtgagccacggcgcccggccccagcgtatgacttcttaatgatgtctttgtagtacaagagtttttaattttaataaagttaacttttttttaaattgtacaagcttttagtgctgtgtctaacaacttgttgccaaacccaaggtcataaagctgttctcttacgttttcttttttttttttttttgagacggagtctcactctgtcacccaggctggagtgcaatggcacgatgtcggctcactgcaacctccgccacccgggttcaagcgattcttccgcctcagcctccggggtagctgggattacaggcgcacgacaccacgccctgctaatttttgtatttttgtagagaaggtttcaccatgttagttaggctgctttacgttttcttttagaagttttatatttttggctcttatatttagtttgtgatccattgagttgattttatgtacgtatgtatggtcgcgttcttttctttcctgtcttttttttttttttttttttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtaacacggttgctggcaccctcggtttgcagcctcaagatccctgaaagcgggtttgcagtggatttaccccaacagatggggagggactgagcttgaccaaagagccagaaatgactggagaatgcatcccttgccactgctgcaaggggagaaaaaaggattgatcctcagtgacaacccctccctcatgtggcaggtggctcagaactccggtctgactctgaggcgacagcagttggctcaggatgcactggaagggctcagagggctcctccatagtctgcaaggtaggcgggtcctccccaggatggtcagttcccctcttccatagccagagaaacatccgctcctgcgtttttgggatcgatataattactcggggcagggagtcctgtttaaggcacagaggagactggagtggaatcatctttgtacaggcaaatccctctcttccttacacactcacagagtggcatttgaaaaatggtttccaagatggtctgatctggataacttttttgccctttccagactctctgtccaaaggttgggttctttttttaaatccttagctaattggctggagggtgggttctttattgtagctgttttggttggagtggggtgatctctgagttgggattttatttggaggatcttccatgggggagcagtctgtaagaccaacattgttgctccagggctccctgcagctgttcctgttcttcccttggagctgactgtcacctgcaacttcattatcctgagggcaagcttggcccagggtttcacagaggatcaggcccaggatatccagcggagcctagagagaggtgagggccagagattgtccctgattcccctgccatcttcagtctgggtttaagttattgcagggagatgggaggataaacaacatctgtcacctccatggagagaggtgcccttctctgtgctcttcagaccaggttgaggtattattattgtgacctttggggtcctgcaggagaggaaagccagagtgtgtggggagatggaggatgaggtgctacttcagctgtgtgtgtgtctatgtgtgtgtgtatactctacagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccaggtaatagggaaagtgacctgaagctgagggtctcctccttccttcctcctcctttctctccagctgcagtagcatcatcatgtactggacaggcggctgggttggtggtcggaaaacctggattctctctgggactcttgggtgaccttgccctggttggtctctcattgtggggattctcttaggagtgttttttaaaaattggacaggcatggtggctcatacctgtaatctcagcactttgggaggctgaggtaggaggatcacttgaacccaagaggtggaggcaacagtgagttgtgagctatgatcacgccactgcactccagccctgcagcctgggtgacagagggagaccctgtctcaaaaaaaaaaaaaatttttttttggatagggatagggctcttgtgatcttgctcaagtcagctctcagccttagtctccttattagtaactcaaatatggtccttgccctgagtgaggaggcacgctggaatagatcatcactgccccaggtttttcttccttttttttaattcttgcctcatagctatctatctcttagaattgggggaaactacaggcattatgcatagcttcttgctttgtaagggtagctgaggcctgtgtcctcaaggatcaagaggacccttgagctcaaggtctagccaggatagatggagataggagaagacggggaggttgtaggcttggagcttctggttgtccttctttccccagagtggagcctctaaggatctgctgttacttctgaaaacttggagtcccccagctgaggaattagatgctccattgaccctgcaggatgcccagggattgaaggatgtcctcctgacagcatttgcctaccgccaaggtcagctagcaacctgactcatctcttctacctttaagtggtcctccagactcatgccctctctcttgtcccattcagttccatgggcttcttagacccttgttccccatcatgacccctgctctatagccctctccaagctcacaccctgactgtcctcaggtctccaggagctgatcacagggaacccagacaaggcactaagcagccttcatgaagcggcctcaggcctgtgtccacggcctgtgttggtccaggtgtacacagcactggggtcctgtcaccgtaagatggtaaagacagtcctagggtggattggggaaaccacaagcattatgtatagctttttgctttgtaagggtagctgaggcccgtgtcctcctatccctttagggaaatccacagagagcactgttgtacttggttgcagccctgaaagagggatcagcctggggtcctccacttctggaggcctctaggctctatcagcaactgggggacacaacagcagagctggagagtctggagctgctagttgaggtagggaactgccaggtgaagatgtggggtggaggattcctgaggtgcttgtgatggggtgacttgactagtcaagatccaagtataaggaagtatggctcccaaagattatagatacaatttttttctttctcttttaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggaggtgaggttccccttgctcacctgagcttctcttcccacttctgatgcctcccctggggtgtgactctgcttttgttcttgtgacttgggggatgaatgaggcagtggcaggacataggtcgccactcctcagcctcttaccttgcttctagacctgaactgaggactcttctctaagacattaaccttctctatctttgacactctgaagtctcttccccagtccattctgtaactggggtagatccatactgagccaaaattggagccctaagaccttccctccctttctcctcctcagggcccatgaacatccatctgttagctaagagagaacattctcaggacccttgcaggttccctgctagggcctagggtgaggcttatgggcttttactcctcagggcaggagacgctgcagagcattacttggacctgctggccctgttgctggatagctcggagccaagggtgggtgtgtcttcaagcttctctgcaatggggtagacgggttggtgtcccctttgaaatacagcaagactgcaattttttgttttttcctctattctgtctgtccagtctgggggcccaggactctgcatggtaccagagcctggtgaagaggttggggatggtggctcatgcctttcaagacactgcttcttcttcccactccagttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgagcccggggtcctagagggggtgtggagggatgattttctgattgggacctgagttggtgagctccatgttcacctacttaccctagagtttctgaaattgattcctcttcacccctgttctgtgtcctacttcaggtgcctcgagctgctcttccgggccacacctgaggaaaaagaacaaggtgatctaaactttcagttttcctcttacctcctggaagtggtagtggtggaagtgggttccctttaatgtgtcccagcccaccaggagacttaagagaaagggactgtggacacaagaagaaatagaggaggatttggggttttggtgactgtgaggctgggaagacacttcttgactttgggagtggtccccaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtatgtatacttgcatgacgtcggctatgcatagatgtgcaaggacagagaggcccatgggaaatacttgggcgtaagtgtaagagtggtgttctcagacaggaggggtgattggggttgtgctatatatacctagggatatatccaggtgttcaaatatacacagtgtgtatgcagggctcccaagagttccctggtttccccgatatcctcagacacaaagaccatgactctgctgttgtgggttgcacaggagtagggggcagatgatggacactgggatgggaatggttgtgaatgatctgcccccgcttccatatgtgagtgtaggcaagatacttcctctctctaggcctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctcgtctgcctactacatatacttgcgtgggaaggcttgtgaccgtctagttgagtgctagttgtctatgatgccctttcctgacatcgtctaccttatgaacttgaagtctgggtatgaggaaagggctacaggaatcctcactttggaggcagtggctttagtccttcacattgcctgaatgcagagccccaaagcccaggacagtgacaatgagtggagttgggtctgaagggtggtctagataggcctctcaggacaagggcaggtacctgttacttagagacaggcaggtttctctcagagtaactcttcactcccttcctaattccaaattctagaaattcgactcgtcttagtcaaatgtgtctgtgtgggtacagggtgaaaggtgaattgagtcagcatatcaccaacagctgcctgttgactactaacagggacccctgttatttggggcccaaggattttcaagtcccagcatatgcagttttcttgctaatttgggttctactgaattggctgtgtgttctgtggttgccctttgacttctctggatttgagtgccttattataaggtattaatattaatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcagggtaggcccggcggggcctggccgtgggcgcgtcagagaggtggagaccaggaaagagggaagggaagctagggggcgagtgaggggccgtggacccggcaggcccggctggggccagctgcgcacccgcgcgccccctaggcggggcttgcgttgggtccgggtcggagcctgggccggatcgtgctgtgtcatgcaggccccggcccgcccgattggctcccttagaacggacgtctgggcctggccaggtcttccggcccactccgccggggcggcgccccggggctttggggcgccagtctgccgtccggcctaccacccgccgaaagcctttggtccccggagagagcaggccccgcgagcccgaggccccagccgggcccggtgggcgtggactttgcgccatgtgaaggcctcaggagctctgccaccgaggcggag

SEQ ID NO: 13112 - DNA, 10697 bp, Human
gtgtgactgcgtgagtgtatgaatatgtgtaagtgtgtctgagtctgaggcggtgtggctgtgcccgtgtgactgtgagtgaccgcatgtgagagtgtatgagtctgagggtaactgtgggtcttgtgtatctggcaccaagggaccaaaggcatttcctggtgctggggcccaaagaatggagggggaggtgagaaatggctggaacttccaggggagggggaactggactctttggcctctccttatatcccccaacctggggcctcccttcccctggaagcacagccagctgtaccctaaggaaacatttggtgaggagtgaaaagagggggagtttgtatctgatttttcatttgattgtgtccacgtgtgttcaaaggcatgcccttttgttaactgtgcctcttgagtctgtgtgtgaatgtgactgtgtctggctgtgtgaaaacacagggcatctctcactgacagggacataagtattagccaccctcctttccctcttgctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgaggtagggtggggctaagcagggtaagtgtggctgggtggccaggggtgagccaactggacacactcagacagacacacagacaggtggaggccctgctctgctctactcctactcctgaagggtccgtgctcttcctcttctggtcttgttcccagagccctttccccgcctgccccttcgttctccatccacttcaccactgccttcctccttctgctcccccttgtccagaatctctctctcctagcatcccccacctgccatatagacacactgttagctttttgagtttccgctgaccccaatccagtctttccaacacttcccacactgccccatcacctcctagtcctgatctctgagtatctcttggtgctgtggcccccatgcctgtccctgcaggctcccagttcctctcagcctctcatccccttccctcccctcccctccccgccaccctgtctccatttccatctgctggctcctcgcccacccccagcctctggcagcagccagggcatctggatctgcttaactacacagccccagcctgcaccctagccccatccagcttcacaaactggagaccaacgaagtgtcaagagccaggcccagctgagtggcccaagtagccagaccaaggagccaggttcaggcgagaagcctggcagccagggcaggggtgggcctcagggtgggagtgcaggatgggctcagatccatgatgacacccttcccccagggtgataaggtctgcctaggttaatcagaggcagtgataagccctggaccaggtgggggtaaataccagaattcccaacagctggactggaggggttaatgggagtggctgagctggtgccagtgcttggtgccaggggtgggcgccaagggcagtggagggggagttgctggcacagtctgttgcctccggcttttgttctgggccctaagcccaggactgagatggagggtgtgagggggtgtgtgtgtccgtgtgtgtgtgtgtgtgtgtgtgtgcgcgcgcacgcacatgcaaagcactgggtatacagtgggaaaggggacctcaggtcagttcccgcagtgatttctaacagccttaccccacttggtgcatcaatttttctcctaggaagcctcagttttggagaggaagagccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccgggtaagtgccccacctgcctgttggtctgacactcatgaccctttcttgactctgcctagtcctcatgtcccgcccctcccatccttgcccgctctgtccgtaatcctcacctctctatctgtcctaaccgtctaactatccttattcaacagaaaattcaactggtatgttttgagcatctgccaagtgccaggtctattctaggctctgggatacagcagtgctaatgccaggcaaggtgcctgccttcaaagagcttacatcttagtggggaagacaataagcaaaggagaatcttgccagatagtaatacctgcagggcagaaaaaccaaagtgagggatgtcgaagaggacaactgagtggttactttttttttttttttttccgagagtctcactctgttgcccaggctggagtgcagtggtgcaatctgggctcactgcaacctctgcctcctgggttcaagcaattctcctgcctcagcctcccaagtagctgggattacaggtatgcgccaccaggcccggctaatttttttttgtatttttagtagagacggggttttaccatgttggtcaggctttgaactcctgacttcaagtaatccacccacctcagcctcccaaagtgctagattacaggcgtgagccaccgtgcctggcccgtggttaccttttaattggtagttaggaaaggtctctctgaggagatggtgttgaagctgatttctgaaggtcaggaaggaggcagccatgcacacattaaggtataagcgctcgtgacagagggagcagctagtgcaaaatgtcctgaggtgggaatgagctcaatacccccgaggaatagaaagaagaccaatgtagctggagttttcagtgggtgagggggagagagataggagctgaagaaggaaaggaaggcaagggctggctcacaaggggctttgaaagccagtaaaaggaatttgggttctattgcaaatgcagttagaagccaatggagagctgtggcatggtctgacttatgcttgacatcttgtctttgtccattgtcacctcatctcacttccagggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctgtgagttggggagggtggcactgatgacacatagggatcctgagggagtatgggacctaagtaagccctctgggaccaggaggacctgaggactgctcagtctccaggtgtaccctctgcctctagaccctccagcccgccctgttgtctcctgccaagcagccgactatgagaacttctcttgcacttggagtcccagccagatcagcggtttacccacccgctacctcacctcctacaggtgtgtgtgtgattgggtgtggatgcctacacatttgggtatgctggtgcaatgtgggtgtgggaggcagggaggtaggttctgaggaaagcctcagagagggcagaaggccctcttttccttcctgacttcagatggccccctccccaccaggaagaagacagtcctaggagctgatagccagaggtaggacgtgagggagcatgtgggggctccagctgggtcccacagtaggcattttcaaagccaaagaccacatcctcccttctaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatctgtgagtacccaccccagacctcccccagacccccatcacagagaccccaaatggactcagatctctccactcccagagctcccagtttcctcccaacctagactccatttcacacagagaaggccctgtggagcctgagaaggcaaagggatcagagcccaggaggcatggttatttcagcacacactctagaggctgctgctgctacccacactgcctgattggctgcctagcctcagagcaggccctgtaccgaatgcagccatatgtcatgtcctcccttgctggcccctccttccttgacctgtgcatgggagtgggacactaaaactctagctggaatttgggccaattcatcttccttggatgaaaataggaattgctcttttattcactcaagaagcacttcaaaagtccacccgcagatctcaggtggtttctttttttctttctcttcctttttttgttgagatagggtctcactttgtgcccaggctggatgaagttcagtggtgtgatcttggctcactgaagcctgcaactcctgggctcaagctatcccctcacctcagcctcccaagtagctgggattacaggcatgtgccaccatgtctggttaatttttaaaattttttgtagagacagggttttgctacgttgcccacgctggtctcaaactcgtggcatcaagtgatcctcccgcctcagtcttccagagtgctgagattacaggcatgagccaccacacgcggcctcagcccatttcataatacagatgaccggtctgagtctaatggatgatcaagtttaagatttcccctcccctctcaggagtgtctggctaaggctcctttaaacacacactttgggaagtggtggggaagtgatggagacccatagcctaccctgactttgtgtcttgatgcccttagtgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtgaggcctggagtgcgtcccaacccacggctgtgggtcctgtctctgatttcacgatcctgggtgttctgtatagctttccagtgctggcaggtcactgaagacccaacacttccctgtgggccaggctttgtactgggtgctgggttgcagtggtgactgagagactgaatgtctgtcctgtggggctataactatgaggtaaagcacatctgtgggaagatagcaatggcttttaaaaaaataactttttttttttgagagggagtctcgctctgtcacctaggctggagtgcagtggtgcaatctcggctaactgcaacctccacctcctgggttcaagcaattcttctgtctcagcctcccgagtagctgggactacaggtgcccgccgccatgcctggctaatttttgtatttttagtagagatggggtttcaccatattgcccaggctggtctcgaactcatgacctcacgatctgcccacctcggcctcccaaagtgctgggattacaggtgtgagccacggcgcccggcctaaaaataactcttaggaaaaggagtgcctttcacctagaggcacattctcctacaaacactcatatacccagctgaggatagcagtgaatttgtgtctcaggagatgttaaagattggctggtatcaggactagggagcagcagcatcagataataactaatatttacttagtgctgcctgcctgtggggtacctggctacactttttgcatacattgttttgtttaggtagattcacctctattttacaaatgaagaaactgagtcacagagaggcccaaagggtcattcaatatgtggttcaccaaagatttgaacccaggctgcctgatgccacagcctctctaagtaatcactactgccgtcttacaaacactaggtgtagactcagctccaccagacacccaacatgagacctagacagctccactaggctttaggatgagactgggagcaaggggtgctctttgtagatggtggctgggaaggccctgcacttacaagctgggtaacagtgagtcatgtttacccccaggtggagccagctggactggaggaggtgatcacagatgctgtggctgggctgccccatgctgtacgagtcagtgcccgggactttctagatgctggcacctggagcacctggagcccggaggcctggggaactccgagcactggtgagagacaaagccaaagaaaagggcagaggccccatcccaaagcatctatcagctgaaccagttccaaaagacaggcaggtggcacatgccctgcccacacaggcacggcaattgctgtcccagacttcagacttgtttgcctacagccctgtcttagcttaagtcctgccccttggcctccacccctgcagttacaggctccacttctacaagcttggagcttgccatgctccctaggagctggccatgccctatcaggctcctcctcctaggtaccttgacttccaacctaggccttggccttgagcacaggacgtgacccccgtccccaccagcgtatggacacttattgggtcttgccttcctttagggaccataccaaaggagataccagcatggggccagctacacacgcagccagaggtggagcctcaggtggacagccctgctcctccaaggccctccctccaaccacaccctcggctacttggtgagcttgggcagatgggcaagacttgtaaaggactgaaaaccccagagaaaaggggacaccgagcttggtcaggcttgctctcagtgacatgtggccctccccctcagatcacagggactctgtggagcaggtagctgtgctggcgtctttgggaatcctttctttcctgggactggtggctggggccctggcactggggctctggtaagtgactgccattggtccctcagcctctgatcctcacacatgctctgatgcccatagaccacattcatctccacccttcatgactgcccgctgaacctgtctgattctggaactacctccccatacctccatcccccatgccccacttgattttaactgattcctctcctgaccctttactaataaaccctttggcggagactgagataacccacattgttggagagacagctgcctttctatgccccaggctgaggctgagacggggtgggaaggatggatccccaaagcctgggttcttggcctcagtgattccagtggacaggcgtccaggtgagtaggacatccagaagatttggacttggagatgtttgcccctattttgagtgtccagattaagagctggctgccctagtcattttaaaacatgctgggaatccaagttgggtctcctcattttaatgatgtctaggctgagggctgggcctttcattcttgagtccctgggctcagaagtgggtctctttccctcctctcagggtactgaggaaggaccccaggtggacttcccttcagggtattagtattagtactaatactcttccagggtattagactcagagctggatattcatccttttttttcaaggtgtcttggatcagtgctaggtcccctccttcattcttaatgtgcctgggcccagagctaggtccactcccgtatcttcagtgtgttgaagaggctccctcagagctgggctcctctactcatcttcagagtgttaagcttagaactgagtcacctccctcattctcagggtgtctgggccaagatccggtcttactgtctctcctgatttgcctcctgcttcttctaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagattatactcagaaattattatccaatgctgctttattatttggctattgggggcttcagcccattttccttagcatcccaaaattcagcttgggcagagtcccatggagctttctctcttggtgctcaaaccactgtgacaggctggggttctgggggtggatgcagatgctgcgttgagccaggtgaagcctgggtagagaaaggtccaaagctatgaccatagcttggggatgagattagggtcatccccaatgaccctaattaggggttaggagcaaggaccagatgaaaacctgagttggcaacagaattagcagttagggctggggttgggatcagcattaggggttgggactgaggtcagagtcaggggtatcaggggtgggagctcacacgaaagcctggaggtgacagtccccgtcagcctcctgcagttccacctggatgaccttcctcagtagcttgtctgagagtggctttcggtagagctgagtacagcaggcagtgctgggtggcagtaggaatgctaggggcaacagggccatgtgttcagagggatcctgaccaagaacctctctgccagacagctggaggttaggttggatttcctgggtcttttcaacttcatcccattcacccagacccccagctttctatacccccaagtactcacctgctgtagggtctgggctcaggagcaatgacagcagcaggaggctgcagaaggttgggggccccttcatgttgctcagcctagactcttccttctctctctctcctcctcccctaccttttatctgggtgccttttacctggggcactaggtgagtcagaggcagttggagatgtactgtgtaacctgtgacactcctgggccctaattctcggcctgttgccacagactccttcctcatctaggatagccatttcccatgtgctcctaagctctgggcagtgaagctgggggaaggattagtgtgtgatgtagggactgatggaacagtgagtaagggcagtcaagcatccacagcagcatctaatgatagacattcacactcaaatacgcatagccacacattcaaagtcactcctcaatcacttggtcaacctcacaaagtcatactcatgatcagacaaccgtagacaaaattatatagccccggttatactcaaagtccctctcccacccaattgtgttttcacagtcatccaatcacaagcaaattcacactagcacacacagattctgataggggagttgtgggtggggtgggagcagagggcaggcaagcaccaacttgccttcaccttctcctccccacttcctggcttggcctgcctgtcttatcagaagaaatggatgggaatgggtccctagagcaggcccttctggctgaggaggttcttggctgaggccagccccattcagagaagctgggggaaggccctttatggtaatattaagggtgttttggagatgctgaggtggggcagctttccccaggatgatgagacagggaggaaaggtggggtagataaggagggaagataaaagctctttggtgctaggttactgttgtcaaaacaggtaaaaggcccagtgaatcttaccttcctgtttttgtctagtcctgttccaggaatgccaacctcttgccagcaggggcctagggtctccagatccagtccctgacttgttgaagacattggactcaagcactcaattacatctttgttttactcaaattccagcctccttcctgggcctggaggaacatcccctctccctacccgggttcagtcacaccctcatgtccaactgctataccccctgcatcccaccctccagctatagccgcttctctcctaatcccatacccagctgtcactccgttctttaccccctccccgcaatgcaaagctcctattcatctttatccagtcctttccaggaagctgggagctgcctagggtgggggtatgctgccaagttcagtgcccctggctcctttaagaat

SEQ ID NO: 13113 - DNA, 246444 bp, Human
  misc_feature (1)...(246444): n = A,T,C or G
cactgcaacctccgcctcccaggttcaagtgattctcctgcctctgcctcctgagtagctgggattacaggcacgtgccaccatgcctggctaactttttttgtatctttagtcgagacagggtttcatcatgttggcgaggctgagtctcgaactcctgacctcgtgatccgcccacctcggcctcccaaagtgctgggattacaggcgtgaaccatggcgcccggcctaaattctttaaagaggttcaagtcattagaagccttctctcgattttttggtaatgcagatggcaaagggtgaaggaggtatagggtggaagaaaagtaaacaaaagaacaattgaattttttttttttttttttttaatttgagacagagtctcacactgtagctcaggctggagtgcaatggctcgatctccactcactgcaacctgcgcctcctggttcaagcaattctcctgcctcagcctcccgagtagctgggattacaggcacccgccaccatgcccggctaattttttttgtattttcagtagagacagggtttcactatgttggccaggctggccttgaactcctgacctcgtgatccgcccgcctcggcctcccaaagtgctaggattacaggtgtgagccaccgcgcccggcctaagaacagtttaatttttaagaccaggaagcaaacacagaaaccaaatacatggttttttgttttctgtttgttttttcttttgcagctgtgaggaattttactcaaattagataggccttgttacccataatttggaattctcacttggatttgaccaagtgaagtagagttggtcaatgggaaaaagacaaacaaaataaaaaaaaacccaacaatatgatcactgagcactctaatggtaagcagaaattaagaccagctggttgttaactttagccaagacaaaaatccctattcagctacttacctaggggtgcgtctcaggctgaaaacggctgtctaccatcccagaagtaggaaaaaaacccctcatcttccctgttggaagtgagctcaaactccataaaagagttacctgccttccctcgtcatggaagcaggaaaacttgccttccttgttggaagcaagtaaaactccaaaataataataataataataataataataataataataataataataatagagggagttgtacaacaaaatgaactttagatctcgaccaaattttgggagatcagggattctctggagggggtgctcctagaccttagcaaattgtcctgttggtttgagccatggagttagctcatgttggtaccaagcatggataggagatttgtcaaagatcagaggtatctccactcacaatccctccgtggttaccatccttcattcagtaaatatttacggactgattaccatacactaggcactattccagacattggagatacaatgatgagcataaaaaacggtctagataagaactgaggtctccagacatactttatgcccactcagttttgtcttttgccctagttgctaaacaaaacttaactttgctgtgcggtgcgacttcgttaacttaaaattacaggctgtcagctatgaccgctagactctaagaaagtccagtggaaatccttcaatgaaaagaatctgttcttgggtggaagccccgctcatgcaggaggaacagagggcttccattctcgcgtcacacaactgagggtcaaccccttgctccctgcagtaagcctgattagtgggcggagcttccttcaggatcgcaagaaagaaaggaggaaggggaccccgcctcctacgtgctcgcgggggggggcggggtcggtggactgggcgtgagttaattggctggggggcggggcaccacgggttggctccgcccaggcgctcgcgcggatcccgggtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaactttacatcccgtccgtgctttgggggtctattattttggcaatcacttaacaatcacttgagttctttccactttcttgttttcccccaagctcctgcaagggacgattagctctccattctggtagccatgtgacaatgttgttggactgcaggctcagatcctattaaacagtgactggggttctctagtgagagtggacgagttagaagaccgcggatggttggtgcctgtgaatggtgggcagcctctcattcttttcctcctcctcgcaccgtaacgctacagtatgcttagtagcaggttctttttatcacactttgaatgcgttagtggtacagctgtcacatcccttctattgcttgtcttgtcccctgccacttccctgaacactaaccggtagtataggctaagattattcttctgttccacttgggaggatgtggtgactgcttttgaggataagaggtatgatttatttttatttttattttagcttgcctcacagtaactcaaggtgaagggccattattgcttttcccctgaggacacttgacccatctaagaagatatcttaaagcaagagctttggggtttaagatgaggcatggtacgcgaactaagttctatgtgggtagagactgtttcttattagtttttgtattcctggtgtctgacgtagtagaagcttaatgctggttttgaatgaatgcaagtactgtgacttcagagagattatctgatcaggaaaacacagggtttggattagccattgaatttgatctcgggaaattcaggttacagcctatcatatctgatgtgtcttgattatgaatgagagagcatttatcaactagagcctttacctgatatcttttactggagagttcatatttcttttggctctacagattagaagcattgttgttgtttgtgatttctccaataacgatgtttcccccagctactggcagatgaaactgctttgctctgttctcttccactattttgttgaatctgcattaaccaaaatggatttggccatttcccgggattatgagatatacagtttttcttctttcatggttgatttttcattaatgagaattttgctttgcttttagtaagacattttctctcagcagctgggaatctatttattcctttagatccctgctgctgagtagcaggatttgggagaggttggactttgctgtgtctcttggacagtttaattctctacggccacactgtattacagagctggtccttatgaaagactctttaggcaggagcactcgtgaatcagaaattcctatttaactgaatttatataactactggtgttttcatttgttttaatagcaggcaggtttcattgtctagaaattctgctatttagctaacttctttcctttttaatgttactttagtgaagtttcttcttttttgaatctggagaaacgagatcagcaggccattgtctttttgaatagagatctagaagattttaaatactgaaacaaacaggtaccttatatgcagatattcatattgaatggcaaagtattcattttgggaaaacttacagaaatgaattgaaatacatctttatttttatttctttttctttttttgagacagagtctcattctgtcacccaggctggagtgcagtgctgcgatcttggctcactgcaacctccacctcctgggttcaagtgattctcatgcctcagcctcccgagcagctggaattacaggagtgaaccaccaggcccggctaatttttgtattttttgtagagacagagtttcactgtgttggctaggctggtcttgaacttctgacctcaagtgatccatctgccttggccttccaaagtgctgggattagaggcataatccactgcacccagcacaaaatacatctttctaaaatgacattccttgcgttgtattttggcagtaggaatgttgtattctgaaagcagtctatatagtgatatttattacaactcaatttcaattcatcttggagtagaatcaattagaaacttcctatgcagagttcaaaaagtagttaacttgatgtagaaattggcaaactggtattgaattaatcattcctaaacatttcattcaagaagtcagttattttgtcttgccctttaatcatgccttattgcctgcaggtttaaggctctcaatactctgactccagacttgtggccttctattcttgcctatccttatgcagactttgctctagcactaactttgtttattcctgcctctgctctgttctgcacttgtgccccctgaaatactcgttccatattttctgcctatctaaaatgtattcttactttcccagctaacagtctactttttttgttgttgaaaacttcttcaggtccccagtccacagtgatctctttttcctttaaatcctcggagcacttgtggtctgaacagtgccactagtttggaaatgaatcatatgctgcctgcaactggtcttgtattgtggtgcttatggtgacccagacaaaggaagtaattgcactggtcagatcagatctggaattttgtgttcagctgtggtatttccttctaagaagcatattgagaagctaggttatcttaagaggggagtgattagaataatgaaacatgtaggaaccgaaccatttgaagaatatgggaaatttagttctagaagatttaagaggaagaggatcacgatagtacatgaagactgtttaaaaaactgtcttgtagaagttatgtcaccttttttgttgtcattccagaggacagaactgggacaagtgtggatcagtggttgaaaatgacaggaaattagattttagcttaacataaagaagaacagttgggttgttcagaacaaatggaatgggctatgtagattttttgacactaaacagaaattgaatgagtggtaaggattctaaaggggatattgaccattcagcgggtgattgacttgaatttttttttttttttttttttaattttttgagatggagtctctgttgcccaggctggagtgcagtggcatgatctcagctcactgcaacttctgcctcccaggttcaagcgattctcctgccttagcctctggggtagctgggattacaggcgcctgccaccatgcctggctaattttttgtatttttagtagagacggggtttcaccatgttggccaggctggtctcaaactcctgacctcgtgatctgcccacctcggcctcccaaagtgctgggattacaggcgtgagccactgcgcccggcctagacttgaatttttaagaaaccactcttttatagaattcacttagtctttctttaaatatttccataagtataaagaaatataagtctttaacatgttttggcacagctttacttataatacggatactttttttgggcttccatagggaccagtgccacatgaacaactgcagtaaactaaattaaggattttgtttgacttttattgtcttggtattcacgaccaagtttctccaagcaattataagcatttttagaatcagacctttccataattttctctgtnnnnnnnnnnnnnnnnnnnntatttagtgtgtgtaggccgatggcgttagatttccatacactcaacattggggagaaacctcattggcagtggagtggctggtggtaccagctgggggtcccttctttggtcctttgagtgcagagtctttgccctggttgttccctgctttcactattaggagaagccacttgactcatggctggcagatagcacaccagtttcagtaccttgctaaatttatagaaaaccagtgtattaaacagcgaggtatagatagaaactgttttccaacagtgggtatttgaatattaagtagtagtaaattagccaggtgtggtggcacacacctgtggtcctagctacttgggaggctaaggcatgagaattgcttgaaccctggaggtcaaggttgcagtgagccatgattataccactgtactccagcttgggtgacgaagtgagaccctgtctcaaaaaaaatatgtgtatggtaatacattgctaattatagaaaatttaaaaaatgcagaaaagtacaaaaaaagaaaaaaatttccatgggcctaccacctgccaataccattgctaactttttttttaaatttaattttttttttaaagatgggatctcactatgttgcctaggctggatttgaactcctgggctcaagtgactgtcttttctcagcatcacgagtagctgggactacaaggaacacaccaccacacccaactattgttaactttttaattcattgttttcattttgtttttattataaggtgataaatatacagataagaagttgaaacagtttagagtgtaaagtagaaggaaaagttctcttgtccccattcggtattcttacttcccagaggtaactactgtttactgtctcttacctatccttctggaaattttcattgcagatgagtatataggttctgcagttgaatgtacatagcattcttcagctttttttgttttttaacctcaatgatctattttcctgtcaggtcatctgagtctaaaccaagcttgtccagcctgtggcatgtgagctgcatgtggcccaagacggctttgaatgtggcccaacacaaatttgtaaactttcttaaaacattatgagatttgtcagctatcattagtgttagtgtattttttttattttatttttattttttgagacagtctcgctgtgtcgcccaggctggagtgcagtggcgcgatctcagctcactgcaacccctgcctcctgggttcaagcgattctcctgtcagcctcccaagtagctgggattacaggcgcccatcaccacgcctggctaattttttgtatttttagtagagacagggtttcaccttgttagccaggatggtctcgatcaccttacttcatgatccgcctgccttggccttgcaaagtgctgagattacaggcatgagcgcctggccagtgttaatgtattttatgcatggcccgagataattcttcttccactgtggcccagggtagccaaaaggttggacaccctggtctataccattcttttgaatggctgcagagtattctgttatataagcatacataatttaaacagttttatattgatgatattcaggatatttttcttttcactattacaaacagtgctacaatgaacatctttgtaggtttttttttttttttttttgagatggagtctcacactgttgctcaggctggagtgcagtggcgccctctctgctcactgcaacctctgcctcctgggttcaagcaattatcctgcctcagcctcttgagtagctgggattacaggtgcctgccaccatgcctggctaatttttttttttttttttttttggatttttagtagagaagggggtttcactatgttggccaggctggtgttgaactcctgaccttgtgatctgccctcctcggccccccagagtgctgggattacaggcgtgagccaccacgtccagcctgtagatggtttttaaacatttgtttttatttttgagacagggtcttgcattgtcacccaggctggagtgcagtagtacgatcgtggctcactgcatcctcaaactcctgggctcaatctgtcctcccatctcagtctcctgagtagctgggactacaagtgcatgccaccatgcctgactaatttttctactttttgtaggatggaattgccctattttgcccaggctggtcttgaacttctggactcaagtgatctgcccaccttggcctcccaaaatgctaggattacaggtgtgagccactgcacctgaccagtttttttattattaatttttttctttccaacttttaagttcaaggggtacatatgcaggtttgttacatgggtaaattgcatattgccatattgcaggggtttcatatacagataattttgtcacccaggtaatcagcataatacccaaataggtagttttcagtccttaccctcctcccactccatagatggtttttgttatatgtttggagatctccaattagctttccacctggactttatgtgtaattttctcattgctgttttctttggcatataattatactcagttggaccaaatgcctcggtgtctcagatcaacatcctcaattagaggcagatccttcagcagcaggtaatatttttctatgcctgttgaaaagaccaaagactctgctcttgtaagtaagtttgacctgtgatttccatgtacttttctttcttatttgtattttattttccatatgaacatgtattacttgctttttttttttttttttgatacagggtctcactctgttgcccaggctggggtgcagtggcatgatcacggctcactgcagtcttgacctccctgggctcaggtgatgctctcaccttagactcctgagtagctggaactacaggctttcttgtagagacagggttttgctatgtttcccagggtggtcttgaactcctgggctcaagcaatctgcctgtctcagtctcctaaagtgttgggattaacaggtgtgagccactgtgcccgactgcatttttaaaacagaacaaaacaatgtcactggtgaatggtaacaggaccaagttgatttatattatgatttgccctttaaaaaactcgttactggacaggtgaggtggctcatgcctgtaatcccagtactttgggaggctgaggcaagagaatcacttgcatccaggagtttgagaccagcctgggcaacatagcaagaccccattcctactaaaaaaatatttaaaaattagctgtgcgtgttgacgcatgccggtagtctcagctacttgggaggcgaggcaggaggatggcttgagtccaagagattgagggtgtagtgagccatgttcatgccactgcattctagcctgggtaacagagccatctcaaaaagttcatggcttatcattaatcatccatctaactagacacgttgattgtgcattgattctactctagggaaagtccaaaaatatatttcggtttacagccattgtggaaagtaggaatggtaatgatattagagttttcagacataggtataggttggtcagatacttctcatctccttcccccatcctgccaccccctgctgaatgttattgtcatctgcctcagctaactcctttttgctgggcttccatcgatcgtggttctagtagtccctgcccttagagcagagctgtggctgtgttcctttcacttagggcctcaggaagttgattgtgctttgtgtgagccaggcagtgatgggggaaaggaccaatttgctctgctatgctattgttataaactgttctgttccttataagtagcgtattctgtaatttagtttctaaaaatggggtttctgaaagttgggctctttaggccaataagcttaatttttatcctatttacctgtgctgtgtatttcagactttgagtttgtttaaagtttgggctgtgtatcattagtaaatatttgttggatactttctctgtgcatgtttatgacacaaatctgtattgtagataagaggccacggaatctagataggttttaaaatgtctgttatacagtgttcttatataaactcaaataatccattaggattattaggtctgatttggaataagcagaataaattaagttcttccttgagtagggaaataactgcactgtcttgttttaacatttattttcacattgttattattactgttttttttttgttttgtttttgagatggagtctcgttctgttgcccaggttggagtgcagtggtgcaatctcagcttactgcaacctctgcctcccaggttcaagcgattctcctgactcagtctcctgagtagctgggactacaggtgtccaccaccacgcctagctaatttttgtatttttagtagagatggggtttcaccatgttggccaggctggtctctaactcctgacctcaagtgatctgcccactgcggcctcccaaagtgttgggattacagatgtgagccaccacgcccagccttattttatgattagttttttgagactggatcttgctctgttgcccaggctggagtgcaatggtgcgaacatggctctctgcagcctcgacctcctgggatcaagtgatatgctcatttcagccttctgagtacctgggactacaggtgtgaactaccatgcttggctaattaaaaaaaaattttttttagagatggggtcttgctatgttgcccaggctggtcttgaactcttgggctcaagcaatccttctgcctcagcctcctaaaatgctgggattatagtcatgagccactgtgcatttaaagcaagagtctttgagtttgggggtattttatatataccttctctttttttttgagacaggttcttattctgttgcttaggctagagtgccatggtgctaatcagggctcactgcagcctcaatcttgccaagctcaggtgattcttccacctcagcctcctgagtagctgggactgtatgcttgtgcaaccatacatggctaatttttgtattttttgtagagacagggttttgtcactttacccaggctaatcttcaacctgtggagtcaagtggtctgcccgcctcagcctcccaaagtgctgggattacaggcatgaaccactgtgcctggctcctttttttttgagatggagtctcattcttttaccccggctggaatgcagtggctcaatcttggcccactgtaacctccatctcccaggttcaagagattctcctgcctcagcctcccaagtaggtgggactacaggtgcccgccaccacgcccagctaatttttgtattttcagtagagacagggtttcaccatgttggccaggctggtctcaaactcctgacctcaggtgacccacccgccttggcctcccaaagtgctgggattacaggtgtgagccaccatgcctggtctcaagtatagttttttaaagaaagaagtctcactctgttgcccagactggagtgcagtgatgtgatcatagctcactgtagcctcaaactcctgggctcaagagatcctcccgtctccgtctcctaagtagttgggactacaagcatgtgccaccacacctggctaatttttgaaaatttttttgtagagatgggtctccctatgttgcccaggctggtgtcgaactcctggcttcaagcagtccttctctctgggactcccaaagttctgaggtgacatgcatgagccactgttccctaccccaggctagtttattttgattaacatgtttgtcagattcttccacttgatgtgtgtggcagttagttcattgattttcgttgctatgtagtatcttgttagatgcatatactattgtttatttatttaatgtatttcttaatctcatgacagtgtagattagattatgtggggagaaattggaggcacttgaattatagcaggagtgatttagattaaacataaattaaaatttcttgatgaaatttgaactgccacagaaaagctgtgaaatttatttttctatggctcttcaaaaataagccctatttccttcatttaaaattttatttattaatttttttttgtagagatggggtctcactatgctgtccaggcaggtctcaggtctcaaactcctgggctcaaggcctcctcctgcctccgcctcccaaagtgctgagattacaggtgtgagctaccatgcctggcccctttgttttttttttttaaattgatatgtcatagatgtatgtgttttggggatatgtgtcatatttagataaattcatataatgtgttaatgatcaattcagggcaattaggatatctgtcacctcaaacatctttcatactgggaacactggaattctcttctggctatttggaaatctacaatagattttcattaactgtaatcatcttactgaactatcgaatactagatcttattccatttatccaactgtatttttgtactctttaatcaacctttcttaatcctccctctcctgtttcctttcatatactatattaggtgtaactgctctggatgaggaaggttagataaccagctttgcatttcctgttttgttgcagtcttttctttgattactgggaaatggaataaaaatgtaagcatatggttaaaatgttgtgttcacctttataaagtacattaaaaaattcttttgttatctttagtaaaaatgaaatgtactttctcaagtgtgatgtccagaaataattatccactgggtgtgtgagaaaggccaatagaatcaaaggaaaaagaatcatgaaatcttttttttttgtgctgatgaatcctttggtgataaaatatgtggtaaaaatgtgacaggaggaagtttgtgctaaggtgtaaggtctatttttatcctgtaagtagggagaagcaattcttagtcattaggaaatataggtttccaaaaagaagagtgttgttttcctgctgctgcttggttctctcttttgctatagtaagtgcttctttagagctgtagaagacaggcctgtggattgtgttgggctgtcaattttctcttgcaactgtttgctttattgatttctatagcgtttcattgtaaatgatgttgagaagaggttagagggcagggagggagatctgcctagcaaccaataaggggctggcagttggacagtgggaagataattgcttttatataattagagttggggcaaagatgattcgaaaggctagattacttacatgagccaaattagttatgaagcaaattttagagactttgtctgcaaaaggatagaggaaatctgcttgccaaggaaaggggggtaaatgatagatataaacctgtatgtctacctcacttcagccctccattcccacaattacaccagagagcatgtcactctttggaatggtgctctccttttgtaatcttaatcttcataatctatctttttttttttttttggggacagagtctcactttgtagctcaggctggagtgcggtggtgctatctcggctcactgaaacctccacctccctggttcaagcgattcttgtgcctcagcctcgtgagtagttgggattacaggccctcaccaccatgcccggctaatttttttatttttggtagagatggggtttcaccgtgttgcccaggctggtctcaaactcttgagctcatgtaatccgcccgcctcagcctcccaaagtgttaggattacaggcgtgagccactgtgcctggccagaatctatctgattgtattctttagcccatttttacagcttatactcttgctatgctttaaccactgtgatataaggtagatgttaaaagctttggttttagacagacatggcttggtgaatatatcagctccaacgctgtgagttgtctgcctttccatatgttacctcatctcattaaaccttaatttccacatctttaaaattcatatatttgttagggtagtagtaccagtgatggtgaaaatacctatagcaaagtattgctgacataattgttgtgaaagtgattagtactgtcccaggcatagaatgagtacttattttaatataaaaacagtattaatattcttcatccagctttatgatatctattcatctaagacagggagctgaaagtcttcctagacctctctctctctctctctttttttgagacagaatctcaccttttttgagatagtctcactctgtttcccaggctggagtgcagtgatttgatcccagctcactgcagcctcaacttccagggctcaggtgattctcctaccttagcctcctgagtagctggaactacaggtgtgtgccaccacacccagctaattttttttttttttgtcggggggcagggtctccctctgtcctccaggctgtagtgcagagtgcgatctcggctcactgcaacctctgcctcctgggttcaagcgattctcttgcctcagactcccaagtaactgggactacaggtgtgcgccaccatgcttggctaatttcttgtatttttagtagagatggggttttgccgtgctggccaggctagtcttgaactcctttttttttttttgagacagagtctcactctgttgcccaggctggagtgcagtggcacgatcttggctcactgcaagctctgcgtcccgggttcacgccattcttctgcctcagcctcccgagtagctgggactacaggcgcccgccaccacgcctggctaattttttttgtacttttagtagagacggggttccactgtgttagccaggatagtctcaatctcctggttccaccgtgttagccaggatagtctcaatctcctgacctcgtgatctgcctgcctcagcctcccaaagtgctgggattacaggcatgagccaccgcgcccggccacgtcttgaactcctgaccttaggtgatccacacgcctcagcctcccaaagtgctgggattacaggcatgagccaccgtgccctgccatttgtgtagagacaaggttttgccatgtggctgaggcttgtctcgaactcctgggactcaagtgatctgtctgcttcagcctcccaaagtgctgggattacaggcgtgagcccctgtgtccagcctagacttctcagttgaggaagaaaatacaaagagagggaggaaagttgggttccgttgagtttgtgggatctgtgagataagttacatgtgagatatattgaattgaatgtatcagtctcattgcagatgatccttgaaaatggtaacccaaatgtaggtttgtagcttagtagagaaatctgttagagataaatatatggaagttgcaggtatttggtaataaagacattagcttgaattaaaatacttatggagggtcagaaaggagaaaaaggggctgatgctgccgccaaggaactccagtgtataggaatgggcagaagaggagttgatagatgtggtcagaactgtaggaaaatggagagtgttgtgttagggtctgtagcctagagtacagcgagtttcaagaaggaatgatcagatgatagaggtgaaggagacttgttgaggtttaggaaaaaatgaagagatcattggatttgaaaacaaggacagtttcatttgggtaatgtgagggcaggcagtgtattatagtagctgatgagtatttgggcagtaaagaagtggaatgagcaagtgtaggctacacattcagaagttctgcagtgaagagtagggttaagagtagtcttaaaggccaggcgtggtggctcacgcctgtaatcccagcactttgggaggccaaggtgggtggatcacttgaggtcaggagttcgagaccagtctggccaacatggtgaaaccccgtctctactaaaaatacaaaaaaaaaaaaaaattagccagacattgtgctgcatgcctataatcccacttatttgggaggccaaggcaggagaaatgcttgaacccagaaagcagaggttgcggtgagctgagatcacaccattgcactccagcctggttgacaaagtaagactctgtctcaaaaaaaaaaaaaaaaaaaagagtagtcttaagaagaaatttgagtattttgtagcttgaagggaaggaatctgtaagaaggggaaagtcaagatgagatggggaagggagagatgataactgatttcttttgtaaagtaggatgcaaaattatcagctgatagtgaggtggtggggatgatttagagagcttgaggagagtgcaaagggttcattcatttattctttcaacaactattgggccgggtgtggtggctcatgtctataatcccagcattttgggaggctgaggcgggtagatcacttgagatcaggagtttgagaccagcctggccaacatgacaaaaccccgtctctactaaaaataaaaaaattagctgggcgtggtggcaggcgcctgtaatcccagctactcgggactctgaggcatgagaatcgcttgaacccaggaggcagagattgcagtgagctgaaatcgcaccactgcactccagcctgggagacagagcaagagtttgtctcaaacaaacaaaccaacaaacaaaaacaaaaaaaccccacaactgttgtgctaggcacttggggaggaatggtgaggaaaaaacccctttccttcttggaagtttatatagactagtaggactacggaggagttagacattaaacaaggaagaatcatacaaattaatataaaattacgagtaggaaaaaatacaactgatttgtgctataaacgagagtacatgttattataagaacatgtgttaaggaaagttacctacacagatcagagaagtcctccctaatgaagtgaagactgaactgagatctagaagaagaggacactattgagagaaggagaagaatattctaggcagaggaaatagtatgtgcaaaggccttgcagtgggagaaggatctgagagaaggcaagtatagccaatattccaagagaaagggaaaatatggattaagatgaagctggggctcctgacctcaggtgatccacccgcctcggcctcccaaagtgctaggattacaggcatgagccacagcgcagcctggccaacatgacgaaaccccatctctatttaaaaaaaattaaaaaaaaattagtcgggcgtggtggccggtgcctataatcccagctactcaggatcctgctgagacaggagaatctcttcaacccaggggcggagatttcagtgagccaagagtgcgccatctcactccagcctgggtgaaagagcgaaactccatctcagagaaacaaaaaacaaaactatagggccttgtaggcaacataaggtggaaagttagcgagaataagaccgaggaaggggcagaagtatagaagtttataaactgaaagcactgggtttctactttgatttgtttgaatcctttttctaccagtgaaagcttttggcaagcctcttgactaccaagccacaattttaaaatggaagtgttaacatctgccccatgtaccttcataaagttgatgagaattacactcttaagatcatgtgtttgaaattctattgtataataacttttactctcagtcctttttatatcttgtttgtagagacttaactgttttgaaacttataaacaaacaggatatgatcagttccataaacatttattgagcacttaactatgggtgaggcattgaacttgtcaccctgggtatataaaaatgaggaagaagtgggccttgccctcaagaaattgagggcaaagaaagggtgacagccatgtgtacagctaagcatgatgcaagacacaaatggataatttctaaaacagaaaaaatataatggattgtagaaattccaactgagggacagggaagaactgtagaaaaagtcaagttttccattatggtgtcactcattaattgggatacgaagcatagaaagaaagaataacaacttctggggagatgatttgggtgttggatatgttgaatttgaagagttggcagtccacgtgttaaggttggaaatgttactcaggagatcagggttagagtagatttggtctgttctttgtggatctgttgtgtggaggcacggtgacagggtaaacatatactcagcatcatcattataatatactccatttcatccactataagatgccatagattgtaagaggcatcattattttatgtattatttgaaaaatactattgctgggcacagtggctcatgcctgtaatctcagcattattgggaggccaagacgggtagatcacttgagtccaggggttcaagactagtctgggcaacatggcaaaaccccatctctacaaaaattaggcatggtggcacatgcctgtagtccctaatacttgggaggctgaggtgggaggattgcttaaacccaggaggcggaggttgcagtgagctgagatccgccactgcactccagtctggaggacagagtgagaccctgtttcaaaaaaaaaaagaacaaacaaaaaaacacatacacacacacatacaattgattgctctatgacatgtcattgattgtaagattcatttcaatttcagagtggttacatatgagaaaataggccagtggctcacacatgtaatcccagcactttgggaggccgaggcgggtggatcacttgaggttaggagtttgagaccagcgtggccaacatggtgaaaccccgtctctgctaaaaatactaaaattaactgggtgtggtgcacgcctggattcccaactactctggaggctgaggcagaagaattgcttgaccttgggaggcggaggttgcagtgagctgagatcgcaccactgcactccagactgggtgacagagtgagacagcctcaaaaaaaaaaaaaaaaaaaaaaagacaatgtctcaccatcttagaatcaatgaaatactgaagctaacatttaatgagtctttactctttgccaataagtaggtaagggttaatcatttaattcttgtaataaccttgttatcctcattttacaaatgagggcactggcctactgaagtttgtccttttccatactgaaaagctgaatttactttttttgctttactcttaactatacaatacaataccaaattaattatacagggtagtgctttggaacatgaataaaatctatttttaataaaagtatttagggaaagatggctgttatgcattgttggctgtgaatcagagtctcactatagctgtggtttctgtttgcttaggatatatttgtggacagcattatagcaggtgtttcatagactggagagttcattatggctctagtttaatattttcataaaaaataaaaggagtttaataaaatccctttttttcttgggagggagtgtggtataatggaaaatttgggattctagagaactcttgaatctcgctaggtagtgactaaaactgtatctataagtaagtttcttaacttcactaagaatcatcttctggccaggtgcagtggctcgcgcctgtaatcccagcactttggaaggctgaggcatgtgcatagcttgagcacaggattttgagaccagcctgggcaacgtgacaaaaccctatctctacaaaaaatataaaaattagctgggtgtggtggtgcatgcctgcagtcccagctttttggaaggctgaggtgggaggatcacttgagcctgggagattgaggctgcagtgagccatgatcacaccactgtgccctagcccagcctgggtgacagagtaagactctgtttcaaaaaagacaaaaaaatagagagagatgatactttagtggttttagttttaggtaaagttaaagcattaagttcagttaattgggtaacatcctaatttttctttacagttcactttagactgtaagagtcagttgcctaatgtaggaattaggtagatggatggctagaatgaccttgtcctgtgtgtgtataatcaaacttgggttatttctgataaacagtaaccatagaaatctgattgtgtattaatgtaaactctattccaactgaggtttatttatttagaaaacatttagaaagatacacttgaacacttgtacatgctcaattataaccttaactgtgtttactttataattagtcattggttttgttagttgaggtttgacgtaagtacttgtttgtcttttggtttgagagagaccttatagagagtaaattttattgatttttggagaaattaatttttttttcaaggacagggtagcatatttatatatatttcatctgtattctttttaagttgtgataagtcgctatgaagtaaagtggaagcctagcagtgatatctaagacttttgagaaatgtttgtgaatgaatgaaactaaagatatatggctgctttgcaagtttagttttgcttattattctatccataccatcagattttaatacaatttattcttttttttttacttgcttcatgtgagcataaattggagcattagctatttcagtcggtgtgaatttggtatcagtactgcagggagagggctgtggacttcaaaaattatgggcttttgaatctgtttcaattttatactgcattgtttaattaagtcagacttggggtacttagcctttctgagttttaatctgtaaattgtaaattacatactctacaacagtgttttttaaaattgtagcagtgtttgtttttgtttttgcttttgttcattagttctgaaatcagttaagtgggtgaccagcgttaggggaaaaagatacagagttttggccaggcagagtggtttacgcctgtaatcccagcactctgggaagccaaggtgggattgcttgaacccaggagttccagaccagcctagtaaacacagtgagaccctgtctttaaaaaaaaaaaaaaaaaatgctggatctgtttcagcaggtacctgtagtcccaggtactcaggaggctgactgagatgggaggatcacttgagcctgggaagtgaaggctacactgaggcttgatcacacctctgcactccagcctgggcaacagaatgagacgctgtttcaaaaaacaaacaaaaaaacaaaaacaaaacaatggcatttctttccatattagtgtcctgagtttttctcttttattttcattcaaaaaattttctctagtgccttgatagggacccttatttttcttatttcacagatgtaactaattttaaaatcctttatctttgtttttctatgtttcatgattttaagcaaatctcttagagcaagttgttggattctgttttctaaaaaaaattcagtgaatgtcttttggtattgctgtgtctcagtgatctagaagctgtgttttattgacatatagtaactgagatatgacctgaaatttatttaatctgtttctcatgtttctcacctataaaatggagataatattagtacctatacggtactaattataggcatgagccaccattcctggcctggacaactttttatatcaatgaagatcgatctggccaggtgcggtggctcatgcctgtaataccggcactttgggaggccggagtgggtggaccactcgaggtcaggagtttgagaccagcctggccaacatggtgaaaccctgtctttactaaaaatataaaaattagcctggcatggtggtgcgggcctgtagttccagctactcgggaggctgaggcagtagaattgcttgaacccaggaggtggaggttgcagtgaggccagatcagccactgcacttcagcgtgggtgacagagactctgtctcaaaaaaacaaataaataaatacataaaaaataaaaattaagatagatctgcccaccaaactatccttgaaaaaccctaaattctgagtctttggagagattgatttgagtaataactccatctcctgtgtggatggctggacctgcatcagttaaactctttactgcagtgccatggtcttggtgaactggttttgtttgtgcagtgggcaggaagaagctgtggagtgattataggattaccagccctactggactttatttttgaatactacttcttttacatttgttcctatatcatcttcagtaactccaatatctgtgtgttagagctctttatatcttcctacttctcacctttaaaaattataaaaccatcagttttcttgaaagttgactcctctattgctgcttctagtgcatttttatactttttctcatgtttaacttaatattctttctcattgagcttccttttgatttttatctgcctctcagcagtcttcctcagtcttctgcttttcatcttttgcttctgtgaccccccctttttaaaatttagaaactgtgaaaccaatgctgattaaaatttatttttttaacacaaaattttattttattttatttttatttatttttatttttattttttttagtatttattgatcattcttgggtgtttctcagagagggggatgtggcagggtcatagggtaatagtggagagaaggtcagcagataaacacgtgaacaaaggtctctggttttcctaggcagaggtccctgtggccttctgtagtgtttgtgtccctgggtacttgagattagggagtggtgatgactcttaacgagcatgctgccttcaagcatctgtttaacaaagcacatcttgcaccgcccttaatccatttaactctgagttgacacagcacatgtttcagagagcactgggttgggggtaaggttatagattaacagcatcccaaggcagaataatttttcttagtacagaacaaaatggagtctcctatgtctacttctttctacacagacacagtaacaatctgatctctctttcttttccccacatttcccccttttcttttcgacaaaaccgccatcgtcatcatggcccgttcttgatggtcgctgtctcttcagagctgttgggtacacttcccagatggggcggcctggcagaggcgctcctcacttcccagatggggcggccgggcagaggcgctcctcacctcccagacggggcggcctggcagaggtgctcctcacctcccagacggggtggccgggcagaggcgctccccacctcccagatggggcggccgggcagaggtgctcctcacctcccagacgatgggcggtcgggcagaggcgctccccacctcccagacgaagggcggccgggcagaggagcccctcacctcccaggcggggtggccgggcagaggcgcccctcacctcccaggcggggcagccgggcagaggcgcccctcacctcccaggcggggcggccgggcagaggcgctcctcacctcccagacggggcggccgggcagaggctcccccaacctcccagatgaagggcggccgggcagaggagcccctcacctcccaggcagggcggccgggcagaggcgctcctcacctcccagacggggcggccgggcagaggctcccccaacctcccagatgaagggcggccaggcagaggcgcccctcacctcccaggcagggcggctgggcagaggcgctcctcacctcccagacggggcggccgggcagaggcactcctcacatcccagacgatgggcggccgggcagaggcgctcctcacttcccagacggggcagctgggcagaggcgctcctcacttcccagacggggcagccgggcagaggcgctcctcacatcccagacgatgggcggccaggcagaggcgctcctcacatcccagacgatgggcggccgggcagaggcgctcctcgcctcccagacggggcggccgggcagaggcgctccttgcctcccagacggggtggtggccgggcagagacgctcctcgcctccaagacggggtggcggcagggcataggtgctcctcaccacccagacggggcggcggggcagaggcgctcctcacctcccagacggggcagccaggcagaggcgctcctcacttcccggacgtggcggtcaggcagaggcgctcctcacatcccagacgatgggcggccgagcagaggcactcctcacatcccagacgatgggcagccaggcagagacactcctcacttcgcagacagggtggcggccaggcagaggcgcccctcacttcccagacagggcggccgggcagaggcgctcctcacttcccagacggggcggctgggcagagggcctccccacatcccagacgatgggcggccaggcagagacgctgcccacttcccagacggggtggtggccgggcagaggctgtaatcttagcactttgggaggccaaggcaggcggctggaaggtggaggttgtggcgagccgagatcaagccactgcactccagcctgggcaacactgagcattgagtgagcgagactccgtctgcaatcccagcaccccgggaggccgaggcgggcagatcactcgaggtcaggagtgggagaccagcccggtcaacagggcgaaaccccgtctcctccaaacatacaaaaaccagtcaggcgtggcagcgcacgcctgcaatcccaggcactcggcaggctgaggcaggagaaccacgggagcccggggcagggaggctacagggagccaagaccaccgcagtacagtccagcctcgacaacagagggagactgaagaaagaaagaaagaaaggggagagagggagacgaaagaaagaaagaaagaaaggaaggaaggaaggaaggagaaagaaagagaaagaagcgggggggggagagagagagagagagaggagaaagaaagaaagaaaagaaagaaaggggagagggagagagcacaaaattttaaaaatgtttctttacctttgagtcctatgttcttacattgttttataatcttttttcttggtcttcaaaacaataaaatattttttcctcccaagaataatgagatattcattcgtatgggggttcccttcctcccacctcaaacatattgagtattcttagatgatctcactttctgtttcctattagaagcctcctcttagattttatttatttacttttcctaaggtacttttgttatagcaagaaggctcctcttggattttaacaaaaagggctcagattgccagttaagtgcctcaggacagtgaggaggaagtcctggctacaaatcacccttttagagaaacttctctttgtggaggatattatttgtagttggctaagatgctatgtcaagttaagatctggtgtggccacattgttgccttgcactagaatagtcctgcttcctcctagagtatatgtcagctctgtgtagcttcctttggtacactagaaaatggtctgccactagtacaaccaactactatgtcctatgtcttgcaggacagttctcaaattctgccaagttgttctctgggtgctgcacctcattgcatccaaagagaatccccctgatttatttagcaagaatgttcttccaaccccgagcttcactttgggctcttgctacagcttttctcaaatcccgctagtttgcagctgttaaaagaactctctataatccgaaaataaaattctaggctgggcatgctggctcatgcctgtaatcccagcactttgggaggccgaggtgggcggatcacttgaggccaggagttcgagaccagtctggcctaacatgatgaaaccccatctctattaaaatacaaaaaaaaaaaaaatggtggcacatgtctgtattcccagatacttgggaggctgaggagggaggatttcttgagctctagatgtagagactgcagtgagccgagatcatgccactgcagtccagcctgggcgacagagcgagactctacctcaaaaaaagaaaaaagaaaaaaaaaaaacaacacagtaaaataaaactctaagccctccagctggctgaatggacctccccccttggccaagggaaacccaaagaaacctgaaaaactacttcagggcataaggagaaggggcatctgatatgcctcatcatacagtgttccctttggagtttagacacaactgaccagcattaacattaaaacagagatgttaagactgacaaaacatgactcttcatagcaccctactaggtgtagaccctactagatctgacatctcttaaggtctgataagagacattcaccacctattctctctgaagcctgctacctggaggtttcatctacatgatgaaaatcttggctttcacggctcccttatctaaactcaagcattttctttatgctgaattcaactcttcaggcagggcttaacttccaaccatttggcaaccaggaaatctttcaatccacttatgacctggaaggtcctcccacccgctgtcccactttgagatgttgaagaatctgtgttgtctgcggtaaatacctggggtttgtcatcttgcaccaggaaaatttaggacacagatacacatgaggagtttaggagcagaatttaataggcaaaagaaagagaaacaaagagaaaggaaaacagttctctctctagtgagagagaggggacttccaagaggaaaaagctgactggtggcagatgtgtcagattttatagtcagtcttgagaaggcggtgtctgatttacatagggctcacagattggttcaatcaagtatgatgtttacatagcacatggggaaggctggccacctcaccctaatcttattatgcaaatgaactttccccttgtctggtgccatcttgtctgctccttactgtacatgtggctggcagagaaaggaacaccgcgcccggccacgagatgcttccttatataaaaatttcttccctttataaccttctttgtatagccagggtgtgacatattaccaaacccaataagaagttcttgcagactcagtgatagtaaaactatcatgcttccttttcgttgggaaccattatctctgctattaggataataattaagcaaaatactacagcaatggaaattctctgtccgatattccggttagaaggtgctaccatctataggtcttactgcaaatagtaaagtgagtatagcaattcctgcaagtgtggtacagtagataatttccatgtaaaattttacttgccaagatatagaatctccctttggggatctatgaagtttcttggttttattttcccaaacagaaacatctgggttatgggcaccctattcactttcattacctggcagatgttgcaggataattgcccagaactagcatattgatccagctttttatattgcccattcctttttgtttcttccaggcttcaggagatcaccacttgattcacaggaataagcgggattagtctaaaatgtagtcaaaaaaacttaaaaacaatcattgagactagaatttagtgacaaatggatgataagctttggagcataatttttctctctccagtctttattttaggtaaaaacaaattatgataggattgtgttgtttgtataataaactttagtcttatacttggcctgattatttgcataaggtgcagaaagaatgatttctacataggccttttgaattggctttgatggaactctgatccacaaggaattttagataaaacctcttagagctgaacccagccatgggtttatatcctcaaatacctgtgagttgggtgatcccctcctcttaaggtcccaagataaacttggagctcctggatctgttagaaagtggcattctttactgactacaggtcagaaaccctggacggggactgtgtaggtaagggtatgaggccagttcttctcatggggcttttattggctctgcaagtctagattgactccttaaatagtttccaaattctagaggaactaggcagagagaaacaaacatactccaaattttgttcacaagagtataacttactcaattattaaaggccataagtagttcaaaataagtttcattgactctgaaaaacaaaacaaggatcagcaatattccaagcaaaagtcagaaagtttgctttagctttgtgagtgcagcccatttagttaactcttattttgcttgatatacatgagcattttagttcttcatagtcctgtactttttttctttattccgtgttacaatctttaaagctattaaaaaaactcacatttgagaacacctgttaaagtcctgtagcttgattataaaccatcttttgagaaagaacaaagcaagacaacaattgtctgcgaatgacaaaatttccaaggtagttatagttaaaagcaagactgacaaataagtttagttatctctgtgatttacaataactttaaccttaattataattgatagcatatacttagacattagaattttagaagtcacatgcaattttggaacatatattagtattcaccaaaatataacttaaagaatatcggacatcattttggcaatcttatgtgacaaaacatgccaaataatcctgtgtacctcttctctggatttttcaggggcctctgaaccatccagaaagccaggcatcaggaaagacaattttgaaacttgaagtttgattttgggacacctgttaaatgtcagaggtttaaaatacttgatgttatgaaatagaatttcagatcgccataaattgcttattttgccaaaatgactcaaaaggcaaaaaccttctattaacctttactattacatgaaaatcctattcaaagtcaaaatttacccttgcattagtttattaatgttagccccagtttgttgaaatgaaaccttatagatgattccatctaattttaaccaatttgaccatgaggtgcaatctttacaaaccttttataaccctttttactaaagggcagattagcatctttagacaaccttgctatacttttatttcaatactcaatttatgagaagaccgtataatgcccttttggatttaatgtttacacattgtttgcaagattaatttttacaatctttctgtaacttgcttaaacctctagctttatcttatcaaatttaagataatccctcatacctgggcaaaatttacatttccatgcattcttataatcttttactaaaaaacgcattttactgtttttatacgccttgcatgtaaaactgtttagtgacctcaaatacatgtggcactgttaactcttagcaacttttacttttggtgaaaaacctgtttagtaagtgtttttaattatgtaccaggtgtggagcctaggacccagacagaagtgcagataaggtctgaccctcttcagcatctaactttcacgtgtcccaggccttacctatctgtaaagcaggcaatttggaacatttagcaaacctagtatctaagctgtatgatttagaccacctatttgcattttgacgacacttgcattttaccaattcttcagactatttttatttcttaaagattacagtcatgtgaactaaaaaatatttaagtgcttatttttctttaacccaattagagctctttttatagacattacacacaacacacatatagcaacacaaatagaagattcagcacttgtaacatttttcatttgccagtttctttttttctgttttttgagacagagtttcactcttgttgtccaggctggagtgcaaaggcgtgatcccggctcaccgcaacctccgcctcccaggttcaagcgattctcctgcctcagcctcctgagtagctgggattacaagcatgcaccaccacacccggataattttttatatttttagtagagatggggtttttccatgttggtcaggatggtcttgagctcccaacctcaggtgatccgcccacctcggcctcccaaagtgctgagattacagacgtgagccaccatgcccgacctgccagtttcttaattggattactcgtttcaggatggagcccttggaggaacagggccaggatagcatgccttttagggcctaagaagcaggcacagctgaaggcaaagaaagatccgcaaaattaacggcgccattttatactggatcttggatcccccaaaggtgggagatactgtggaagaagagagtgcagtgcttctactgtgcatttcatttcaaggcaacccaaagccaattggcttattttgtaatcggcccatccctcatgggagtcttatctctcaatagggggtggggatgtttccatatcttataggtggccaagagcatgcttctctgactcaaatgtgcagagttaagtatccctccataactactattagccattccttaaagtatatttcctacctagttattacacaccaaagctctctcataatgtgaagtaatttgatatccccaaaactcaaaactatcagataacacaatgcaaaacagaactgagcctttgattttgagagggaatgatctgcttttaattcctggggtttcatgaggaaaacagtttttttttcttccccccctcccccaaaacagggtctgtagtgcctcctctgtttttcccaaggagtccccggctaccggaagttatcttagggcctgtcatatgtgcattaagagtggcaagacaaaaaatggagaaaaataattcagtcgactaaaaagaaaaaagactttttccagaaaaacatgatccaagaagagaaaaacataatagccttttaagtatatctataactgggatatccacttttaattaagctgagcactctttcagaaaatccttttaaatcccttgttactaaactttagccacaccaagcagttaagattttcagcttttgaatgtcacaaaaagtaacctcacaggtgagaccaacaagccttaattagtttatgacttaacctccagtgtacaaggtattttcttttttctttttttttgagacagagtctcgctctgtcgcccaggctggagtgcagtggcgccatctcagctcaccgcaactcccatctcccgggttccaatgattctcctgcctcagcctcccaaatacctgggattacaggtgccagccaccacacccagctaatttttgtagttttagtacagatggggtttcaccatgttggtcaggctggtctcaaactcctgacctcaggtgatctctgcctcccaaagtgcagggattacaagcgtgagccaccgtgccctgccaggtatcaggtattttcaaaggggtgataagtaacttttgaaactctcattgcaaaattgtgactgagacagtgaaagagatcagacccaaccaactccattttgtttttagcccctaagctgtccttgctcatcactgggcataggctgaaccaactttgggaggtgtctggtttacagtgtatagtctaaaacaaaggtggtaacagccccttcctaagatatacttccctcttgcctggggaccagaccaagaaactagccacaaaatgagaaaccatggcttaggagtcacgcagctggaggctacaagattttatcctcccttaactgcccaagatcagtatttaagatattttgtaaactctgcccttgatggatcagctggctctgcctagattgataaactggcttatctgatttttggcccttccccgggaactaacttagcacaagacacccaccgttgtaaaatggcagagactaaaacaaagtattgccacgtggttacacgtcatgtttccaagtacatgaaacaagatggaggcctgtagccaagtttgttactgaccattttgttggactggcttgaacagcaggcttatagggtcctgggtctgcatcttaacctaaggtaccctttctttccacaggaccatacagaaagatacacgaagcacaccagattggctacagtttaagaccaacctcacaaatcccttttcattaattaaaacttaaccacaaatataaacaataatccttatcccttttgccagtttggatagggagagagaagccaaaagcctgactggtaagaaaattttacccttttgcccacatgtcaggcttctagttccttttccccagctcaactctaagccaagcatttttaaggtttggaaaattaacttttcccaggttgaaagaacattataaaagcatataggagccattttaagctgtaaaagaaggaaaaataccatagaaaagtctgggggttccagttagagttgttaagaggtattgcttcccttcctatcgacaatgatgtttcctctatttcttgatcttctctattttctcttttccctttttgcttattataggagacatattgtacatttccaaaattctctgccttctgcagaactgcctgtttttcagctgtagtttggggtttggcttagaagcagcataacatcccttcatgagaggttaaacacctgagttaaatttcagaaagcttctatatacctatcagggtcattggagaattggcctaagtctccctttatttgcctaaggtactgtaatgagaagggaacttgaggggcccctgaataagggggatccttagattgttcccctggaagttacttctctaactttggtgaatcatttgctattggcctgcctgatatgactactaaaagagctgggttgattttgtaacacctgcaaaggtctagtaaggccatgcccttgtgcaaaagaaaatgagttgatttttctttaaattattagagtcaaaggagtccttgtgcttcagaatgtactccagaggggtgcaagctgaagatgatctgttacccatctagagagagaagtgacaaaaaggcatctcttttttcaccttccttttggtgtgacccagggtggagaggaaaacagtggggacgtccctcctgctgttttccctctgcggtttctgggtcctggcaccttgtttaatgtgccacccatggttgcaggtgtgacccccagccatggaaccagaggaactaagtgattgggattagtcacactgattcatgcaactcaagtcctctgcctgtgatttcctttgacttcctagacttgtgtgacctgcctggctccctgaaaaatggatcttgggagagactatgcgacagttgcatttgggcaattgttgcacttccctccttaatggaggaagtgtgctggtttgagctctatatcctgctattacagtccatgctaaagtgtttacccttagagaatggttctggttaacttctgaacttaaaatccccttactaattaagtaccattctgattggaggcagaataggtgccttaaaagatcataggggctgagtgtggtggctcatgcctgtaatcccagcactttggtaggccgagacaggtggatcatgaggtcaggagttcgagaccagcctgaccaacatggtgaaaccccgtctctactaaaaatacaaaaattagctgggcatggtggcatgtaatccacctgtgcctgtaatcccagctactcaggaggctgaggcaggagaatctcttgaacccaggaggtggaggttgcattgagccgagactgcacaattgcactccagcctgggtgacagagcaagactccgtctcaaaaaaaaaaaaaaaaaaaaaagattgtagggactaaatggctgttttcctgttgatggagcagtatcaagaataaaatttggttttgaaggatgttttattcctagttgttgaagccagaattttcccatttacagaagcagcatgaagcctggtttgtagtagagaggctcaaaaagggaagagaattgggaagctaggctgtttttggtaaaggactgacaatgtgcctcatgaagaggatccctgtttcactagatggtgctgttgaccttgaaatgccatgtgctttccagaccaagggcagagtgaccttgacacgccatgtgctctccagtcctaggtcagagagagacctggaaatgccacgtgctctccagaccaagggcagagtgacctggaagttccgtttgctctccagaccaagggcagggagagacctgcaaatgctatatactcttcagaccaagggcagagagtgatgctcactgtcggggggagccttctgtttctagaaaatctcaaagacgccttcccttgagctatatcccctacaacgtttcctgatcttgccaaacaaaataactgaactgtaaaacttcgctcacatagcatacacagagagaataggagatatgacagtcgcagacaggaaaggaggaaattatgatagaaaagttggagatcctgttgccaacaccccatcaggtggtcagagactgggatcagtccagaagcctttggataacacctgaaggtagccccagccagaaatcctcagttgctctagaacctcttacagccccgcacaatggctaagtcctccatgaaaggaagctggttcaaacatggccaacatgcccagcaacccatgggtgctgggggattctccattttcttcccagtaaatctcacatctgagtctttaagaatggcagccacgctaaccgtgtttttaactggctgacagatgcccattattgatttgatttagttctaaagtggaggccaacagccccaaaatgaaaggacagagttggattccactcctctactcaccgttttgatgagcgttgtaccttggtatcctgagtgagcaccctgacatgattggctatgttgtctggggtaaatacccagcgtctgtcatctcgtgccagaaaaatttaggacacggacacatacgaggagtttaggaatggaggtttaataggcaagagaaagagaaacaaaaagaaaggaaaacagctctctctctagtgtgagaggggaattctgagagcaaaaggtggactggcggcggatgtgccggattttatagtcttaaggaggcagtgtctgatttacatagggctcacaaattggttcaatcaggtgtgagctttacatagtactcagggaaggctggccaccccaccctaatctttttatgcaaatggaactttccccttggctgatgccatcttgtctgctccttactatacacatggctgacagagaagggaagatggagccactattttgaacatgattggcacacctgccagcatgtatgtctgcagcttgattttacaggctgctctttgttagaaaatgatttggggctgcttcttattaaaaggaaaaccttaccaaggacttctgtacccttattatctgcctaagtgagttcttcttaactcctgtatcagtgtgccccctttccacgccaaaccaatgtatacttaacatgtatcaacttttgtctttgccttaaaatgtataaaaccagtctgtaacccaaaaaccttgggcacatgttctcaggacctcctgaggctgtgtcacaagccatgggtccttaaccttggcaaaagtaacctctaaattgattgagatctgtctcagatacttttttgtttacatcctcatagctgttttgttaaatcttgtccctgattttagccttttttaccttatttctgattttagccttttccttccaagaaaagggtgttcataaggtctcaaataccctttttcataattctcagagggccatactggccctgaaaaatactttttaaagttagtcctgaggattctgttttaaaaagctagatctgtctgcacagacagaatattcagctttgttagagttgttttttttcctccccctccttcacaaacatcttgctagccagtcagaacagctgagtcaactgtggtcagttggctgagagatgtcacggtccatctttatgtccaaatatttgacaaatgtaaaaatatagctgaatatgcaaattaattattgtaaccatgctaatacacatacacatatacatgcatacatatatatacagggcagtgggattatatactattcctatcttttgttttttcatttctatcttttaaaatgttaagttttaaataagaaatggtggttattgtatttttgtttttcatgtctatcttttaaaatgttaagttttaaataagaaatggtggttattgtatttttgtttttcatgtctatcttttaaaatgttaagttttaaataagaaatggtggttattgtatttgggaggtgatacacctttttacttctagattctgaaatagatgggttacaaacaagggaactagtgccacaatgtttggaaattgttccatgcatagaactggctagaacaaggcaagttagccattccctgtgcctgaggaaccaggtcactggctgcagagtcagtgtgaataggattatttcccataatcccttgtagctttggttctatatcaaggtcagagagactcaggagcggaagttacatgtttttttgagggttaggtacagttcttatatattctcctatttctgcctttacttgtaaagatcttggggaggatgctctgcccaggcattttctctttatcccggacttccagggttttcatattggctggagttttataagaacctcagtgttttgtaatgaatatttcttttccacacatcttttctgtttttacatattgtagtagtaatatggatgaggcaggaattgtgtgctgaagtacctcccagctttgactctgaaaatactactttttaaaaatctatttatttatttattttctttttttgaggcatggtcttgctctgttgctcaggctggagtgcagtagtacgatcatggctgactgcatccttgacctcctaggctcaagcaatcctcccacctcagcctccagagaagctgagactgcaggcatgtgccaccatgcccagctaatttttaatttttttgtagagacaggatctccctatgttgcccaggctggtcttgagctcctgtgctcaagcattcctcctgcttcaatctcccaaaacgttgggatgacaggcttgacctactgaacctggcctaaatatttattttaaattagcttcataattagatgaatatcaagtttattcaatctggtattttttaacagtcttgaggaagtagttgatattgattgagcaatatagtgctttcttatttaaatatttaatgttttccttttttcttttttttgagacagagtctcgctctctcaccgaggctggggggcagtggtgtgatcttggcttactacagcctccgccttccaggttcaagcaatcctcccacctcagtctcctgagtagctgggactacaggtgtgtgcccccacacccggctagtttttgtatttttaggagagatggggtttcaccatgttggccaggctggtcttgaactcctggcctcaagtgatctgcctgcctcagcctcccaaagtgttgggattacaggccagagccactacacccagccatttttcaaaacccctgtttgttttaatatgtgatatgttttcagaacacctgcttattttaatatgtgatacggtttggatttgtgtccccactcaaatctcatgtcgaattgtattgtaatccctaacgttggaggaggggcctggtgggaggtgatgggccatgggggcggacttcccccttgctgttcttgtgacagtgagttcgttctcatgagatcttgttgtttaaatttgtagtacctctcccaccttctctccctcctgctccaaccgggtaagatgtgcctgcttcccctttgccttccgccatgatcctaagtttcctgaggcatcccttgccatgcttcctgtacagcctgtggaactgtgaaccaatgaaacctcttttttaaataaattacccagtctcagatagttctttatagcaatgtgagaacagactaatacaatatgcgaaccattaggagatatataaggatttaaaaactttaaaaaacatatctacacatctgtttaaatcttatcagttaaggtaataatgttaacaccccacttggtgtatatctttccatacttatcttcctattcataacatgtgttcaagcatattgataggatttggatctatgtctctaccaaatctcacgtcgaattgtaatccccagttttggaggtggagcctggtggtaggtgatggatcatgggagcggagttctcatgaataggtcagcaccatctgcttggtgcttttctcctgtgagtgagtaagttctcttgagatgtgatttttttaaggtgtgtggtatcttctccctctctctgttccttttgctctggccatgtaatatgcgcctgcttctccttggccttctgccatgatcatacgtttcctgaagcagatgctgtgatgcttcctgtacagcctacagaactgtgggctaattaaatattaaatctcttttctttatacagtatgtagtctcaggtatttctttatagcagtacgagaacagactaatacagaaaattggtatcaaggagtgaagcattgctataaagatacctgaaaatgtgaaagtgacttgggaactgggtaatgggcagaggttggacgagtgtggagggctcagaagaagatagaaggatgagggaaaaattggactgtcttagagacttgttaaattgttgtgaccaaaatgttgatagtgatatggacagtgaaggccaggctgaggagttttcagatggagatgaggaacttactgggaactggagcaaagtcagttttgttatgtgttagcaaagaggttggaggcattatgtctctgccctggggacctagggactgtttttattattattattatactttaagttctagggtacatgtgcacaacgtgcaggtttgttacatatgtatacatgtgccatgttggtgtgctgcgcccgttaactcatcatttacattacgtataactcctaatgctatccctccccgctccccctactgcacgacaggccccagtgtgtgatgttccccaccctgtgtccattcccacctatgagtgagaacatgcggtgtttggttttctgtcctcgggatagtttgctcagaatggtggtttccagcttcattcatgtccctacaaaggacatgaactcatccttttttatggcttcatagtattccacggtgtatatgtgccacattttcttaatccgatctatcactgatggacatttaggttggttgcaagtctttgctattgtgaatagtgctgcaataaacatacgtgtgcctgtgtctttatagcagcatgatttataatcctttgggtatatgccgagtaatgggatgactgagtcaaatggtatttctagttctagatccttgaggaatcgccacactgtcttccacaatggttgaactagtttacagtcccaccaacagtgtaaaagcattcctatttctccatatcctctccagcacctgttgtttcctgactttttaatgattgccattctaactggtgtgagatggtatgtcattgtggttttgatttgcatttctctgatggccagtgatgatgagcattttttcatgtgtctgttggctgcataaatgtcttttgagaagtgtctgttcatatcctttgcccattttttgatggggttgtttgattttttcttgtaaatttgtttaggttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatgattttaggtctaacatgtaagtctttcatccatctcgaattaatttttgtataaggtgtaaggaagggatccagtttcagctttctacatatggctagccagttttcccagcaccatttattaaatagggaatccttttcccatttcttgtttttgtcaggtttgtcaaagatcagatggttgtagatgtgtggtattatttctgagggttctgttccattggtctatatctctgttttgataccagtaccatgctgttttggttattgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatattcattcttcctatccatgagcatggaatgttcttccattgtttgtgtcctcttttattttgttgagcagtggtttgtagttctccttgaagaggtccttcacatcccttgtaagttggattcctaggtattttattctctttgaagcaattgtgaatgggagttctctcatgatttggcttactgtttgtctgttattggtgtataggaatgcttgtgatttttgcacattgattttgtatcctgagactttcctgaagttgcttatcagcttaaggagattttgggctgagatgatggggttttctagatatacaatcatgtcatttgcaaacagggacaatttgacatcctcttttcctaattgaataccctttatttctttctcttgcctgattgccctggccagaacttccaacactatgttgaataggagtggtgagagagggcatccctgtcttgtgccagttttcaaagggaaggcttccagtttttgcccattcagtatgatattggctgtgggtttgtcatagatagctcttattattttgagatatgtcccatcagtacctaatttattgagagtttttagcatgacgggctgttgaattttgtcgaaggccttttctgcatctattgagataatcatgtggtttttgtctttggttctgtttgtatgatggattacgtttattgatttgtgtatgttgaaccagtcttgcatcccagggatgaagcccacttgatcatggtggataagcttttagatgtgctgctggattcggtttgccagtattttattgaggatttttgcattgatgttcatcaggatattggtctaaaattctctgtttttgttgtgtctctgccaggctttggtatcaggatgatgctggcctcataaaatgagttagggaggattccctctttttctattgattggaatagtttcagaaggaatggtaccagcttctctttgtacctctggtagaattcagctgtgaatccatctggtcctggactttttttggttggtaggctattaattagtgcctcaatttcagagcctgttattggtctattcagggattcaacttcttcctggtttagtcttgggagagtgtatgtgtcgaggaatttatccttttcctctagattttctagtttatttgcatagaggtgtttatattattctctgatggtagtttgtatttctgtgggatcggtggtgatatcccctttatcattttttactgcgtctatttgattcttctctcttttcttctttattagtcttgctagcggtctatcaattttgttgatcttttcaaaaaaccagctcctggattcattgatttttttttgaagggttttttgtgtctctatctccttcagttctgctctgatcttagttatttcttgccttctgctagcttttgaatgtgtttgctcttgcttctctagttcttttcattgtgacgttagggtgtgaattttagatctttcctgctttctcttgtgggcatttagtgctataaatttccgtctacacattgctttaaatgtgtaccagagattctggtatgttgtgtctttgttccattggtttcaaagaacatttttatttttgccttcattttgttatgcatccagtagtcattcaggagcaggttgttgagtttccatgtagttgagcggttttgagtgagtttcttaatcctgagttctagtttgattgcactgtagtctgagagacagtttgttataatttctgttcttttacatttgctgaggagtgctttacttccaaacatgtggtcacttttggaataagtatgatgtggtgctgaaaataatgtatgttctgttgatttgaggtggagaattctgtagacgtctattaggtccgcttggtgcagagttcaattcttggtgagttcaattcctggatatccttgttaactttctgtctcattgagctgtctaacgttgacagtggggtgttaaagtctccccttattattgtgtaggagtctaagtctctttgtaggtctctaaggacttgctttatgaatctgggtgctcctgtattggatgcatatatatttaggatagttagctcttcttgttgaattgatccctttaccattatgtaatggccttctttgtctcttttgatctttgttggttaaaagtctgttttgtcagagactaggattgcaacctttgcttttttttgttttccatttgcttggtagatcttcctccatccctttattttgagcctatatgtgtctctgcctgtcagatgggtctcctgaatacagcacactgatgggtcttgactttttttttttttttttgagacagagtctcgctctgtcacccagggtggagtgcagtggcgtgatctcagctcactgcaagctctgcctcccaggttcacgccattctcctgcctcagcctcctgagtagctgggacaacaggcgcctgccaacgtgcccggctaattttttgtatttttagtagagacgggttttcaccatgttagccaggatggtctcgatctcctgacctcgtgatccacccaccttggcctcccaaagtgctgggattacaggtgtgagccaccatgcccggccgggtcttgactcttatccaatttgccagtctgtgtcttttaattggaatatttagcccatttacatttaaggttaatattgttatgtgtgaatttggtcctgtcattatgatgttagctggttgttttgcttgttagttgatgcagtttcttcctagcatcgatggtctttacaatttggcatgtttttgcagtggctggtactggttgttcctttccatgtttagtgcttccttcaggagctcttataaggcaggcctggtggtgacaaaatctctcagcatttgtttgtctgtaaaggattttatttctccttcacttatgaagcttagtttggctggatatgaaattctgggttgaaaattcttttctttacgaatgttgaatattggccccccactctcttctggcttgtagagtttctgccaagagatctgctgttagtctgatgggcttccctttgagggtaacccgacctttctctctggctcccttaacattttttccttcatttcaacaggatctgtggaaatttgaacttgaaagtgatgatttagggtatgtggtggaagaaatttccaaccagcagagtattcaagatgtggcctggctgcttctaacagcctgcattcatatgcatgagcaaggaaatgacctgaaactggaacttatttaaaagggaagcagagcatgaaagtttgggaaatttgtagcctagccatgtggtagaaaagaaaaaccccattttcagtggaggaattcaatcaggctgcagaaatctgcctaagtaaagagcagccaagtgctaatttttcaagacaacgaggaaaagaccttgaaggcgtttcagagaactttgtggcagcctctcccatcacaggcccagaggcctaggaaggaagaatgattttcttggctaggcccagggccttgctgcactgcacagctccatgcatcctggagcactgctctgtgcatcctggcatctctagcaccagctgggctcagaagggcccaggtatagcttgggctgctgcttcagagagtgtaaactgtaagccttggtggtttacacttggtgttaagcctgtggatgcacagagtgcaggagttgaggcttgggagcctccatctagatttcagaggatgtatggaaaagcctggatgtccaggctgaagcctagtgcagggtttgagccctcatggagaacctctactagtgcagtgcagaggggaaatgtggggtgggagcccccccacagagtccacactggggcactgcctagtggagctgtgagaagagggccactgtctttgagaacctagaatggtagatccattggcaacttgcacactgtgcctggaaaagccacaggcactcaacgccagcctgtgagagcaactctgaaggctgaatcctggaaagatttggaactttccaaggccttgggagcccactccttgcatcagtgtgccctggatgtgagacatggagtcaaaggagattattttggagctttacgatttaatgactgcctactgggtttgggacttgcgtggggcctatgacccctttcttttgcccaatttctcctttcaaagtggagtatttacccaatgcctgtacccccattatatcttcaaagtagctaatgtgtttgattttacagtctcatagctggaaggggcttgccttgtctcagatgtcactttggattttggacctttgagttaatgctggaatgtgttaagactttggaggactgttgggaaggcatgattatattttgtagtgtgagaaggacatgagatttggagaggccaggggcagaatgatatggtttgcctctgtgcctcccacaaatctcatgttgaattgtaatccccagtgttggaggtggggcttaatgggaggtgatggataatggggtggagttctcatgaatgggttaacaccatcccttggtgctattcttgttatagttctcatgagatctggttatttaaaagtgtatagcacctcacccctcactcttttcctcctgctctggccatgtgaagtgctatatctcccttcaccttataccttgattgtaagcttcctgaggcttccccagccgtgcttcctgtatagcctgtggaactgtgagccaattaaacctcttttttaaataaatcaccacgtttcaggtatttatggcaatacaagaacagactaatacacacacacaaacacacacacatatatacatgcccttttggtttactttaaaaaaaatagctttattgaggtgtagtttgcataccatgcaattcatccctttaaagtataaatccagtggtttttaatgtattcacagagttgtgtaactgtcaccacaataaattttagaatattattatcactgtaagaaagaaacctcttagccattagcaatcatttccattttctccaacctcccactagggaggttcctccaactgggaaaccacgaatctactttctgtctttgtagaattactcattctggacattttatgtgaatggaataatataatatgtagtcttttgtagctgctttctttcacttaacatcatttttttaggttcatccaagttgtagtgtgtatcagtacattgttcctttttatgcctgaataatattccattatatgggtatactataatttgtttattcattcatcagttgatggacattgcattgtttccacttttggactgtaatgagtaatgctggtatgaacatttgtgtataaaattttgtgtggattttttaaaacttgaggtgaggctgggcacagtggctcatgcttgtaatctcagtactttgggaggctgaggtggatggattgcttgagcccaggagtttgagaccaggttgggcaacatgatgtaaccccatctctaaaaaaaatgcaaaaattagctgggcatagtggcacatgcctctagtcccagctacttggaggctgggaggtaggaggatcactaagcctgggaggcagaggttgtagtgagctgagattgtgccactccctctgttgtccaggctggagtgagcagcagagggagaccctgtctcaaaaataaaaattaaaaaaaattaaaaattgaggtgatagtcacataacatacaattaactatttgaaagtgtgcaattcagtggcttttagtatgttcacagtgtcatgcaattattgtgtctctctacttccaaaattttttcatcatcccaagaaaaatacccatacacattaaataatcactccctttccctctatcccctggtaaccactaatctgtcttctgtctctatggattttgcagttctggttatgtcatctaaaaggtatcatataatttatggtccttgtgactggcttttttaacttagcataattttttagggttcatccatatggtggtttgtatcagcatgtcattctttttaatgattgaataataccatagtgtaggccgggtgtggcacagtggctcacacctgtaatcccagcactttgggagaccaaggcaggtggatcacgaggtcaagagatcgagaccatcctggccaacatggtgaaatcccatctctactaaaagtgcaataattagctgggtgtggtgtcgcacacctgtagtcccagctactcgggaggctgaagcaggggaatcacttgaactgaggaggcggagtttgcagtgagctgagatcgcgccactgcactccagcctggtgacagagtgagactccatctcaaaaaaaaaaaaaaaaacacacacacaaaaactctagtgtatggatattaccacagtttgtttacccattcattagttcatggacatttgggttgtttctgctgtttggatgttatgtataatgctgctagatacacttgtgtacatgttcctgtgtggcatatttctgtgtgcactatttttcaaagtggctgtatcattgtggattcccaccagcagtatatgatggttccaccttttccacattcaagctcaaagttactattatctgtcttttaagtcatcctaatgggtgtgaaatgatatcttactgtggttttgatttacatttccctaatgactagtggttgttatgcatattttcatgtatttattgaccatttatttatttttatttattttttgacatggagtcttattctgtaactcaggctggaatgcagtggttggatcatagctcactgcaaccttgaacttctgggctcaagcagtactcccactccagtctcctgagtagctgggactacaggtgtgcaccaccaccacgcttggctaattaaaaaaaaatatttttttctatgaactctgcagagaagaaattaatttttatttatttatttatttatttatttatttatttatttagtagagatggggatctccctgtgttacccaggctagtcacgaactcctgggcccaagtgatcctcccacctaggccacccaaagtgctgggcttacaggtgtaagccactatgcctggcctcattggccatttgtatatcttctttggggaaatatttattcagatcctttgcccatttaaaaattggattatttgtctttttattgaattgtatgtgttctttatgtatatgctagatacaaaactcttattagatatattacttgcaaacattgtctcccattctgtgcttttcgctttcttaatagtatcctttaaagtgcaaaagttttaattttgatgaagactaatttatctacatattttttctttggttgcttgtgctttgggcattatagctaagaaaccattgcaagagtttgtatactttcagctattatagtcagatctttgatacatttttaagttaatttttgtatgtcatgtgaggtttttggtttgcttttacaaaatgtattatgtatttttacttaaaatacatcttggatatctctatcagccagtagataactgtcatttttaagtctgtggataaaagagcgtgttactttgccaacttgtaaactccccttcctggaacgatacctctgcaagtctacctgccatccctgctgtttgttccttattctgtagaccctgttcaaagcagaactctagaccaattgctttcagatttgctttcccttttaataaggcacccatctaattttgagatgaaataatacccttcttggaacattcagtgactccttggaattcatataataaaatgcaattagggagggggcacaatctgaaatagatctgccctttcatactctttagactattactctgtattagtctgttctcgtactgctataaagaaatacctgagactgggtaatttataaagaagaggtttaattggctcacagttctgcaggctgtacaggaagcatggtggcacttctgcttctggggaagccccaggaaacctacaatcatggtggaaggcgaaagggaggcagagacatcttacatggcagaagcaagagcaagagtggggaggtgctacacacttttaaaacaaccagatttcataactcctcattcacttgccatcaccagaacagcacaaagaggatggtgctaaaggctaaagctttcatgagaactccacccccatgatccagtcacctcccaccaggccccacctccaacactggggattgcaattcaacatgagatttgggtggggacacaaatcgaaaccatatcactctgatagtttcaaggaatatttttgttgcttttcattgactttccaatttatgatccttactgactttactacttggaattctcttacaaaatctgtttttcactgtttatccaccttgcaattaataaaagtgtcctgtttcacaaaatgattaaaattatctataattttctcacttaacaatatgtctccctcacattatgctttcctttccactttgtttgtttgtttgtttgcttatttgagacagggtcttgctgtgtcacccagggtggagtacagtggcacaatcacggctcactgcagtctccgcctcacgggttcaagcgattctcctgcttcagcctcctgagtagctgggattacaggcatataccaccgcaccggctaatttttgtatttttagtagagatggggttttaccatgttggccaggctagtcttgatctcctgacctcaagtgatctgcctgcctcagtctcccaaagtgctgggattagaggcatgagctaccacgcccagcctcccttccactttagttattattattatttttaaaatagagtcttgctctgtcacccaggctgaagtgcagtggcatgactttggctcactgcaacctccacctcccagattcaagcaattctcctgcctcagcctcctaagcagctggagttacaagtgcgcaccaccacacccagctaatttttgcatttttagtagagatggggtttcaacatgttggcccggctggtctcaaactcctgacctcaagtgatccgcccacctcggcctcccaaagtgctgggattttaggcatgggccacacgcccagccaaatgaggaatcttgagaaaacttggcaatgatatagttctatacattgctgctgtttttcattcccttttctacccccttcttttcccgacatcattcttcattctatttccattttacatgacaaattttgttacttatttaattattcccagactgacatttgagataacagtaagaaaaccttatttttagtgttatgtttcccttctagtggactaatactttccttaggtgccttacccttcttttaagcacacggcaataagaacagttttctcagccagtcatgttggctcatgcttgtaatctcaccactttgggaggccaaggtgggtggatcgcttgagcccaggagttcaagaccagcctggacaacaaaataatacccagttactaaaaaaaaaatttttttttccttctagaaagcatttaagttaccttatgcatttcaagaacaaataattcctaataaatgttttaaattgaccttattccatattttgagcgattgatttctatccatgcacacctgcttaccatttcctccactcaatttgtatatagcttcctgtccagtatagttttcactagctacatgtgggtatttaaatgtaaatttgttaaaattaaatgaatttaaaaattcattttctcagttacactaaccacatttcacatactcattagccacataaagctgatgggtactacagttgacagtgcagacacagaattccttcatcatcacagaaagttttatttactggcactgctacactgtttgacttattcctacttgcggggctgacatttgaaattattgtaaaccattccctgtttaataaacttatttttttttttttgagacagagtctcacttagtcacccaggctggagtgcagtggcacgatcttagctcactgcagcctccgcctcctgggttcaagcgagtctcattcctcagcctcccgagtagctgggactacaggcatgtgccaccatgcccggctaatttttgtatttttagtagagatggggtttcaccatgttggccaggctggtcttgaactcctgacctcaagtgatctgcccacaccgtcctcccaaagtgctgggattacaggtgtgagccactgcatctggcctataaacttatctttgatggactcttgttagtggtcattgttgcagaaatcttgcaatgccccatagaagtgttttgtatttttgtttgttttaaagagatgggggtctctctatgttgcttaggctgtactaactcctgggctcaatgaatcctcctgcctcagccttccaagtagctgggactacaggagtgcaatactgtgcttgggagaagttttaaaattgtttttggcagttttgtgtggcaaatataaaagtcattttaagctgaaatattttaagtcagcatcctatttatgttttaaacacataatatattcacatgataattttaagtaagaataaagaatatacggtgaaaagtaaatcttctcatgtcttcctctcagttgtccttggagagaggcatgtactaaaacaaggttctttgtgtgttcttctagattttttatcttataagcatatgtgtgcctgtcttcacttttgaaaatgtaagtggtagcatcctatgcatactttttatcgtgtgtgtgtgtgtcaggtcttaagtctagatgatttgtgtttttacattcatgtattttggaaattattccatgtgggtacccgtaaatctgccttatttttattgcatagtatttcattatataggtgtattttaacttatctactcatcttctattgaacatttaggctgattctaacattttactattgccaaatagattacaatgagtatctttatttttgcaaatgtgcaagtatagcaatatgagtagtagtactgggagagcacaggtctgtgctttttaagactttgatagattctgccaaattgccctccctaaagactgttccaaattacacatttacctacagtgtatgagaatgtctgtttctctgtccctcatcattacggcttatcataaaactcattgtagagcagtattattaaagattgtaataaaaagtttattttattaaattttggctgggtgtggtagtgcatgtctgtagtcctagctaccccggaggctgaggcgggaggatggcttgagcctgggaggttgaggctgcactatgttgcccaggctggccttgaactcctgggctcaagtgatccttctgcctcggcctctgaaagtgtggggattacaggcatcagccactgcacccacccggtaatgtactttctataatggaaataaattaagagctttgagtgtagctattctgagttgcaaacttatctgtatactttggataaaaatatctgagctaacatgtactaagaaacctgagcttacttggaagactgcttcacttttgcatgaagttagaccctaaggtaatcagagcaatctataagaataacttttctatgcattagtaataagttgtcacaaaaagtaagagaaaaaatatcccatccacagtagcacagaggtataaaatatctaagaataggccaggcgcactggctcatgcctgtaatcccaggactttgggaggccgagattagtggatcgcttgaggctaggagttggagaccagcctggccaacatggcgaaaacctgtctccactaaaaatacaaaaattagccaagcacagtggcgtgtgcctgtagtcccagccactcaggaggctaaggcacaagaatcgcttcaacccaggaggtggagattgcagtgagctgagattgtgccactgcactccatcctgggtgacagagtgagactctgtctcaaaaaaataaaatatttaagaataaagccacatgagatatgaaagcatgaaaggcagaatattataaactacatgacctcaaacccttgtactgcaaaagcttagaaatactgaccaaatataacaaatatcccattaaggatataatttagctcccaagaaagtaaggcggctctcccttgggctaaaatggaaaacaatttaaaaaccagagtagaaagtagaactaatgctttaagaacatgagagttggtggaggagcagttgttaatgacgtgttactcctagtggaatagcctcccaccccctaataaatagcccagctaatttatgccattacacacacctagattttagttccagaccttgagctgtgggaccttgggcaaggcctctttgaattccaggtttctcacctgcaaaatggggaaacaatagtacccaccttttctggtggctgtataggttaagttaaatggaaataacacacaatatattgagtgctaactgtgttccagggcagtgccctaagtggtatgtataaattcacttctcttcataaggtggactgaattgtgatgccctccaccaaatccctatgttgaaaccccagctcccaatgtgatggtatttgtagatgaggccttttggaggtcatttggtttagataaggtcatgagggtagggccttcatgatggggttagtacccttataagaacagcaccaggcagtttgtactcctttcccggtctcccctgcatctggtatcaggacacagtgagagcgcagccatctgcaagccaggaagtatgagcccttactgaggaacaaaatcggctggcatcttgatcttggactttacagcctccagaactgtgagaaataaattattgttgtttaagccattcaatctatggtgtcttattaaggcagcctgacctaatacataaggcagcaaaggcattctcaccataaaggcataggttataatggcttcctggtgacaagagacaaggtgatgagtcaggtagctggaaataagatccttgcttccataaagctaggattctcaaagggtcatatgctcagttaaagcctggcctagaaaatattcacaggaagatgaaaagcaagtttattcatcttagtctgagttctgggtggatgggggaaaaagtgtctgacttgagtattcataaccagaggcttgtgctcatgaaagtctgagattcaaatttgtttaatttacatggttcagcaatccctaagccagtaagctaccccaaaaagacagtccaaagctagaaaacaactttgggccacactctcacatcaggttacacaaatttctgtggatacagctacactttacatgagttcataatgcaaaattataaaacctacaaaaaaaatagccaaccagagtgtcatgatacatgacgtagaacataatcagaccttcattaactggtgatagcagactgagtataaatcaaaatgagtatgaaatgattatagacatttaaaaaggaatcgaaaaagaaagggatactatatttagaaaaaagaccaggctgggcatggtggctcacgcatataatcccagcactttgggaggtggagatgagtggatcacctgaggtcaggagttggtgaccatcctgactaacacaataaaaccccttttctactaaaaatacaaaaatagctgggtgtagtggtgcatgcctgtaatcccagctactgagtaggctgaggcaggagaatcacttgaaccctggaggcagaggttgcagtgagtggagatcgcaccactgtattccagcctaggcaacagaacaagactctgtctcaaaaacaaacaaacaatcaacaacaacaacaagaacaaaacaaaagaaactaggtatatttgaaaaagaaccaaaaagaaaaactcaagggaaaagttaaacaagtgaagagtattattgaatttttgaatgtatactagaaagaaattacccattatgtaacagagggagaaagagagaggctgagtgacattgcagataaaatgagaaagtccaacatagttaatagaagttctctaggggggaaaaaggagaggagaggagaggcaatatttaatgagaaatggctggacttcatgaagttaattggaagaaaagacagattatctacaaaggaatgacagattaagaccgtaatagtaacaatagagatcctgagagaaattactatctagaatttttttactagctaaattattcaaaattgaaagtaaaatagacatttcagacaaaaatgtgagaatgtaagctcagtgatgaaagggatttttctttctccactgctgtatctctactaacttgaacaatccttggcacatagtaggcatttagtaagtatttgttgaataagtgaaaaattgaacagtctctcacagttgcttctggaagagggaaattgaaatgagaaggaaggattgagatacaagaaagactattgagtagaacagttgttaaacatgagtaaatgtaaataaatatactttagtggtggctcatgcctatcatcccaacactttggaaggctggggtgggaggatcacttgaggtcaagagtttgagaccagcctgggcaacatagaccctgtttctacaaaaaatttaaaaaattagctaggtgtggtggcacacgcctgtaatcccagctactggggagtctgaggtgggaggattatttgagcccaggaggtcaaggcggcagtcagccatgatctcaccactgtactccagcctgggtgacagagtgagactgtctcaaaaacaaaccaaaaataaataaatatactttataaaactactataattttaattatgtctaatatgttacagttttacaaacaagatggaaataaagttcctgacaacaataggatgtaaagcagaaagtagagattgtagttaaagtagtctaaggttgtgttttttttctgggaagaatttagagatgtggtttagttaaaattcagatgtaataaatttcaaggatagggtttttattttctggaatgtgataaactagttttctgaggaaactattctcattctagtacacctgaatatgctattgacagggacaaaatgagcaatttttttcctacatagttgaattattggaaggccagaaacaataagaaaacatgagcaggtgctaaagccagcatttgcctgttagtatcttctgattcctggtgtctctgagccggagttttaatcgtaatagagggaactttccctaacttactttatgatgatagtaatttaatattactatcaccagacaataacatttttgtaaataaatactaaggccattttcaagcctaaataaaggaccaaaagtcctaaagacattgttaaaatgtatttagcttcatataaaccaataatacagcattatcaagttaagttgattttaggaataaaagagtggtttatcatctgaaaatatgttaatgtattgtatctgttaatcatctaaaatctgtagcattaacagactaaagaggaaacatccttggatcatctcaacagatgcagaaaaagcatttgataaaattcagtaagcattcatgataaaaattcatggtaaattcaaaagggacctttcttttctggaccaggatggattgttctgtattgctcctgctaagtatagctcaaaaccctggacactgtatgtaaaacaaacataggaagaatttgaaaggtaaagagaagacgacagaccagctaggggtttcacgacccatggaatgacatagcagtgagttccctggacttgcttgattgtttatttgcctcatataacgtaagtgttggatcaactggcaacttagtcagaaatggcaatgggaacatacaccccaagaaagccaaaaacagccttttctctttaaaagatggtgaaagaggaaacatagcaagacagaaacttttggacaataaccacgctactctagccacatgccatggaaagaccatggctcctccccttcgctaactcctgttaacccctgttaatgatagataaaaggggtagaaatttgaaaaatatttaatccacaggaaggcaggaaaaagaaaacggaaaatagaaaataaaatgtcagacttaagccctaacattttaataattacgttaaatgtaaatagtctaaacacacaaatttaaagacagttggcatattggatataaaaacataatccaactatgtgagtgatacattcaacaacttggcgttatgctgagtggaaaaaaaacaatctcataaggtcatattctgtgtgattctctgggtataacattctgcaaatgacaaaatgatggagatggagagcagattaatggttccaatggtttgggatgatgagggagggtgtagatatgactataaagtggtagcaagagggagatcttcgtgttgatggaatagttttatatcttgattgtggcaatagtaacatgggtctacatatgtgataaatagcacagaactacgcacacacatcaggttttttctttttgatattgtactatagttatgtaagatttaactattgttgggaactaggtgaagggtacataggacctctctactatttttgcaactccctctgattatttcaaaataagctttaaagaaacctatagcaaacatcatactcaaaattgatttattaaaagtattttctttaaagtcaggaacaatacaaggatgcctactatcatttcttgtttgtttgttttttttgttttttttttttttgagacagagtctctgtcacccaggctggagtgcagtggcgtgatctcagctcactgcaagctccgcctcctgggttcacgccattctcctgcctcagcctcccgagtagctgggactacaggggcgtgccaccacgtccggctaatttttttgtatttttagtagagacggggtttcactgtgttagccaggatggtctcgatctcctgacctcgtgatccgcccgcctcggcctcccaaagtgctgggattacaggcgtgagccactgtgcccggcgcctactatcatttcttacattcaatagtttacaggcagtcctattctatgcaataagatcagaaaataattaaggctgggtgcggtggcttacacctataatcccagcactttcagaggctgaggagggaggaccacttgagcttgaaagtttgagaccagcctgagcaatataatgagaccttgtctctataaaaaataaaaaaattagccaggcgtggtggcaggtacctagtcttagctactcaggagcctgagccctggaggtggaggctgcagtgagctgtgtttgcaccactgcacttcagcctggatgacacagcaaaaccctcaaaaaaaaaagattttaggcgtggaaagagaaaaaattataacctgtaagggagtctaggcaatgagtacctggcatttttactttctattatatattgtgagataggctctttctctcaccaggttttctctgaaactgatgatttctaatcctaagagccaagggaaaagagtaacaaaaacaataacatgtccacacactggaaaacttatcagtgaaaaatatacttcatgggatggcaagaagcaacataggattgtagttgacatgcagctactattattatattattatgattattaattttactcttcaagactcttatttggtgtgagtctagatctgttagaaggtcactgatgaaaaaggatgtgtgggtgtccaagctgatctgattcatacagctcaatatatttatttattaattttgagacagggtctggctctgtcacccagactagagtgcagtggcatgatcaaggctcacggcaacctctgcctcccaggctccatttttatttattattattatttttaattaattaattaattttttgtagagacagagcctcaccgtgtttcccaggctcatctcaggctcctggcctgaaggagttctcccaccttgaccttgaaaagtattgggattatagccgtgagccaccgcgtctggttaagtggttaatttagaaatgtgcagagttaatgttcgtgtttttctttttcttttctcttttttttttttgagatggagtttcgctcttgttgcccaggctggagtgcaatggtgcaatcttggctcactgcagcctctgcttcccgggttcaagtgattctcctgcctcagcctcctgagtagctgggattacaggcatgcaccaccacgcctggctaattttgtatttttagtagagatggggtttctccatgttggtcaggctggccttgaactcccaacctcgggtgatctgcctgcctcggcctcccaaagtgctgggattacaggcgtgagccactgtgcccggccagtgttcatgtttatttttcatagcgttaaggaactgggtgagaatcaaaatctggaggagagtttagagttttcttcatggttaaatttaaaaaattctatagaacaaatatatttagtgtgtgtaggccgatggcgttagatttccatacactcaacattggggagaaacctcattggcagtggagtggctggtggtaccagctgggggtcccttctttggtcctttgagtgcagagtctttgccctggttgttccctgctttcactattaggagaagccacttgactcatggctggcagatagcacaccagtttcagtaccttgctaaatttatagaaaaccagtgtattaaacagcgaggtatagatagaaactgttttccaacagtgggtatttgaatattaagtagtagtaaattagccaggtgtggtggcacacacctgtggtcctagctacttgggaggctaaggcaggaggattgcttgaaccctggaggtcaaggctgcagtgagccatgattataccactgcactccagcctgggtgacagagcaagaccctgtgtccaaaaaaaaaaaaaaaaaagtaaagacattgttttctttaaattttcaaacttctaaaaaagaacagagaataatatattgcatacccatgtagttgccaacttaatttaacaaatgttaatgatttgttacattagtcaagattaaaaaaatggtgtacagtggataaagttgaaattttctttactgtctcaatctctctttcccaagctgtagtcactctcaaagttggtgtgcattccttccttttagggttattattattctaaaatgtgtgcatatgtctatttgtctatcatgcagatattcattctcttatttttttctgaacgttttaaagctttagtgtcacatttagatgtttaatccatttataattcataattgtgttagcatgaggtaagggcttaattttgtctttttgtatgaataactcatcattactagttttgtctttagcagagtttgtttatgcaggtataagcaaatatgaatatatatttttatttgttccccttattttgtattctttaatttttaattttggggtatataatacatgtatatacttatagggtacatgagatattttgttaaaggcatacagtgcttaatcacattagggtaaatggggtatctatcacctcaaccatttatcctttatttgtttaacaatctaattatatacttttagttattttaaaatgtacaataaattattattgactgtagtccccctgttgtgctatcacatactagatcttatttattctaactatatttttatacccattaatcatccccacttcccccccaactactctttctagtagcttctgttattggtagttctactgtttccatgagttcaattgttttaatttttagctcccacaaataagcgagagcatgtgaagtttgtctttctgtgcctggtatagttcacataacacaatgacctccagttccatccatgttgttgcaagtgacaggatgtcattcttttttgtggctgaatagtactccattgtgtatatgtagcacatttttgttatgatgaacacttaagttgcttccaaatcttggctattgtgaaatggtgcttcaataaatgtgggagtgcagatttactgatttccttttttggggtatatacctagcattgggattgcaggatcatatcgtagctctatttttagtcttttgagaaacctccaaactgttctctatagtgactctaataattatattcctgccaacagtgtacaagggttccctttctccacatctttgccagcatttcttattgcttgtcttttggataaaagccattttaactggggtgagatgatacctcatagtagttttgatttgcattttgctgatgatcattgatgtttaacaccttttcatgtacttgtttgccatttgtgtgtctgtcttttaaatttttatttatttatttattttgagacgttatctcactctgtcacccaggctggagtgcggtggagcaaattcagctcactgcgaactctgcctcccgatctcaagtgatcctcccacctcagcttcctgagtagctgggaccacaggtgcatgccactatacccagctgattttgtgtatttttggtaaagacgagttttcaccatgttgcccaggctggtctggaattcctgagctcaagcaatccaccttccttggcctctcatagtgctgggattacatgcgtgagccaccatgcccggcctgtccgtcttgttttgacaaatatctattcaggtcttttgcctgtttttaaattggattattagactttttcctattgacttgtttgagctccttatatattctggttattaatcacttgtcagaagaatagtttgcaaattactttttctcattctgtcggttgtctcttcactttgttgattgttttctttgctgtgctgaagatatttaacttgatgtgatcctatttgtccatttttggtttgattgtcatggggtattcagatcatagcacattcaaatcatagcacttgtttgtacattttttttcttttaaacttcatgcattttgcatacaatttaagaaatctaacccagggtcactaagattttctcctatgttttcttccagatatttcatagttttatctctcacatttagttctattcctgactcatttcaagttttgcatattgtgtacagtaaggataaaataagcaaatatgtatatgcacttgcatatgaatatcgaatttttcagtaccattgttaaaaagattatcttttccctcaattgaattgccttggcaattttgttgaaaatcagttgacccatatgtgtgtgggtctgtttctgaactttctaattttttccattgatcattatgtctttttatgccaataccacactgtcttgattcctgtatctttataatataacttgagatcaggtagtataattactccaacaccctttttcccccaaaatgttttttggctcttctgatcctttgcgttttcatataaattttaaaaccagcttgtcagtatctaaaaaaaaatgcctgctagaattttgattgggtttgtcttgaatatgtagattaatatggggaaaattgtcattttaacaatagtgagtcttccaaacattgaccatggtatatctcttcatttagttacttctttgatttctctcctcagtgtttatagtttttaacttacaggccttacatttcttttgttaaatctattctaagaatttaatattttggggggatgctgttgtacatagcattttttaaacaggaagaaatacatatacattttattattacatgcacatgtgcgcatgggagtcaagcaagatataaatattcagagaaagataagatggttcatgcttgtataccatcttttgggggccagatgggaaggccattttttggatacataataactgtacgtatttatgaggtacatgtgatatttctgtacatgcatacaatgtgtaatgatcaacccagggtatttaggatatccatcacctaaaatatttatcacttctttgtgttgggaacatttcaaatcttttcttctagctattttgaaatatgcaaattattgataactataatcaccccagtctgtgatcacacactacaacgtattccttcaatataactgtatgtatgcattaaccagcctctcttcaccacccttctcccccttcccagcatctggtagccatcattctactctctgcctccaggagatctcctttattttagctctcacatgagtgagaacatgcaaaatttatctttctgtgcctagcttatttcacttaacatgatgctatccagttccatccatgttgctgcaaatgacagggtttcattctttttatggctgaatagtattccattgtatatatataccacattttcttcatttatttgttgattgacacttaggttgattctataccttggctatcatgaatagtgctgcagtaaacatggggatgctaatatccctttgacatactgacatcctttcctttggataaatacccagtaatgggattgctggatcatgtggtagttctgtttttggttttttgggaaacccccatactgttttccataagggctgtactaattcacgttcctgtccacagtgtatatgagttctcttttctctccatccaggccagcatctgttatattttgtggttttggtgatagccattctaactggggtgagatgatagctcactgtggttttgattttaattttcctgatgattagtactcttgagcatttttttcatatacatgttggccattcttttgagaaatgtctattcagatcctttgtccactttttaatgggatttttttttttgctcttgatttgagttccttatatattctggatattagtcccttgttggatgaatagtttgcaaatattgtctcccattctgtagtttgtctctttattgattgttacttttgcggtgcaaaggctttttagttttatagggtcccatttgtctatttttatttatttctatgcatttgaagtcttagccataaaatctttgactagactaatgtcctgaagtgttttcttctagtagttttaaagttttgggtcttatatttaactcttgaattcattttgagttgatttttgtgataggtgcccagtttcattcttctgtaatatggatattcagttttcccaacaccatttattgaagatattatactttcctctgtgtttttctggtacgtttgttgaaaaatcaattggctgtaaatacatggatttatttctgggttctctattctattccattggcttgtgtctcagtttttataccagtagtaacctgctttggttactatagctttatggtgtattttgaagtcagatagcatgataccttcagctttgtccattttgctcagcattgctttgactatccagggtcttttgtggtttatatgaattttaggattgttgtttctatttctctgatgaatagcattggtattttgatagggattgcatttaatctctagattgctttggataatacagtcattttaacaatattcttagagcctatttgcatagtacgtttttccatttgtttgtgttctcttcaatttctctcatcagtgttttgtcatttttgttgtagaggtctttcacccttggttaaatttattcccaggtattgaatattttttgtagtaattgtaaatgtgattactttttaaatttctttttcagctagtttattattactgatttttgtagttgattttgtattatgcaactttactgaatatattgatcagatctagagttaaaaacaaacagtggagtctttaggtttttctatatataagatcatgtcatgtgcaaagagggacaatttggcttcctcttttccagtgtggttgccttggatttctttctcttgcctgattgctctggctaggactcccagtactaagttgaatgagagttgtgaaagtggggcattgtctactaagccagacaatggcagaacaaaaaaataaaactacaggcaaatactcctgataaacacagatgcaaaaatcgtcaacaaaatactagcaaaccaaatcaagtaatatatcaaaaagataatataccatgatcaagggggatttatcccagggatgcaatgatggttccacatatgcaaatcaataaatgcgatacatcacatcaacagaatgaagaacaaaaactgttaagatcatctcaatagacatagaaaaggcgtttgataaaattcaacatcccttcatcataaaaaaaaaaactctcaaaaaattacacattaaaggaacatacctcaacacagtagaggtcgtatgtgacaaacccatagcttacatcctactgaatggggaaaagttgaaagcctttcctctaagaactggaaaaacacaagaacccatatttattgtgttcttgtttgttgttgttgttattttgagacagggtctcactctgtcacccccgctggagtgtggtggtgctatctcagctcacttcaacctctgcctcccaggctcaagcgagtctcccaccccagccccccgagtagctaggatgacaggcatgtgccactacacccagctaatttttgtatttttagtagagatggggtttcccatgttggccaagctggtctcgaattccttaagtgatccacccactttggcctcccaaagtgctgggattacaggtgtgagccaccatgcccggctgaatgtttcttttcttcttatattgatatttgtgtatgtgttataacaattccttcttttaatgttatggagtggcttttttagggaaagactttttttctgtagatgtatctatattgttgctggggaaaggtgttttggctttgattctgggtgggtgcagtagtgtagtctccgtatgatttcttcacctttactcggactagtttcttggcttctcagtggtgtaggctataattgttggcggaggctgtgacaagactttgctggggactgatatgccagatgggctggtcctctggaatcagtagtagcagtggcattctaggaatgccagtctttgggctcccttgggcctccaggtggtatgcttgggtgctggcagtgccagtggctgaccaagtgggtgggtccttggatccccgcggtgacgtgtgaggagttgacagtggtggcagcagtggtgcgccagtccttgcaccactcagcagcatgtgtggcttttagtggtgggagcaggcttgataagctagtccctagacctccaggaggcatgcagtgatgggtggcactggtggtaggataggctaggttttgctctggagaactgtcctgcatactgtagaatgtttaccagcatccctgttctttagccagtaaatgccagtaacatcacatgggaacttgttagaaatacagtttcacaggccctgctgcactgcactgagtctagaaactaaggtgatgtggcccagcattctgtgctttaacagccctcaggtgattctaatgtatgctcaagcttgaaattccactgccttggtagattgcaaggttccccctgcccccagaaagaacctgtattagtcaaggttctctaaagggacagaactgatagggtgtgtgtgtgtgtgtgtatgtgtgtgtgtgagtgcacatatacatatatgcacacacacacatatctatatatgagagtttattaggagaattgactcatatcatcacaaggtgaagtcccacactaggccatctgcaaactgcggagctgggaagccagtccgagtcccaaaacctcagaagtagggaagccgacagtgcagccttcagtctgtggtcaaaggcccgagagcccctggcaaagcacaggtgtaagaccaagagtccaaaagctgaagaacttggatgttcaagggcaggaatcatccagcatgggagaaagatggaggccagaggactcaggtctgtcttctccttccgcgttcctctgcctgcttttatcctagttgtgctgtcagctgattaaatggtacccacccaggttgagggtgggtctgtctctcccagtccactgactgaaacattaatctcctttggcaacacccttacagacacagccaggaacaatactttgcatccttcacatgcaatcaagtggcactcaatagagtgtcacattacagaaccattattatcactatatcgttgactagcataatggcaaatttatgcttattgaccaattagtaattgcagagcttaatctttttaaggtagctttagccaggctattcagagagatgtgtatgtactttctacacatttgtgaaaaagaacaccagttgggaagaggatttgaactgaaatgggactacaaaaggtagtctccagtgagagacagactttgtttcaataaaaagaatagattttagtaaaatcctgtctgaaaatggagaggacgtgtgaaaggtacagaatgacccatctcttagaagtattaagcaggacttggatgttagttaaggtgaagctttcagtagtaatgcaggataaggagaatggcagacgtatactcttaagcatcctttccaggttttgtgttttagggttttcttcacctttttttttctcctgtggcacgtagctctaatcttctttgatagctacttggtgctttctgagatttagcagttttcctgcatgtatggtctttgacctttcccaggagttggcatgtgcactccagtgtgggattctttcctgtgtagttctctactgcctttggaaacagcgctttgtgattacattgacaggagctcctcttactatctgcttattttcagaaagaagttatttctcattcttgttttaaaggttattatctagatctggcctgttatgctcttcttttggtgtgaacagaatagaggggatttctatgctaggttttaaataaggaacatttgtaacttaaactttcagaagatatctcacatgaaactggctgcctgccacaggagtaacttagatctctccaccttgttgtcaggagcctggaacagagatttttgcattggatatgagatcagattgacttttaaggtctcgtctgactctttgcctttcaagttttgatcagaagtctcagctttttttctccaggtttagatttaacaatctaaacctagttctaacattggtatgtagtgcctaataaatgttgcttaagtaaaatgaacttggaaacattcttcatggtatcctcttttttctcttgcagttaaaagggccaaattccagggttcaccaggtaaggccagctttctattatgtcttttcctcttgtatttgctgttatttcaaagcaatttaaaaaaattattaattcattgatcaaattcagtaatttgattcattacttcactaaattaattcatgaaatcattaatctagtgaaaaattagttttcttacctcttggctaacccaattctacttctcaataataactatatatttagaggttttgatataccttttccgactttttctcagaaaaaagtctgaaatagtgtaaaaggataaatattgacaattagtggaaacaatttttttttttttactttaagttctagggtacatgtgcacaacgtgcaggtttgttacataggtatacatgtgccatgttggtttgctgcacccattaactcgtcatttacattaggtatttctcctaatgctatccctccccccgtcccccaccccacgacaggccccagtgtgtagtggataaatattgaaatatcagtgtatcatgtcttgcagttcatgaacctgtttcagcttgagagtgtgtgtatatgtatctattgggtcatatataaaatttcttaaaatttaaaatattcaaatagaccatgtgaaacatatcttatgcaacctgcttttcccccagcaacacatcatgaaagtgtgtgtgtgtgtgtgtgtgtgtgtgtgtgtgtgtatgtgtgtgtctggttcgttcttttaaggtgctgtacagaattttgttgtagatttgtaccctgattaataggtccctgattgattaatacttgattaatatttaggttcccaagtttttgctattacaaataataaatgttcttgtgcacttctcattgcttgcttttgcaaatgtgtctatgtactagattcagaagtagaattgctgggtcaaaagtgtatatatatttttaaaaatttggtaactcctgccaaattgttctcttgcaagtttttactatatataccgagaccaaaagtttatgaacatttattttcccaaatccttatcaacatttgatatgaaactttaaaatctctgtccatctgaagattaaaaatggtatttccttattttaatgtgcatttcctcaattttgattgtcacattaggaagacttcctctggttactgctggggaaggagggaggggagctggagggttactggaaatatatgaatacgcttgagaacccaggaaaacctgaaaaactggaccttgggtgcaacagtaatgaaagcagtttctgagcagtttcttgttttaaaggttattatctttttgtctctgctggctctttttttctgagaatctgctctgttgtttctctcccagctggttttctatgcttacccatcttgtacccataatagctgcctcagtggaatttataccccttccttttagcttcagcaccaaccaccaattgtcaatatttatctttttaccctatttaaaatcttttgagagggaatcaggtttgtttcagcttttggccagctcatggattggctgctcttgggttatttactcttggtctggtcagctatgtgtgattggatgttggggtggagtacaaaataatgtaatataaaacatagctcagtggcctactgcactactactactggatatggatggagattccccttgtatgggcttttatcctcatatatctttaatataattataaattttccatgttgataagtataaaaccacaccattttaaatgatatttaaaagaaagacttaccttcagctgaaagtgtatgacgggttccattttctcatatcttctgtaacattaggtaatcatgttaagcaatgtttgccaatttgatgagtcaaagtgatagtttgctattttttcattgtataacattaggattaatttcttacatagaaaagcaaaccctcaattcagtgcccctaatcatggctgatgtggatgtagtgaggtgagtgccaaatgtgctgtaataagaattaggtgagacacctgagtttgaagtttcaggccaccacctttgtttagtaatcaacttgtttagtactcaactctcaggttagagaatttccttttctcaactctgtgataatatttctttttttggctgggcctggtggctcatgcttgtaatcccagcacttttggaggccaagatgggtagatcacttgaggtcaggcatttgagaccgcctggccaacgtggtgaaaccccatctctactaaaaatacaaaagttagctgggcatggtggcgcacacctataatcccagctacttgggtagctgaggcatgagaattgcttgaacctggtaggtagaggttgcagtgagccaagatcatgccactgcaccctggtctgggtgacacagcaagactctgtctcaaaaaaaaaaaaaaaaaaaaaagatttctttttatgtaacttgtgctttaggccaaactgagtagatcgagcttgaaatctattttctttgtgaagatttttccttaatttttgtccctgttaacagctcagctctgcagttctttatcactttttcttttttccttctggtatgtatctctttctacattttattaaatttacgtaccttatctttcctagtaggtcaattagatttggatttttccccccagatggcaagtgggctatataattaacatagtaggttaggattaacattgtaatagattaaataaattagaacaggaaatatcaatgtatcatatcttggcattcatgaatctgtttcagtttgagtgtgtgtgtatgcatatctgttgggtcatatataaaatttcttaaaattaaaaaaatagtattttagattatgctcttgaagatagcacgtagttttataatttcggcaactctgctatgtcttgaatgaggctatgttgtacaatatagcttaattttttcctgcacatgtaatactttaatttctatattgcttaattccaagggctttgtgagatgggtaacaatctgagcactaagtattatgtctccattttgtattttttcaaagataaatttaacacatatgtgaccctgaaagtacagaatgtgaagagcacaactgtagcagttcgtggtgatcagccttcctgggaacaggatttcatgttgtaagtattttgcagcagcagtgtgcctacatattttataatctttttaagggaattgcattggatgaaacaattagaagattttgtgtatttttgagatttataaaatgtactggcactgttaaatactgttttgaaaactgtggagttatagaaataagtgaggttcatggtacatgaagcacaactgcagttttgttttctcatggattcgtaatttgttcttagagatgaatgataatgcaggtaaactcccaattgatttgtgttggtgaaaaactacataggcagattttctcagtggtcagaattagaatacagtacaacagacttagcatgacattaaacataacttcatctttctttgattctgagaaggctctttgaaggaatgtggccatgcatgtgagagactgtatcttcatgtgtacctcagtcatctgttttagaggctgaagatttctgtgcttataatccttttgctttatggagtaaaatgtcctatattcaattaattaaaatgaataaatattagtagaatttctcgtgtatgacaaagtttagtatattatgattttaattaaactttggctttaaaaacttgttatttctttcttttgtccctttagtttcaggatttttttgttcctgttctacaaaaggggagaaaagtatagaatatattgaaggactgggcaaatcatttagcttcatagggcactagtttccttatctgtaaaggtcttcctttctcagaagattatgcttgttttttctgggagttggaggtgggcatgaaggggctgaatgagaaaacgtactgaaatttgctgtgaaatttgaaactgaactgaaatcgatttgcatgttttatagtgcagctcagagggacatagggatggttattatttttaaggggagacatttccaatcctctgggctcttggtatattgctgcttttttttttttttttttttttgaggcaggatctcactctctcacccatcctagagtgtggtggtatgatcatagtttactgcagcctctaactcctgggcttgagcgatcttcttgccttagcctcctgagtaatggaaactacaagcatgtaccatcacaccttggctaatgtttttattttttgtaaagatggggtttcactatgttgcccaggctgatctcaaactcctgggctcaagcaatcttcccgccttggcctcccaaagctgtgggattacaggtgttagccactgcacccagcttatattgcttcctataggaccattattgtgatagttaaaggcaaagattataaggttttgggctaggacaatagcagaagacatagaaaaggatgaatagaaggtattcaggaagtagaaccaaaacattttcttggaagatgggttgggtggtatgccattcagtaggatagggattaatatcagttatggacaatcttatatttgagattcttataggacagataggaaggatgagaggtacagaagatagttagaaacctaaagctggcactcagggaagaagtctgctttggagaaatattttggtcagttgaagccataggtgaagatgagaaagcttagggagagaatgtgtatggtgagaaaagggactggagtagaagctggagagtggcagcatttaatgaggggacagagggaactaaaaaggattgaacagagaggtaggagagccaggagataatggtgtcttggaagctgagggagaactgggcttcaaagagaaggaggccaatggtgtcatgtttctttctcactggttgcttctctctcaagattatataagcctcatttattccctctctcagtgacagtgatatgagaccgagagcacctgtttccttctttacacatgcagtgtacagagtcagctacaaatggtttatgcaagtctctttccataccagtatgttagccatagtcctggctatggtttataaacctagcacttccagttggctataaccataatttccagttataactcttcccatcatatgaggcacagtgatcttctgcagcctctcatcagcatagccagcattattcttatgtgtttattttccaatttcccatagcacttccccttttgaccctgctgtgatatgtgtgaattttcttcctgtctctcccacgttgagatgctgtgtgaattttgccctcttcttttacacgtgggttttattagctactttctctacttttctgctcttcctactccttattcctcctatcctgtcctattttagttatttacttattttttttggttcactccttgcagaacttagtctactaccctgtccttttgtcaccggaatctccagtgctggtttcctatctcccgttctcctttttccttctccatgatgtattatgtggcagtatctaatattcgttttggtatttcttatattatttgtttttaatattttcatatcttgtttttaggattagattgttcatttcttaagggtaaggtgggcatcttcactatttgtgtgcatttgtgtagcccagagtctgctatacacgtgtttatgtatattgttgattgaattaacagaaaagaaacttccctagggtcctgggtatgaagcataaacagagctctcagacctctcttagctggacctgctgagcaaatgtaggtgagatgagaagcttcttatagaatatatactcattgtttgggccttctccctagagagttctctgaagagcagattttcttctttatctgttcaagtcaagctgttgaagacctctggctatttcttctgtctgttggcttgagatgctatttgggagttgatttgggaatattatatatgtatccccaagcaaatttctttttttctttattttgtgggacagggtctcactctgttgcccaggctggagtgcagtggcagcatcttggctcactgcagccttgatctcctgggctcaaatgattttcctgcctcagcctcctgagtaactgggactacagatgcatgccaccatgtctagctaattaaaaaaaatttttctgggagacactaggttttgccatgttgtccaggctggtctcaaactcctgggctccagtgatcttcccacctcagcctcccaacatactgagattacaggcatgagccattgcacctggcccaagcaatttttcgattccatattcaaatgatggataagtccaatggatttgaggatgtcacatatcttttccaagactaattggttaattaggctgaattaaattatgtgacaaaaagcttagtttctccactgtgaacactgtaacttagtggctaggcttattcatctactttgtggctctgaacagctctccagatagcttagaagtttttggacacaaaaactgagtcctatattatgtttctactccaaagcactaagtcatatgtcttgtaagtgctcaggaaatgctaattaaatgaataaattaactcagtacattctatgctgtattatatttatataaaagggacaaattttctttgctttattcattttcaacacctgacatgaattctgtggctgtcattctatatctcaaacttgtgaatctgagaacatttattttatagcacaacagggaacccaagctttctctaaagtacagacttgaagcttctacttgtgataaatagctgttgttttcctgagaatgcctttctgctttctctgctggaattggtcttttctcatctttcttggattacccctcaagtaaccttgtgtttcaataagagctttctggagaacgtttttagcattaacacaggtactatttgcgtattctagtttaatactgggattatgtttgagttagtccttccaagcagatattcaaccatgtatgatactgcttttaaatagtgcttatctggctctttatggaatgatttcttttcgaattttttcccctggttattattataggaaaatcattgtatttatcattatcccatggtaataattttgcttataagtgacagtgcctagcttaataatgattaatgagtctccagggactgagtggtgtgaactagcacactctagagcccctcacttgcctgtgaccacatgttcctatcaaacttatatgttctcagggaccctacttctacctggactccctttcataaatcccccccgccccgccccggcttttttggtggggatggagtctggctctgtcactcaggctggagtgcagtggcgtgatcttggctctgcctcctgggttcaagtgattcttgtgcctcagcctcccaagtagctgggattacaggtgtgcaccaccatgcccagctaatttttgtatttttagtagagacagggttttgcaacgttggccaagctggtctcaaactcctgacctcaggtgatctgtgcacctcccaaagtgctgggattacaggcttgagccaccatgcccagcctgataaatcttgtaaagtagacttacctttcctaaaagtttcctgtatacgatgtgtagtttaagttgaagcagtgttagttaacaataacacatataaaactgttgcctatgggtggaaattggcaggcaggcctggcaataatgtccttattacttggcctcatattgtgtgaaactgcattagtctaattatgattgtatctccaaagcggaaagaatggatagacaaaggcatttttctttcttttcccgccccccctccccactgaggtttaattgggatataagaaactgtacataattaatgtatacaatttagacatttatatacttgtgttaccatcaccataatcaaggtagtaaatatatttatcacctctaaaagtttacttgtgtctccttttttttgttgtatgtgtgtgttaagagcatttaatatgaaatctaccctcttaaattttgaggtgcacaataccttattgctaactggaggcactatgtggtatagcagcaggtctctggaacttatttaactgtaacaaaggcagttttctatggatacctattataggtttcttggagcctaaaaatggtcgtggcattctgggaaattttgatttttcctgaagacaggatcctggtgagaaagcattcaaagtttagcaaaacaggagatgtagttgtttctttcatattgtctagctttcctcaaagggctttcctctttcccttagtgagattagtcgcctggacctgggtctaagtgtggaggtatggaacaaaggactgatctgggacaccatggtggggactgtgtggattgcgctgaagactattcgtcagtcggatgaggtcagtcattgcattttctgtttggaagtatggttcccagcccatgcttctccccatgctagctccactttagctaatattcatccatgcatcttggattattcttccccctttctaattagagggcatgcaacctgcctgttcctaacttcacctgaaggttcagatgattttatttatgtctggcctaccctgtgtcctgtgacaactcacaggctccagagcacctcttcagccttatcaggtagatagccccttctgaggtatgtgtgtgtcggtgtgtgtgtttacttagggtacttgtggtttctgtgttctcttctaagtcactgccctgggaggagtcccattaaacttccttagccagctggctggctattctctgctttgtttctttgagttaccaatctccaaggaactagttttcagtgcccttcttctgcatgtaagcctgacagagtttaaggaactaccaggcttggcaatttgtattcacactgtctctatacgttatttctaggattgaactcttgcctcactttcctagactagaccataactcagcatcatttccccactttggacctggacaaaatctgttatattcctgtttggtgttaacatggaccatgagttttctctgggagtggggaagttgaaattgcctgtattttctgtatttcttttagttctagctaagtctctactccccaggcagatgggcagttcattttcattgctgccccagttcaatcctatttagccagcaatgttagtagctttttactgactagaaacagtgacacagtcattaagaactgtgcaggttaaatattgatccacagaggtacttagttttagagtatggtactccagacattctgtcctcgttagacctgcagagctgagcacagtgaaagctgctctccccaccaaagagggaaaacagaagccacatgcagtggaggcaggtggtgatagtggtgtgtttgccttatcaggatgtgaatggccctcagaagctcaaacaaggaacttcagagaaaaaaacctgactcttgaactaagagggagccaagaaagattaaactttaatcttagatctttgtttcctaggaagggcctggggaatggtccacattagaggcagagacgttaatgaaagacgatgagatctgtggaactagaaacccaactcctcataaaattttgcttgatacaagatttgagttgccttttggtgagtaaaattttaaaactatttaataatttttaccatattgtttggaattgtttgctagttgtttcattaatgtatattttgtcacctcagccatctcctttgaggatattttgtcttcattcactctctttctcataacacttcacccagggaatggtgcaaagtagaatatagaatagtgctcattaaagaatctacactaaaaagcattctcttcaactcatttaattttctgtgactatttattataatgacttatgaaatatttgcttgttagatttattattttgaaaataaacatttattgtcttgaagtgactatatataccttctgatttgttaatttaagtattaaatagcactgataaatagaataataatttaaaatgtaaattaaatcacaatacatgctcatgataaaaattcaaatagtaaggaaatgtacatggataaagttaaaagtttattttcccagttcctttaatcttctctgcattctccagtgtgaaaccactgttaacattcttgtattttggtttagacacatgatatttattttccaaaaacttattttggcaaaatttggatcataccctatgtaatatttatttgctgatatatagtgttttacaaactgcttagacatttatcctgaacatcgctccatgttatactttaagatctgtcttattcatctgaacagatgcctctaccataatttatcttttttttttttttcctttttttgagatggagtcttgctctgcccaggctttagggcagtggcatgatcttggctcactgcaacctctgcctcctgggttcaagtaattctcatgtctcagcctcctgagtcactgagattacaggcttgtgctaccacacctggctaattttttgtaatttttagtagagacagggtttcaccatgttggtcaggctggtcttgaactcctgacctcaaacgatccgcccacctctgcttcctaaagtgctggaattacaagcgtgagccaccatgcctggcctaccataatttatttaagtaatcctttattgattgacaggtgggttttttcatttttttttttttttgatgttatataccgcaaactaataactctgtatatctttgcccattttgagtctagaataaatttcttaaagtagaattgctggatcaaagtataagtacatcattactttttatggaatctactaagttccttgtccaaaaggttataccaatttatactcttataaattatatctggggagtgcctgtttctgcacatccttggcagtcttttgtgtttcccaatggttaatctttatttgattattttgtatgatatcttatcaggggaaattcagcccccgatatttcacgtgggtccttttccatttttcctaagtgttggccggtctaagaaataaagggaaagagtacaaaagagggaaattttaaagctgggtgtccaggggagacgtcacatgtcggcaggttctgtgatgccccccaagccacaaaaccagcaagtttttattggtgattctcaaaagaggagggagtgtacgaatagggtgtgggtcacagagatcacatgcttcacaaggtaataaaatatcacaaggtaaatggaggcagagcgagatcacaggactggggcgaaattaaaattgctaatgaagtttcgggcatgcattgtcattgataacattttatcaggagacaggctttgagagcagacaactggtctgaccaaaatttattaggcaggaatttccttgtcctaataagcctgggagcactacaggagaccagggcttatttcatcccttatctacaaccgtaaaagacagacgtccccaaagcagccatttcagaggcctccccttagggacacattctctttctcagggatgttccttgctgagaaaaagaattcagcaatatttctcctgtttgcttttgaaagaagagaaatatggctctgttccgcccggcccacaggcagccagacttcaaggttatctctctttttccctgaacatcgctgttatcctgttcttttttcaaggtgcccagatttcatattatttaaacaatttgtgcagttaacacaatcctcacagggtcctgaggccacattcaacctcagcttacaaagatgacgggattaagagattaaagtaaagacaggcataggaaatctcgagtattgattggggaagtgataagtgtccatgaaatcttcacaatttatgttcagagattgcagtaaagacaggcttaagaaattataaaagtattaatttggggaactaataaatgtccatgaaatcttcacaatttatgttcttctgccatggcttcagcctgtccctctgttcagggtccctgacttcccgcaacagtatcttgttttagtttagttgatttctattagttttattttaattttttactgttcatattattgatatttgcatattctattgttattgctgtcattttatgatctcagtgtatttgtatcttgtatcctatggtgatttaagcaaaaatgacatgattttccagctagctcagaaagaactaaactcagaacaactattatttcagaaaaatagaaaggaagtctttcttgtgggactgtagaccaagctgcaagtgaagggaaaatcaattggagggagtgggtcttggttcaaataccacagatattgaccattttcaccaaattttagtagatattcttgaataaatgttttttcttttgctgtatgcacttagaaccatttccagagactttaaatcgttgtttttttaatgttgtattactttttgactgatttcactcactaattacatagttacaaatgttatataaaatagacattattcttctacttttagtagttgattttatttaaaaatcagggcctggcatggtggctcacacctgtaatcccagcattttgggaggctgaggtgggtggatcatgaggtcaggagttcaagaccagcctgaccaacatggtgaaaccccatttctactaaaaatacaaaaaattagctgggcaaggtgtcgtgcgcctgtaatctcagctacttaggaggctgaggcaggagaatcacttgaacccaggaggcatggaggttgcagtgagctgagattccaccactgctctccagcctaggtgatagagcaagactctgtctcaaaaaaaaaaaaaaaaaatcagtaataacaaagtaacatttatggtgaattattgtgtgttggtgggcatgtcactaagtatttacatatgttagctcagtaatcctcatttcagtcctttgaggcaggcccaactattattccccactttagagataagcaaactatggcagagagtatttaagtattttggccatggtctgactctagagcctgggcttttaattttaactatttgtataatacatttaaccacttcctgttgggtattttgattgtttgaagtttgtactgttataaatagcactgcaataaacatgcttgtatctctctgtatttttttcttcttaaaactatttttgtggaatgaggcaggaataaattaataatggtttaaaaagttatccagtgaaaagtcccttcagaaatccattttcttcctataggctaccactattaatactttcttgtgtatctttccagagtcagtttctgaatataagcacacacacacacacacacacacacacacacacacaccaccatcttctttttaaaacgcaaatagtagcatattctaacacattccctgtgccttgctgttttgcacttagtatatcttggtgaatcatcccacatcagagcatatagacctgcagcagcagcagctcctctgccaccttgcacttcccactctccttctttgtaacaggtgcatagtataccattttatgggtgtaccatatggatgagaaagcactatacaaattacgttgtagactatttgaaggtgtgtgtaagtgtttttaaataagactttgaaatattgctaccagttgttaaagagctagttgaagggaaggagctgaagttttggacaggtggaacaaaggagaaaggaaagggctatatttgctttattcatgtggctactagaaagtgtatctgttgaaatgtctctgaagttgatatgatccatatattgcctgagtgtttctcttcagtgctggttagatggtcatacttgatgtttttaaaaggtgagttttggggagaagttgttatagtcaatgtaaaatgtttaggaatgaggatataccattataccattattttttaagaattcaaatattttcacttagagactcacttaacaaatatttgagcatctaatattttccaggcataaaacctgtgagtattttttaatagcttcttttaaaaaatttttaattgtggtaagagacataactgaaaatttagcatcttaaccatttttaagtgtacagttcactagtgttaagtacattcacattgttgtgcaacagatatccagaactttttcaccttgcaaaactaaaactctgtctccatcaaacaacttctcatttccccctccccacagccactggcaacgaccattctttcttttctgtgaatttgactactttagttaccttagagaagtgaaatcatacagtatttgtcttttttgtgatggactcatttcatttagtgtaatgtcctcaaagtttatccatgttatggcatgtggcaggattttcttccttttaaggctgaataatgctccgttgtatgtaaatctctcattttgttaatcctttcatccattagtggacacttgggttgcttcaactcttggctattgtgaataatgctactaggaacttgggtgtgcacatatctctttgagatcctgctttcacctctttcgtatatataatccaaagtgggagaactatgtcacatggtaattctacttttaatttttttgggagaaaacctttgaattttgagcatctcaatatctcagcatataacttttcttttaagctaatcctttggatggttttggtcttgctgaggggaaggtagtatggttacatagaaagaatgtagtttttggaatcatacaaaccatggtttgaatcatggctcatctctttataaactgtgaccctgaccagattattttagctctctgagcttcagcttcttcatctacaaaataacaatgggaataacagtacattgtattggtttttgtgaagagtaaagataatgttcatgacaagaaccaaaccatcagttaaaacttgtgcatcactaccaccttctgacttcagtcattagacagagtaaagtgttatctgctgatgatttattacctgctgatgtgatttcttttctttttcttcttttttttatggtagatatcccagaggaggaagccagatattggacctacaaatgggagcaaatcaatgccttgggagctgacaatgaggtaggagcagccttatttgcagtatagagagatgggggaaaatctccaatgctctttataggttgcccagggaggggcccaagagcatgttgtcctgagaatgaaatcacttaaattgcattgaagaaaaaaggcagctagaagattgcctgaaatgtcactagaaggttccatctccaatttattctgttcttcccactctcccatactgtggtactagtctggctgtagactcttagagagggagcttgtaccagggaatctgtcctcttttgttacacctgtgagttggaggcatttcttttgcttctactgtctctcagttttttggatattattcttatttgtgtcctgtttttgaggatgtttagactattgcattgtttgttcttgctggtcctaacttacctccagagatgaggctggtgtgtataagagaatgcattcagctcaacctggggcatcaggattggagaatgtttttgttattgctgatggagggaaaagatgataaatttgtttattttggacatgtgggctactaaaaaatgggtctgattataagatatactttgagtgccagaggatatttcagcagaaattgttgataaacaatttcatgagataatttgaagttgaggtttgaatgggtagggagctgtaggcatagagcttcattaatatattagtaacaattgatgtcataggaatggaaaaacttgctcaggtagagcgtatggagacagtattaaagaacaggaacaaaatcttgggaaaccttagacatagaattctgagaaacaaaggagactgagaaagggcaaccttaaagagagagaataagataaccaggaaagattaatggaacaaagaaaaaaagagattcaaggcagaaattcttgacagtatcacatgttaaatcaagtgaattatgaaatagagctattggatttggtgattgatgacgagtatacatccatagactagtacagaaagccaaaatgcagtggtttgatgactgtatttgtttcctacagctgccatcacaaagtaccacaaactaggtggcttacagcaaccaaaatttgttttcacacagttctgtagactggaagtctgaaattaggctgtcagcaggatcagttcagctccgtctagaggctctgaaggaggaagcatcctgtactcttctgcctctgatggttgctggcagtccttgctgttccttagcttgtagatgtatcattctaatctctgcctctgttgtaatgtgcctccctgtgtgtctgtctgtgtcttcacaatgcattctcctgtctctgtgtgtctgtgtctaaatttccatttttcttgtaagaacaacagtcattgaattaatttgattatatctgcagagaccttgtttccaaataaggtcatattcacagatacttagggttagaagtctaacatatcttttaggacatagttcaacccacagtgagttaaatgaaagatgaagaaatggcatttgggacaagcaacatctactcttttcagggttttccgttacctcctttattcttggtaggctttctgttattaagctgtataactcttctcatgtccacaccaacatcctaacttttcttcattgttgaaagctccagtcctctttctccacttagtaactctgagcatttgtgctatctttgcatgtactttactttgtgttttcgttcttcccaagcctggctgtggagtggtattcagcctttcagactgccatcatctttgttttcctagtaaagaagcatgttgtacttttcgttttataggctttgctctgtgtcattatacagaatcagaagaagggattaaaacaatttaaaaaccaaatataacttatacaaaaattgtggaattttataagttctaataataatggttcttggtctgtggttcccaactgcatatcagatttttgctttctgttttttttttttaattttattatttttatactttaagttttagggtacatgtgcacaatgtgcaggtttgttacatatgtatacatgtgccatgttggtgtgctgcacccattaactcgtcatttacattaggtatatctcctaatgctatccctcccccccctccccccaccccacaacaggccccagtgtgtgatgttccccttcctgtgtccaagtgttctcattgttcaattcccacctgtgagtgagaacatgcgatgtttggttttttgtaccttggtgatagtttgctgagaatgatggtttaccagcttcataccatgtccctacaaaggacatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttagtgctataaatttccctctacacattgctttgaatgtgtcccagagattctggttcgttgtgtctttgttctcgttggtttcaaagaacatctttatttctgccttcatttcattatgtgcccagtagtcattcaggagcaggttgttgagtttccatgtagttgagcggttttgaatgagtttattactcctgagttctagtttgattgcactgtggtctgagagacagtttgttataatttctgttcttttacatttgctgaggaatgctttacttccaactatgtggtcaattttagagtaagtgcggtgtggtgctgaggagaatgtatattctgttgatttggggtggagagttctgtagatgtctattagatctgcttggtgcagagctgagttcaattcctggatatccttgttaactttctgtctcgttgagctgtctattgttgacagtgggtgttaaagtctcccattattattgtgtaggagtctaagtctctttgtaggtctctaaggacttgctttatgaatctgggtgctcctgtattgggtgcatgtatatttaagatagttagctcttcttgttgaattgatccctttcccattatgtaatggccttctttgtctcttttgatctttgttggtttaaagtctgttttatcagagactaggattgcaacccctgcctttttttgttttccttttgcttggtagatcttcctccatccctttattttgagtctatgtgtgtctctgcacatgcgacgggcttcctgagtacagcacattgatgagtcttgactctttatccaatttgccagtctgtgtcttttaattggagcatttagcccatttacatttaaggttaatattgttacttgtgaatttgatcctgtcattatgatgttagctggttagtttgctcgttagttgatgcagtttcttcctagcatcgatggtccttacaatttagcatgtttttgcagtggctggtaccggttgttcctttccatgtttagtgcttccttcaggagctcttgtagggcatgcctggtggtgacaaaatctctcagcatttgcttgtctgtaaagtattttatttctccttcacttatgaagcttagtttggctggatatgaaattctggttgaaaattcttttctttaagaatgttgaatattggcccccactctcttctggcttgcagagtttctgccgagagatccactgttagtctgatgggcttccctttgtgggtaacccgacctttctctctggctgcccttaacattatttccttcatttcaactttggtgaatctgacaattatgtgtcttggagttgctcttctcgaggagtatctttgttgctttctgtttttattctagggtatggcactcactacattttcatctttcatcctctcttccactgtgctgtttatctttttagcagttttattgaaatataatttttatatactgtacagttcactcatctaaagcttacaattcggtggctttcagtatcttcatagttgtgccctatggatatcaccacaactccaaatcagatttttgccttctgtttttattctagggtatggcattcactaagtttttatctttcgtctttcttccactgtgctgtttatctttttagcagctttgttgaaatataatttatatataccatacagttcactcatttaaagcttacaattcagtggcttttactagcttcatagttgtgcccatggatatcaccacaattttgaatattttcattgccccgtaaagaaaccctgtgcccttagtcatcagtctccattcttccctatcctcctcagccctatacaaccactaatcaaccttctgtctctatggacctattctgtgcatttcatataaatgaaattatataacatgtggtcctttgttttctttcacttagcataatgttttcaaggtttcattcttgttttaccatgtaaataaattcctttttattgccaaataacattccattgtatggatgtagtacattttaaattcattcattagttgatggacagttgggttgtttctctgcttgttagctgttatggataatgctgcttcgaatgtttatatacaaaatgttgtgtggacatatgttttcacttctcttgcatatgacttgggagtggaattgctagatcacatggtaactctgcatttaactgatagactgccagcctattttccaaagtggctatgacattttatactcctaccagcagtgtataagggtttcaatttcttcatattcttgtcaacacttgttattatcttttttattatatccattcttcgattcttagcatgtatgaagtggtctctcattttggttgctattccatttaaaaacttttttattatggaaattttgaagcatgaaaaaatgtagagttactcttccttttttttttttttttttttttttgagaaggaatctcactctgttgcccaggctggagtgcagtggcgcgatctctgctcactgcaagctccacctcccgggttcatgccattctcctgcctcagcctccggagtagctgggactactggcacccgccaccgcacccggctaatttttttgtatcttttagtagagacagggtttcaccgtgttagccaggacggtctcgatcctctgacctcgtgatccgcccgcctcggcctcccaaagtgctgggattacaggcgtgagtcaccgcgcccggcctactcttccattttttgctggagtattttaaaaccaatccagccgggtgtgttggctcatgccagtaatcccagcactctgggggggccgaggtggtcagaccacttgaggtcaggatttcaagaccagcctgaccaacatggtgaaaacccgtctctactaaaaatacaaaaattagcttggcgtggtggtgggaacctgtattcccacctacttgggaggctgaggcaggagaatcacttgaacctaggaggcagaggctacagtgagccgagatcacatcactgcactccaggctgagtgacagagcgagattccctatcaaaaacaaaaaacaatcctaggtattatcttgtctcacccataaatatatcaatatagatctctaacagataatacttttttttaaaaaaaaaccacaatgccattatcacactgaacttaataatttcttagtgtcatccaatacctagtcttttcaattttctttattatctagaagatgtgttttcatagttgattttttcatttcaagagccagataagatgtgcccatttggctgtcatgtctcttaaatcattttactttattttatttttgtattttttgtagagatggtgtttcaccatttgcccaggctggtcgcaaacttctgggctcaagcgatctgcccgccttggcctcccaaagtgctgagtttacaagcatgggacaccaagctcagctccttgaatcatcttagctgtaaaatcattcactttccctcatctgttttgtagacttctgcacattctggattttgctgattgtgtccccaggttttatttaccatgttcctttatctctcttatttcctttaaactgaaaagtgcatctattagtttgaagattaggttatagttcatttttgtgatagaggtgatgttaaaattcaacagtggattcaagtattgtcagcccatttcattcattatgatgttttcccatcagcctttcatctaatggttttagctgcaaataataatgactattttattagagtctgaaaaatgatgattttctttctttcttttatttatttatttttatttgagacagtcttactttgtcacccaggctggcgtgcagtggtgctgcagtctccgcctcctgagttcctcagcctcctgagtagctgagattacaggcgtgcactaccatgcctggctaatttttgtattttttttatagtgacagggtttcaccttgttgcccaggctggtctcaaactcctggcctcaagtgatctgcccacctcggcctcccaaagtgctgggatttcaggcggaagccactgtggctggtctgatagtctaattatattatcccttcagcatttattagctatgatttgtctataaaaaaaattttctcaatcccagcactttgggaggccgagacgggcggatcacgaggtcaggagatcgagaccatcctggctaacacagtgaaaccccgtctctactaaaaatacaaaaaattagccgggcgtgttggcaggtgcctgtagtcccagctacttgggaggctgaggcaggagattggcgtgaacccaggaggcggagcttgcagtgagctgagattgcaccactgccctccagcctgggcaacagagcgagactctgtctcaaaagaaaaaaaaaattttttttctgttaccagctattcagttcacagaaatatagtctgtataagaaaaacattctcttttatatttttagaataatgaactgttgcctcagcaacttctcaaggtgaccagtaagttattttcttttttaaatggaatattactatgtatttataaatttgggtatatttgataatgtatttcagcccattgcaatcattcttttttggagacagggtcttgctctgttgtccaggctggagtgcaatggcacaatcatagctcactacatcctggaatatctaggttcaagtgatcctcccagttcagcttcccaagtagcagagactacaggcacacatcaccgcacctagctagtttttaatttttttgtggaggtggggtcttgctatgttgcccaggctggacattctttttgatactaaaatgatctcatctttggttaatgggagtttcttcaagttggcttttttctcttctctttttctatttttatcatgaaaaaaatttaagtatacatacaaatacaggaataataaaaggaaacccatgtgtatacctacccctaagattcactaattattaagatttcatcatacttgctgcaaaatcattttaaaaatacaatatagagtctaacttttttattctacagtgtgtaacgtttcccatacacctcgtgggcctagaagtgctaatcaagactgatttgggcacctaccactttacagagttggattgtaccacactgtattacttttcctactcatgggcaattaggttttcactattataaatgcgtgctgcagtgaacatttctggacctgtttctctatgcttgtatttgacagagtctctgggtgtatatctggaaggatagttgcttggttgtaggatatgctctgttcaaccttagtagatattactaaattgctttctgaagtgattgtgccaatttacatttacccttttcctgtttcactgtttccttactgatacttgatgttatcagattttaaatttttgttaatctaacaagtatagaaattgttttaatttgtattttcctgtttattggtgagatttattcatttattcaccaaatcagttattacgcatcaggtaccatgcactattctgtgtttaatatacatcagtggttgaagatccctaccctcatggatcacataggcagaatcagacagtaagcaagaaatataataaatatagttgagtattagaaggtgagaagtgctataggggatttcttagtctatttggattgctataacaatgcaaactggatagcttataaacaacagagacttatttcttatagttctggaggatgggaagtctaaaatcaaggcactggcacattcattgtctggtgagggcccatttcctggttcatagacagcaccctgctgtgttctcatgtgatggaagcatgctctctggagcctcttttgtaagggtgcttatgccattcatgaagtctccacccttatgacctaatcatctcccaaaggccctacctcctagtaccatcacacaggtgaatttttggtgggggcaggggtggtgggatacaaacattcagactatagcagaggggtgtatattttttctccatgtaggtattatactacttttgttagatttttttccctaattgttgcaaatggtacattctaaaaattacattttctagttggttatcacattactattataagtaaatgctttgctgctcatctttttaaagtattgatcttactcatcaactcttattattaatagttctgatactttaaagattcccttagattttctgtgcgactaggttttgcatctttaaattacagtttttattctcctagtccttacgctttttctaagtgttgaattgtttatacattatttatatatattatatataatatacgtatataatatataatatacatatattaatataatatatattaatatatgtatataatataatatattatattatatattaatatatgtatatattatattatattatatattaatatatgtatatataatataatatatattatatataatataatatatattatgtataatataatatatatattatatatatattatatatattttttcttagacagattcttactctttcacccaggctggagtgcagtggcactccagtgatccgcctgccttggactcccaaagtgctgggattacaggcgtgagccattgtgctgggcctgtttacgcatatatttttattaacagacttcattttttagacgttttagatttatagaaatattgagcagatatttatcccctcccccaccccatcttatagtttcccttattattaacatcttacattagtgtaactgcccaacgggttcaccttgtgtgctgcctattcagagctgatttatgaagacaggggaactgcagaggagaaagagtaattcactcagagccagctgtgcaggagactgcagttttattattactcaaatcagtctcctggagcattcgggcatcagagtttttaaagataatttgacaggtaggggtttgggaagtggggaatgctgattggttaggtcggagatggaatcatagcaggtagaagtgagtttttcttgctatcttctgttcctgggtgggatggcagaactggttgggccagatgggtggtgtcagctgattgatctagtgcagggtctgcaaaatatctcaagcacggatcttaggttttataatagtgatgttattcccagaagcaatttggggaggttcagactcttggagccagaggctgcatgacccctaaagtgatttctaatcttgtagctaatttgttagtcctgcaaaggcagactggtccccgggcaagaagggggtctttttggaaaatagctattatcaattttgtttcagagtcaaaaccatgaactgaattccttcccgaagttagttcagcctatgcccaggaatgaacaaggacagcttaatggttagaagcaagatggaactggttaggtctgatttctttcactgtcatactttccttagttatgatttttgcaaaggcagttttgttagtgtgatacatttgttacagttaatgaactaatattggtacattattattaactaaagagtattttttatttattttattaactaaaaaataaagctaaaattccatagtttattcagatttcctcagtttttaccttgagtcttttttgttatttcaggatctcatccaggatattgcattacacttagttgtcatgtctccttaggcttctcttggttgtagtattttctcagacttttcttgtttctcatgaccttttatttaaaacattcaatgcctaagacatctagtataatttttaacattgtaagagtggagagccttgtctgtcttctgactgtaaggggactgctttataagttttaaagtatgctgtttgccatggattttggtagatactctttatcagattaaggaaattctattttctttcttattttttaagcatttttgtcatgaaaaagtatggggttttatcacatctttttctgcatctgtttgatcacatagtttttctcttttgatctgtttaatatggtgaattatatgagtagattttcagatattgaactggcctagcatttaatacccacctggacaggctatatgtacatttatatgctaacacacatatgtgtgcacacatatacatacatattcacatatgaatattacacacacttatttaatatgatagatttggcctagtaatctattaattaggatttttgtctctatattcataaatgaaattggcctgtaattttcctttcttctactatccctgtctgttttttgtagacagattttgtagcttttttcttagctgtcttaacattattaattatactctagttggacttaagctttctgttttgggcctggaagagattcattaaatatagcttctgaaaatatctactctgatctcttaggtctgcattcttcttaatacttaaaattttgggattcctcatggttatgtctatgtactgtctacaaaaatcataattatttgtagtggctattatttataaccaagtccttttgttactttggagtggatctttgaccttcaagatgttttgaacctggctgggtgcagtggctcacacctgtaatcccagcactttgggaggctgaggcgggtggatcacctgaggtcaggagttcaaaaccagcctggccaacgtggtgaaacccccattttttatatttataaaaatataaatatttataaaaatatttatataaatatttataaaaatatttatataaatatttataaaaatatttatataaatatttataaaaatatttatataaatatttataaaaaatataaatattagccatgtttggtggctcacgcctgtaatcccagctactcgggaggctgaagcacaagaattgtttgaacccaggaggcgaaggttgcagtgagccgaaatagctccactgcactccagcctgggagaaagagtgagaatctgtatcaaaaaaaaaaaaaaaaaaaaaaaaaaaaaagatgttttgaacatttttgtgattggcaattttgctagtgctatcatattgtttacattgtacttgacttttcttattctccatggaaattagtaataacagtatctacctctgacatttgtaccatattctattgcttataaagtatattttatatacaaaaagtgttttgtattttggatcccaaccatttgaaatgctcttcaccactgatactcataagagtgttacgtacaacaccatcaacttttgtctggattattgcaataattatttaccctcatgttccctacagttcatctcatacagcagccagattgatcttttaaaagtataatcaaatcataattctctcatgcttaaaaccctaaagggcttctaagtacactagaaaagttcgaattcttaccatgatttacaaattctgttttgccagtgcctagaacaaggccttgcacgtagtggatactcaatcaatatttgttgagttaataagtaactcattcattggcagttttagagaagcattgacttgcctcagatctcatagcttatgaataagtgaccacgtcaggatgagaactccaaatctcatgtttgcaagttgcctggctgagttacatttttctaattatccaatggaccctgaaccagactattctcactgtcttccagactctgtgtacccctgttaatttgtttgtgcctttctctttctgttttgccttctaaatcgggcccatcctcaagatttggacataattcttttccttttatggaacattgtcttatgtcttcagtaccgtgtacttgtttttgtggtggttgtggtgggtgggatggcggaggttacagtgctagtgggagaggaactcttataaataccagatattgcaccacatgcttaggtaagcagttccacttatttcccatgtgaccttatgagcaaagaagcactattacttaaaaatgagaaaacagccccagacaggttttcacttgcatcacctgaatggggaaatcttctatacattagccccaggaaaactcagagggctgtgaaatattctaaggattctaaggccaaaccttctccagctgcctggcagagctaggtgggtgcccaggtgcccttggtcaggacagttcttcattatcctgctttatttagcctgtctcacttggccagggccataaccaatagtctggcctatatgtcaacatcacacagagaaaataggagcaggatgttctgtttctgttcaataaaaattttgtttccaaacactaaacctttttataggtagttgtgatttttttccctgtctttacttgggcttctgattgtatttatttatttattttctcctttctgcttctagtattctagtcaagaagaaagccagaggaagccattgcccactgctgccgcccagtgttgtaagtgagaaacttgtctatgaatctcttttaattgtagctttctgtcgcttctctgaacatgggttattctgagctggggagggtggagatgtcatgtgtgtaagcagaagatattcctgaagcacatctgttcaggcgcctttctctgatggctgtctatctattagctttagggagacgtttttcggttttgtatggggggagtagggctcatctttttttctacatttgttagcttctacccctggaggaatgatttaaccccctctatccctgtttacctgttattattctttaaggctcagtttaaatatcatcacttctgggtaatctttgtgctgttttctccttctcccaagtctaacttaggtctctcctgtgtgcttccattttactgtgtgcacatccatcatatgacatatatatatttctttgacatgaacacaaagttttaaaagacatagacattgttccattttatattctttgcatttggctcaacacctatgcatagtatacctcaataaaatttgataaatgattgacttatttctcctgagattgatttgtcaagatcacacagattaattattgaaatgagccatacgtttttggtatattgttaccctctccccagtttccctcaaaacagcttgagacactaaaggactgacttagagtctgatctatttcgctttttcaacctgtgatatgtgtgtgtgtgtgtgtgtgtagggggatgcgggggggggggattttgatacttttgtgttgctctgttttttctgaatctcatgccaaactccatcaactacaagttgaagatgatggtaatgattgtagcatttgttgttgtaatattagtaataataagaactgtaggctgggcatggttcccagcactttggaaggctgaggcaggaggatttcttgagcccaggagtctgagaccagtttgggcaacaaacagatacctcatttctacaaaaaaaaaaaaaaaaaaaaaaaaaaaccaagtgtgatggcatgtgcctgtagtcccagatacttgggaggctgaggtgggaggatggcttgagcctgggaaatcgaggctgtagtgagctatgattgtgccactgcactgcagcctgggcaacagagcaagaccctgtttcaaaacaaacaaacaaacaaacaaaccatagcagctaacactattgaggtcttacagtatgccagatgccattctgagactttaagtattctaatttatttaaacttcacaacaaccctaagacagattttactgttgttcccatttttgagagcaggaaactgaagcataaatagattgagtaattcgccacaaatcacatagctagtaactggtgaagtaaatattcaaacacagaaaatctgacttagtagctcctacctctgtgtgaaccactgtgttatattgattccttcatattgtttctgaaaaggaaaacctttgtccatggtttgtgaatctgttggttgccttcaatttggtacattctataggcccactttcctgataaaagtaaaggccaatggtagaggtgaacttttttttctttatttaaagaaaacctatttttcatatgatttattactaacttttgttttttgctgtttaggaccgaacatttaaggtcataggaggtcagaagaatctgaatccaaaaccaggttttcaggtttacaggtccttttcaaaactcattgtaatgagttcattgtgattgatttaatcttttaaacctttttccacgactgctaatgagaagcaaaatgtaaagattgagattttacttcctactccttcctggtctcattgatgaaatataattgaagcgattaaagcgcaaatgccaagagggcaggaggaaataaaaaaccttaaataatcaagcaactttattcccatacatttttcatatgtttacaggctattttatttttctgtgaataagccattcttgtcttttgcctgctccctcgtatatttttattttgagaaatgttaaacctatagaaaagttgaaagaacagtaccaagagtgctcattaccctttactaggttcagtgacaagcattttgccagatttgctctttccctcatccccctcttatttttctctcatgtttctttatctctgtctccatacatacatacacaaaaatacaagtattttctgaatcatttgaatataagctgcacatgctataacacatcagcgtgtttctgctaagagctaggaaagtcaacataactgaaataccatgatcacaatcaagaaatttaagactgatacagtaatattgtctataatacagtctatattaagaactccctaattgtccccaaaaatattttgaaagctttttttatattttaaaaaattttatttattttttaatttttatgggtacatagtaggtatttatggaatacatgagtattttgatacgggcatacaatatgtagtaatcacatcaaggtaaatggggtatccatcacctcaagcatttatcatttctttgtgttacaaatattccagttatactcttttagttatttaaaaatgtgtaataaattattgttgaccatagtcaccctattgtgctagcaaatactagatcttactcattctagataactatttttgtacgcattaaccgtccctaatctcctcttacccctaactccccttcccagcctctgttaatcatccttctattctctgtctccatgaattcaattgttttaatttttagctcccacaaacgagtgagaacatgtgaagtttgtctttctgtgcctggcttatttcacacaacataatgtcctccagtttcatccatattgttgcaaatgacaggatctcattctttttttttatggataaatagtactacattgtgtttatgtactacattttccttttccattcatctgttgatggaagcttaggctgctttcaaatcttgcctattgcgaacattgctgcaacaaacataggagtgcagatatctctttgatatactttcatagccttcccccgccatgatctaatcaataaccatacatttcatttattgtcctgtctctttaacctaccttctttccttcattccttttcttttctttgttcttttctttctctctccttccttctttcctttcccttcctttcctttccttttccttttcctttcttttccttttctcttttcacttttctcttttttctttctttcctttcttgagaaggagtcttgctccatcatccaggctggagtgcagtggcatgatcttggctggctgtaagctttgcctcctgggttcaaccaattctcctgcctcagcctcctgagtagctagaactacaggccatgctaccactcccagctaatttttttgtatttttagtagagacagggtttcactatgttggccaggctgttcttgaactcctgacctccagtgatccgcccacctcagcctccaaaagtgctgggattacagacatgaaccaccgcacttggcctagtcttctttaatataataaaaaaaaatctggccacgcactgtggctcacacctgtaatcccaggactctgcaaggtggagacgggtggatcacttgagcccaggagttctagaccaatccgggcaacatggcaaaacatcatctttataaaaaaatacaaaaattagtcaggcatagtggtgcatacctgtagtcccagctacttgggagactgagccaggaggatcacctgagcctggggagattgaggctgcagtgagccgtgatcatgccactgcaccccagcctgggtaacagagtgagaccctgtctcaaaaaaaaccaaaccaaaccaatacaaaaacaaaactttgcctttttggtcatttatgatattgatctttttttatttacaaaaatagtttattctaattataatctctattcatatgggggtataccttcttacaggtttctgggaagcagtttagcaatatgtaccaagtctttgaataggaataggctttgactcagcagctgaatttctggaaatttatcctcagtcatcacagcagacaaagatatatgtgcaaagatgttcactgcagaattatttaagtagcaaaatttgaaaatgacttaatagttaaacagcagtaaaaaataatagtccttaagatagaatattatgcatttattaaaaatcatgctttgaataataggaacattttcatggaacttggtaaaaaaaaaaaaagtattacagttatccctcagtatacttgggggattgcttccaggacccctgcacgtaccaaaatccgtgcatactcaaattcctcacttggccctgaggaacccacctatatgaaaacttggccctctgtatatgcaggtttcacatcctgcattttctatctgtctcattgaaaaagatccataagaggactcatgcagttcaagcttatgttatttaagggtcaacttaaaaccctcagtgtgtgtgtgtgtttatgtatatatatacataagcaatttaagacttattgctgagaacttaattgtgtctaccccccatttatatattgaagcctcaacactcaatattattatatttggagacatggcctgtgaggaggtgataaaggttaagtgaggtcataatctgatagggctggtgccctcataagaagaagagatagcagagctccatccctaccaagtgaggacacagtaagaaggtagccatctgtaagccaggaagaaagccctcaccaggaattgaatcagctagccagccccttgatcttggactttctagcctccagaactgtgagaaataaatttctgttacttaagacacccagtctaagtgatttcgttaaggcaatccaagaagactactgcagattttggtactaagaggtggattgttgctgaaacaaataccaaaaaatttgcaagtagctttggaactgggtgatgggtagaggctggaagagttttgaggtgcatgctagaaaaaactgagatttccatgaaggggttattgttagaaatatggacatgaaaggtgattctggtgagggcttagaaagaaaagaggagagctacagagaaaacttccatcttagagaatgtgtaattaatcatgatcagaatgttggtatgagtgtagatattaaaggcaatttttgtgagatctcagatagaagcagttaataataataataaggaaataactggaagaaggatgatccttgttataaggtggcaaagaacttggctgaattgtgttctagtgttttgtagaaggtagaacctgagagcaattaaattgcatatttagcagaagaaatttctaagcaatgttttgaagatgtgatgtggctttcccttactgcttgtagtaaaatgcaagaggacagaaatgaatgaagaaagactgttggacttcttaggttctagaagactggaccatagagctatttgactgtgaatctgtgctattttccagggaaaggaaagaattaccctcaaaggtgacagaggtcatcagggctgcccccctcaccacagacctgggggcaaggtcatttacttcattatgtaagagggcaggcttatcacagtgaggcagctcctgaaaagccaaggaggcagatatatcaagccaaagagaattattcttgagtcttagatctaatggaattcaccttggtaggctttggacttgcttaggacctgtcaccccttcctttcttccctgtttctctcttttggaatgggaatgtctagcctatgtctgccctacgattgtattttggaagcacataacttgtctggtttcgcaggtttatagctggaaatgcatttcgctttaggatgactctttactcaagatcactcgtcttatttagatgataattagataagacttgggactttagactttgaagtggaaattgaatgagttaagacttggggctgttgggatggaatgaatgtatcttgtgtggataaagacatgaattatggggggctggggcagaattgtatgaacttgattgtgtcccctccaaattcatatgttgaagccctagtccccagtttgactgtatttggacataggacctgtgaggaagtgataaaagttaaatgaggtcataaggatggagccctaatctgacagggctggggcccatttaagaagaagagacaccagagcttgctctctccaccatgtgaggacacagcaaaaaggtgaccatctgcaagccaggaagagactgttcaccagaaaccaaaccttatgggaacattgaccttgggctttccagcctcagactgtgagaaaataaattgttgttgtttaagctccccagcctatggtattttgttatggcagcctgagcagatgtatacactatgtaaatgcatctatacaattataagaaaaattactaggaaaagaatgatcaaaatattaaccaaatttgtctctaggatatgggattgtggccttaaattttttttaatagttaaaagttattattggccaggcacagtggctcatgcttgtaatttcagcattttgggaggctgcagcgggaggatggcttaaggctgaagttcaagactagtccaagcaacatagtgagacccccatctctacaattaaaaacaaagttattattaagaaaagtaattgagttcttgttcattctttttcctttttttgcgatggagtctctctcactctgtcacccagactggagtgcagtgacacgatcttggctcacggcaacctccgtctccctggttcaagtgattctcctgcctcagcctccgagtagctgggaccacagtcatgtgtcatcacacccggctaatttttgtatttttgttggccaggctggtcttgaactcctgacctcaagtgatctgcctggcttggtctccaaaagtgctgggattataggcgttgagccaccaagcccagttgagtccttgttcttaacctgggtttgctgctctctctctgtgactttggaagtcatcccactgttaacttcagtttcttgaagtaataaatggaggtggtgttctagatgatctctaggacttttccagctgtagcacatcatatgactctattacttcctagtcctcagattccttcatgtggatggcccctccactacccagtgtgttaggatcaatcctctgcggccatttataagatgtttccaaagtattttcagaaatcactgggctactgctctaaagaaactctccctttgatacaagagttactgtggctggaagtggtggctcatgcctgtaatcccagcactttgggaggccaaggcaggagaatcacttgaggccagcagtttgaaaccagcctgggcaacatagcgagaccctgtctctatttaaaaataaataagtttaaaaagtaaaaaaataaaaggagttactctagccccagttatttggatatactcttaaaggtgatgggattctttaaaagtattgaggcaaactatctgcttttcccctttgtctcaggtcaagcctttctcttttagcattcagtaacaacattctgcattcacttttatcctgtgaagtttttgtctcatttggtaactgatatatttattttaaaatgttgtagggtaattattgtgatttattatgtccatctgttttttatcccccattttattaccatttctagcatttaggctgacttgtgcccatttcttgaaagaaaggtaaggcagagagcagaagaagtgatctttgtggttttaacttcccaaagcctaagattttaggagagtatgcaaagtgttctggacaaatattatgagagggagcagagtttcacctgaatctcccaatttctaagaagagcttcttttgacttgaatgagaggagagaaatgcaagagaatgaggagagaaagaaagaaagtgaccagggtagatacattgggaccttgtgtctgctttctgtgttagggcactggtgaagcagcaggagtcaaagaggggatggctaggtgttgtgtcttaggcagatggaccatcacaaagagattcctatgctccaagttgcacttgctccaaaatgagtcttgggctttctagaagtgggaaagtgagcctctggtcctattggaaccacttgggcaggaataagaaatgtctctctcagaagtgttctctgtgtccgagtgactaaggactggaggagacctggactatcttgatgaatgccagttcacaaagacacatccatgccatgggcagtcacttcactgcagtgtctttttaaaaattattatgctttaagttctgggttacatgtgcagaaacactgcagtatcttattcacatgctgtgtcagtattcagagcagtcttcatgggacaggggcaagacttaggttgagactgaaggatgaatatgtcttctaagagtgataacattagttttcctaggagacatattgatctctttgttggtggttgttgcctctctggctgatattgcttggttgttcctgccctctgaggtgtaggtgagtgctggctttctcaatggggtgcaggtgtgagtctccaaaggttacttttggggactccctggggtcttatgtgagtgattgctctggttcaacttcttttgtcctgctattgactactaccaaaagatgtacttagcttgttgctgctggtatcctgttacttagaggcttcttgaatggggaaatatcaagataactgggactcacccacattccacagaattcacatgacccatgggaactcaattattcttgccctgagaaacaaaggatataggcaagcagttccattctcttctctgtctcccagctctgcctcctctgttctttttggctgcttagaaaagtacacagttcacatcagcaagtctcctgtccaagcagacatccaacctgtctggctccactcccattcttgtaggcatccctaacctttgtgaattatgaagctcctcctcacttggattcagagcagaaaaacattcgtttttcccctccccaggaggtggagaggggaaggagtgacctctcttcaccaacaattgctctcccaaaggttgctgggtcccacattgacatagacattctacaagacagctgacaaggatctagttaaattgtcttaacaaaatttcctggttgggcacagtggctcacgcctgtaatcccagcactttgggaggctgaggcaggcagatcatgaggtcaagagatcgagaccatcctggctaacacagtgaaaccccatctatactaaaaatacaaaaaattagccaggtgtggtggcgggcacctgtaatcctagctactcgggaggctgaggcagaagaattgcttgaacccgtgagacggaggttgcggtgagccaagattgcaccactgtactccagcctgggcgacagagcgagactctgtctcggaaaaaatttcctaaaatctggatttgtctgattatttcctcgtaattagattcaggttactgcacagctgatgtcaatttgtccctttatttgtgatgctgatgttaattattagttcagatgatgttttccagatctctttgttgcaaagatatttttctcctttgtaactaagtgtgtagtggcagtgatactttgagactgtgtgtatactgcttttatttaaataaacttccatgcattagttttaggatgtattatgatcattgcctaaatttattattacactgtggttgcaaaatgatgattttctaattctgtcattcttttttaaaaggaaaaaatggtttctctatacttgcacaattctgacaccaagtatgttttccataccaagcaattctctgctaacatcaactgagtgtctcatgacttaattctgacactagagatgtggagttagtgcagaccctacaggttaagggctcagtcccacaagactgcctcccactttagagaccaatcataaatcccaggttactgcctgaacttctgaccaactggctataaactggagttcccacaagcccctcctcaggttcaataatttgctaggatggctcacagaacccaggaaaacagttaatttggtattaccgattgattaaaaggatattttaaaggatacaaacaaatagccagatgaaatgatacattggaggaagtccagaagggtctgagcacaggaacttctgtccctgtggagttttgggtgcactactctccctgtgggtgcatttttgttcaccagtgtggaaactctctaaacccctttggctggggttttcacggacacatcattatgtaagtatgattggttaaatcattgatcattgatgattaattggctcaaccttcagcccctcttttctccctggagtttgtggggtgggactgaaagttctaaccctctaatcacaaagttggttcttttggcaactagcctccatcctccaggagttatcacattagcattaactcaggtatgattgaaaggggcttactatgaataacaaaagacagtcttatccctatcactcaaggagttaaaagggttttagaagctctgtgccaagaactgcaggcagagaccaaatatttatttcttattgtgtcacactgttattatactgaacagttgccagtcttttgtaaagaagagctttccttcttcgcatacccccacccctcttttaaaatgagtatcactatggacacatgatttttttttttgaacccagtgttttgtaatcctgttctgccattttctttgatgctcaaattgtcctgaatttggcctatgggtgttccttttaactagatcctgtgtccttttgacatggccctatcattctttgaccacttccttccttccttagtacaaaatattccaagctcatcttgtactttgccttctcagtcctagaataagtcatttctccaatgaggctggttatttttagtggggaatggtatttaaaaatcaagatcttggcactagttttgctcgttgctacaggagggctcttgcttcttggctctttggatggaactagggaacacactatgttcttcatactggtatcaccaattaacaccctcatcacaaggttttcctggtctcctttcatatattctctctctctctatgtatatatatgtgtgtgtgtgtgtgtgtgtgtatgtatgtgtttgtgtattatgcacatatatatacacatatatacacacatgtgtatatacacacacatatacatgtatatcttccagtgagaacctctgttcccaagaacatcaaattatttattcatttgctgtgtcctgtaatgtacacaaacaaattttaggattaatatacccagtgctattatcaacaataagacaacagtctttaagattcttgaaagtttttttttaaccttagaatataaactcacataagattacaaaaccaccagcacaccaaaaatttaacaaaattttataatgtcatcagtatctatcctatattcaaatatccccagttttcccccaaactttcttgtcctttttgcaccattgtagaagttaatcaaggttcacacattgcatttgtatgtggtgtgatttgagtgaagatcgtctttttgcatgtggatttccagttgtcctaagaccatttgttaaaaaggcattttcggccaggcacggtggctcatgcctgtaatcccagcactctgggaggccgaggcaggtggatcacgaggtcaggagatcgagaccatcctggccaacatggtgaaaccccatctctactaaaaatacaaaagttagctgggtgtggtggtgtacacctgtagtctcagctactcaggaggctgagacaggagaatggcttgaacctgggaggtggaggttttagtgagccgagattgcgccactgcactccagcctggatgacagagtgagactccatttcaaaaaaaaaaaaaaaaaaaaggacatttctccccccattaaattgcctctgcatctttgttaaaatcattcttactaccaccacatgttcccattactttccttccttttagcagattagattttatatattcacattagaaagtggatatactttcttttaggatatgttcttcagatgtggcctcagctgggagttggtagcagatgccaggagacgcatgcggctttttgcatgcttgagcctcagtacatcatgtttacttttgcaggtcttattgctcctcaatttatagagctgttctgaggctgtgcaatctgatttgcatatttgatacaaatcttgcaacaaatggtatcagtataatataaacatttagccacaaggctaaatggtcagaagttgagctagagggataaactggtctgttccttttccaaacatacctaaagtttctaaggtatttacacttcactcttcaataaggataatatttctacctatatcttgtcaaagaatgtagcaacacaccatgttgccataccagtctgactactactaaattcaacaactttctgctcttttcaatttttatacatgtctgccttgcccacccactgtattaatgacagtatcactggctacaattgagaattgaatcaaaagtgatttagcatgtgatgaaggtttggtgagatgactacttacatcgaaaccatcctggccaacgtggtgaaactgctagggtgtgtaaattagtacaacctttctaactcagtgattttacttctaggaagtattcaaggaaaataactagaggttcaaaggaagatttatgtataggttttatttataatagtgaaaaattacaaagaaaggaagaatggataattatggtatttccatatgatggaattgtatacttttacataaatttttaagatagaggaaatatttatgtgtataagttctaaaaaataggatcctaacctgattaagatgatctcagttatctaagaaataaattatatacatatgtacgtagaaaaaccacaaggaaatataatttttttgttttttttttttggttgtttcgttttgttttttttgtttttttttgtttttgttttttttttttgagatggagtctcactctgtcgtccaggctggagtgcagtggcagaatcttgggtcactgcaacctttgcctcctaggttcaagcaattctcctgcctcagcctctcgagtagctgggattacaggcacctaccaccacacgtggctaatttttgtatttttagtagagacagggtttcaccatgttggccaggctggcctcgaactcctgacctcaagtgatctacccacctcggcctcccaaagtgttgggattacaggcgtgagccaccacgcccggcctgttttattttttctttatactttattgtactttccagatttcctccaaagaacatgcatttgttttataataattttaaaagggataaatattttaaaataacccaagcctgacaatacagaagcaagttattgtagattcacttttttagtttgaatttgagacttagttgaatgataatttattgttgagattgacatagtttagttcaacaataccagtgattccttcactgaaaattccacgtagcttttagagttgcagtgtaccttttattaatgatatccctaaagcctcccttaactacttaccgtgtctgaaacaaaaagcttctggggtctatgttatttctatatgtattatgatctaaaagatagcttgaacttttgcttgagatatagcccaccttggagtttcaaagagatttttctggttatctattaagggtttgtttcactggttttcttacagtattgcctataattagtgatctatacaaatcataaaccaaaatgtcctgagtacgaatcattcttttaaattagtaaaacggcataacccaacatattgtttaaaaattttcttgaagaatgaatcagttcagaacagttggatgtgagtcatatcatgaataacaagtgaccaaacattcagaagcattgtcagtaatatactgcttagttgctgggttgtgacaaattatttgaccaccacaaacttcagaagaatttcttttaccagcatatccaaaagaggcatgtttaataaaattacttacctttcctcattttcaactcttactgtcaaatgtcctggtcctagtgtccattgcgttgatatttgttgattcttagatggcaagcagtaggttttcaatgctttccactagttttcagccattagacctgatattcatattcctagtgtgcaccatattcaaatactcctcttatagcctcttattattcttggtctccatctaaaactgttcactgccactctattacctgtcttatttctaatattctacctgttaggggaggcagagaaatgggtcattctgtatatgtaactaggtattccccacttggacgattaggttcctgcctgctctacaagtgatgatggtataatccccaactaaaatcaaccacaaaaaaaacgctaggcaggtactgccagtgcttctcttagtctcattttcacacctaccagaaacaagactagctttaggcctgtgggctgtgttggccgcctctcaatggaggctaggacttgctttcgtagttgggtcttatagactttaagtagaacaggaaatgttgtccactcgtttttggtccaggatacctttcttttattctggacccaccacagccagagggagctgacccaagtggcaattactgtgtcaaagcttgatcatgtagagtatgggactatcactccaccatttcatgccagagaacaccatcttgagaggatctagtgcttcctgaccatcagacctaactacctcgcacagctccaagtaaaaaagaagcctggttagaaatctggatctgtattacttattttccgtatgacagtagccaccatactgataacccctgcctatcaggagatatatctcttagagagctttgtggcctcgcactctcaactagtactagcattcttttcttttctttttttgtagaaatgggggtctcactatgttgcccaggctggtctcaaactcctggcctcaagctatcctctgccttagcctcccaaactgctgtgattacaggtgtgagccaccacacccagtcaagaatttgcatgtcttacagattcaagagcatatagtagattaatccatgttcctaataatgccttaaagagaaccagaatctctcaccataattgaattttgaagggacagaactcagaaaatctgtcctctgtatccccttataatgacatgttcttattctgtggcaggccctttgaagacattaggatggcctgctaggacttctgacagccttcataaagaatgccccacaatgaaatttgggggacaaatgccaaagataatcctgggagacctgagagattattgaactctctcctgatgcccaggttcctctgggacattgctaccttgggtttaattataaatgtatccacttcttgaagccataatataatatgtatgctgttcacttaaattcagggccctgtgagtgggctatttagtccctacaccagctggcctttggctgcatccaaattgcagtgctcccccataaaagagatgtccagctccataactttcccaatcattttttgtcatactgtgaaatcatacttcaatagatatcatgggtttggagctttttgttcagtgtcctctaggttaaaattctgcactctcaaagtcatttgtgatttaaagttgtagaatgtattggttttcttgttagttttgaattctttttttttcttttctttaccttggctggataaagttatgaattcttgatggccactttgcatggtattgtgaagagcagctcagagtctttttttctcccaagtctcccaaccagttatctttttctgcatcacttgtttctaggaaatgggtaaactagagttaaaactttggtcagcttgactcaaatgtctgtgttctttccgctataccaccaccctgtggtggcaaaaatctcatgggatataatttgccattcagaaatatgtgcttttcttacgtggctactgccctttgttttaattaaaattaattcatttattgaataggtaatatactttgtataggagttttaaaatattaaagggagtatagtaaaaagtctccctcctgttcctattccccagccacttgggtcttctccccagaggtaatcatcgttagcattttcttgtgaatcattcaagaggttttactgctgttcgaatatacaggtatatacattagagagatcttttgattattctttccatcctttgaattggttttatttactcattcatttattctgagatggagtctcgctttgttgcccaggttggagcgtagtggtgtgatctcggctcactgtgacctccgcctcctgggtttaagtgattccccttcctcaacctcctgagtagctgggattacaggcgcctgcaaccacacctggctaatttttgtagttttaatagagacagcgtttcacaatgttgactaggctggtcttgaactcctgacatcaaatgatctgcctgcctcagcctcccaaaatgctgggattacagtgagccactgtgcccggcctgaattggttttagagtaccaaatactacaataaaatgtccacagctaacttatagttgagatttgaatacttcttgatcagtgtcttttttgggttctcactctgttctaaggatttatttaaaagccacaggggctaggtgcaatggcttgtgcctgtaatcccagcactttgggaggctgaagtgggcaggttgtttgagctcaggagttcgagaccagcctgagcaacatgatgaaacccgatctctacaaaaaatacaaaaattagcctggtgtggtggtgtgtgcctgtagtcccagctacatgggaggctgaagcgggaggatcacttcagcccaggaagttgagactgcaatgagccaagattatgccactgcactccagcctgggtgacagagtgagagcctgtctcaaaaaaaaaaaaaaaaaaaggcatagggaatagatggtttattttattttccctgttgctttccatagcaaagatctgtttcccaaaatcctggccttgagtacaatagaaatgtttcctctgtctgcactcaccctcctagaatgactttcacacatttattcctgggtcaagaacttctgcagtttatgtccatagaatatgttagtttcctcactaattttgaattcgttgtggtcactttttgtggtgttgtgaagagttatttttttcctcttccaacatactgagtccctttcttattttaaactttgtaaaaaatagaaatacgtaacatgggtactataaaagtcttcaaatgattcagaaatgtgtaatatagaaagtgaaagtactcttcaatttccccctctattccactccgggataactagtcttcacagtttcgtgtatattcccccaacattttaatttttatttttaaaaaatgagtcaaaaatttaattatgcggtgtctttcaatgataattgttttccctcccacaaaggccaaattgttctttttgtctgaattacaaaagaataaatgtaaaatacaaaagttttagagcataataatgaaactaatacccattagcctaccactcatcattatcctttagtatagtttagtaatgtactcagaagtttttcttagatttatcatgctccctgagtgacagtgttttccttcatatgggactggtgaattgcaagtgtagggacatagtctttggtttcttagttttgctgtctgatatgttaggtactcagggagtgacgcttggttgtttgcccctgagggacctcatcccatccaggttttagggaaagacaatttaacctttagaggaaaaaaaacaatgatcattgaataagagtgtaatttgcagtattttctggaagatggcatcctttttctttgggttggaaatttactttctccagagcttgtagattgctagaaagcttctgtaattgtgactactagactcatattcaggcgattgagacatgagtttggcaatagctaaagctttgttggctatattgtaaggtaatttataagcattagaatgctcaggggtatccctagtagaaatgacattgaagcagatgccagacagagaactgtcatacttttcctaatttttcctgtgaagctttgagacttcagcattacagaaaagaaatccagagccctgaagtacaaaggagcttatccattatagagcttttcattttctcctttgcaaaggcttttatattttctcggggggttcttgttcttagtgagtagctatgtaaaccagggagtatatttgcagaggctaggaaagaattaatgggagaatgcaaaaacaatcaaaagatctgaatcacaacctagactcaagtccgaagaggtaaatatacaaagacagcaacttgaatatgtaatttataattacatattcacattgtgtacacagtaataccatggaaagtaccctcaatgggtacacagtaataccatggaaagtaccctcaatgggtacacagtaataccatggaaagaaggaaagtcccgaggtggcaaaggaataaataaatggttaagaatggcataaagtttgttcaagaaggctttccagaaacatatgtttagaaattacttttgaaagaactaatcgagatgtgttcattgaaatgagagattgttcacagtagtataaatgaaaagaatgaggagaggattacaaagatgcaggacacactggcttagagtacagtgatgtcatagttgtacttgctaatctgccagaggaaatgaatcctcttgttgttgttggccttcaaaaagccaagatgtacagggctcgcccagtttggcagattcatttctttgggagccttttctttcttttactccagatacgtagagtcctcattatcatctatcaccttctctctgtttaaatgtgtcgtagaattgaaagttttgagccgcttaagattttggtggctaaaattttgttgctgtgatggaagacctgtttctgtgaacactggaagcagaagagccttatgattactttttacttatttacccaggaccacatgccctgcaggaaaataggattgcatgaccagctggcctccactctgcagattcatccacttcttcaatgtcctctatttctccttctcatttttaaaatcccagaaggcataggtccccaggtcatatacttcttttgccaccttcttctacctttttgccactttttttttttgtctgagccttctatattggctcttgcattaaagcatcctaatcattctggagttccataggtagctgattcttgtttatcttataagtaggatattttccccattttattttattttttgaaaggaaacatgtgcataaggtacaaaattcgatgtaaaaatgtatgctatgaaaaacagctttttttctgtaccctgtcctttagccatacagtttctacccagaggtaaccactactgccatttactgtggatttctctagaaagagtttatgcattcacaaacatataaatatatattcccccacccccatgaatggtagtatgctatgaactgtgtttagtgtcttgctttttatcatataatatgtatgactacatgtagggaacaggttcataataatggacattttaaaaattgaggtgaaactcatgtagcataaaataaaccattttaaatatataatttagtgacatttagtacattcataaattgtagaaccattacctgtctagttccaaaacatttttatccccctcaaaggagacctcatacccattaaacggtcactctccattctctccacccctcaccgctggcaaccactgatctactttctgtctctatggatttacccattctcgatatttcacataaatggaatcatatagtattaggccttttgtgactggtttatttagcagcataatgtttttgaggtgcattcaccattgtggcatgtatcagtcctttatcccatcttatggctgaatactaattcattgtacagatataccatattttgtttatccattcatagttgatgaaatatgtttttttttaaaccacttttggctattgtgaatagtgctgctatgaacaacagtgtacaagtatttgaatagctgttttcagttcttttgggtatatactaggattagaatggctattaatgtacatttaagttgcttccagtatttgcagttacaatactgaaattgatattttatatacataattttatacatgtgtgaatatatctgttggatgaatagctaaaagtgcgattgctgggccaaagcattgtacatttaacaatgcatttgaattttgaaatatgttacagaattgcccactatggaggctgtactatttatattcccacttacaaagtatgagagtgcttcatctttccttagcttttaggaatagtcacccttcctacaaaattatattgcagagatggcacactgaggatagccataggcaaacagttcctgtgccatgattcactgagtctcctttctgcttgcctgcttatcctgtctttttctcctctaccatctgggccgtctgattttctgattccccaaaaagaggtcttgataactgggccttttgtttagtgtcctggtcaaagttcttcctctggtttaacttctgtctttctgcttacatgttaattttgggtaatcctttgatttcattttcaataataatattgtggaagtagagaggaaagtgctgaggtgacagaagaagaagcaaatggttgagaatggtataaagtttgttcaggaaggcattctagaaaagatgagtttcgagatgacttttgaagaagttatttgcaatgtaaagtttgaaaggagagattattcctagtaggataaatgaaaagtaggaagaaagggttcaaaaggtaacatactccatctcaccccactccccatgtcctggtcaaggtatctcttactggctggaacattctttttcctattaccttatcccattggggagtgggaagtaaaggatcagacagggtatagcttctggtacctccagtctaggactaagactctgagagacacgaaaatatactagttatggactccttagagtgagtgcacagggagtattattttagtggtaaggcagtgcaatgggtctaggactgtcagtaagggtgggtgatgagttttacactagatatgtggtatcagtggaagcagctgatattgatgctaattataggtgctggcaaactaaaaagaaaagagagaaactattacaatatggtttggctgataaaaataatgttaattgtagtcttctgactcatttatttatttctatcctggcttcctctaaaaagaaatttgaggtggttaattgcagtcattacatcaacttattataatttatgttcagttacaattatacacaattaaccatgttaaaaatgtcagattaatgtatcaaagtttcatttgctagcaacacttaggtgtctatgctgagtacagtgtgtgttgtatatgcataaaggtcagttattaccataaaagcgtggtcatctgatggcttcttgttataggtttcattgggaggctgaggcgggtggatcacgaggtcaggagatcgagaccatcctgaccaacatggtgaaaccctgtctctactaaaaaatacaaaaaattagctgggcgtggtggcgtgcgcctgtagtcccagctactcaggaggctgaggcaggggaattgcttgaacctgggagacggaggttgcggtgagccgagatcacgccactgcactccagcctggtgacagagcaagactctatctcaaaaaaaaaaaaaaaaaattagctgggcatggtggcactttcctgtaatcgcagctactcgagaggcagaggtaggagaattgcttgaacgctaggggcagatgttgcagtgagctgagatcacaccactgcactcgagcctgggagtgagagactgtctcaaaaaaaaaaaaaaaagagagagaggaatgaaagtccctgacctcagggagctcaagtccagagaggaagaaacataagtagtaccatttgataagtgaatgggaacgtaagtacttgatattcaaggaatacagagaaagagaatgtaatacaaatttgggatggttaggaactgcttcccagaggaaatgatatctcaaacaaagtctgtagtttacattatggttctctctttgtattgtacattctatggattttgacaaatgtgtgatgacacatatccacccttatagtatagaatagttacgctgccctaaaaatcttctgtagtttacctattcatttctacctctccccagatccttggcataaattgagtcttaaaggatgagtagcagacagttaagtgaagaaggagaaaagagttcatagtacaaggacactaagatgaaaaagcatgacttaaggtaccttggggtactgcaagttgaaaattcttgatggcttcggtggagggaataagaagagtggggaagggtcagatgaggccagagagacacagagaactcatatcacaaagggcttgaatgccatagcaagctgtttatattttatcttgaaggcaagggggaacctttgatgactttatgcagaggaatgaaacaattagatagcagtgattatagtgatgtgagcagtttgctgcattaaaaatctttttaatggtagaatataacacagatatatagacaactttataaaacaaatgtttaaatgtattagtataaggtaggtaaaagatagacctttgccaaccaccccagaaagcctccatatgcctcttcccaatcacaaccccctcttccctaaaagtacctactatcccaacttttataataattactctcttcttgttctttatatgttgtcacccaagtatgtatctttaaacactagagtttgtttttgcttgttttcttgttttctctttttgatatgtcttacaattttttttgtttgttttgttttgttttgtttttgggatagtctcactctgtcacccaggctggagtgcagtggctgtgatctcggctcactgcaacctctgcctcctgggatcaagagattctcctgctttagcctcctgagtagctaggactacaggcacatgccaccacacccggataattttttttgtatttttagtagagatgggatttcaccatgttggccaggctggtctcgaactcctgacctcaggtgatctgcctgcctcagtctcccaaagtgatgggattacaggtgtgagccaccatgcctgatcatgtcttacaattattttttattctatgggttccccctccgtctcttgcttttttttccttacaatttgtttattgaagaaatcaggccatttgactatatggttttgtttgacttacagagttttttacattcccgattttgctcaaaacattcctataagtttagcttaacacactcttctgtcctttgtatttcctgtaaattgtagttgcacattgaagattgatgatattgatgccaggcatattccatagtttgagtatactataatttaaaattttttccccaatttgtagacatttggattgttccccagtttttgctgctaaaacacaatactatagtgagcaactttatacacttttttttgtaaacatgttcaaatgaatctcccatcctctattacacagtatgtatttttcctctatggcactttctcagtttgtatgattatttgattaatatttgttcccttctttaggccatacatttcatgagtatacccattgttcataggtattttcctttgatttattaatatgcttatctgtgtatccatagtacctttgcccaataaatattagttgaataaatgcatttctataagtggaatcattgggttaaagaatatatacatttataattttgttagacactatcaaattgtataaaaatattttacctatttatatttctgctgctggtacttattttcacatttagcctcactggcccactcaacaacaccgtgccccccacccacctcttcaccccctctcctcttttccttttgttactttcttctacaaacatttttttgacacttacattccaggttttgttctaggtgtttaggatatatcagagagcaaaacaaagatcctgggtgggaagaaatagacaattaacataataaggaaataatataggatgttagagagtgaaccaataaaagagtgaaaggcagttggtaatgctagaattggagttgagttgcaattttaaataaaattctgagtattggccacatgagaaggtgacatttcaatagagttgaaataggtgagggaattaacgtggctctctggggaaagagtgtgataggcagcgtgaacagctagttcaaaagctggtagctactgaaaaggagtaggaagagttttgctgggtcctgggaatgctgtttcttgatctgtgtgctggttacctgagtgtgttcacagtattcattgagcagtacaggccgggcgtggtgtttcacgcctgtaatcccagaactttgggaggctgaggccgggggatcacttgaggtcaggagtttgagacaagcctggccaacatggtgaaatcccatctctactaaaaatacaaaaattagccaggcgtggtggcatgcgactgtagcctgtagtccagctacttgggaggctgaggcaggagaattgcctgaacccgggaggcagaggttacagtgagctgagatcatgtcactgcactccagcctggttgacagagcaagattctgtttcaaaaaaaccaaaaaaacaaaaacgttgagcagtacggttatgatttgtatatttttctctatcttatacttcagtagagcttgcatatttaaaaatattagtggatgttgaacatttcaaaatgcattaatagtacttaaccaattcatggatatttttctttgacttattaatataatgaatgcattaatcagtttctattaataaatcatctttgcctttctaaaatataacctacttggttatggtgaattattcttttactataatgctaggcttgatttgcttgtatttcattttggatttttctatctatatcacaagtaacgttggtgaatagttttttgttattctcctatgttagatttgaagtgttttccttaattataggttctttactactgtcttccgtagaaagagaagttctacagtacttaccgaatcaactgtctagaaaaagggaagagaataatttctagtgtttgagtttatggtccttatgagatacctggtaattactacaatttagtagttgataggtgagttcctgtcattgcctagacagatggctgttcacatggagtctggggcttaagtattccatcattttaatgtcatggaaacattagccagtactggactactaatgggtggtgtaacagttgcctgggggtgttttgtttgataattgtagaccttactttttaatgtgactatttctgatttcttacattttccactagaaacaagataaaatgtgcagaagaagcagcctgtgagtgtgttgctgtagcctagtcagccagcctaggggatggggataagtgcagaggtttaccttctaggaaagaggatgtactttcgtcttagaactgctagaattttttcactgtatgatgacattgaacttttcttcaggctcagtaggatagtgggtctggctgccttcttcctccattagcacaggagtattattcttctgtctgggagactgtggctttttcatataggaaattctatagctgtgtttttcgcaatgtaattcaagaatcattggcatgagagtcaccaagtttcttgttgaaaagccctttgaattagaatctctgtgagtagagtttaaaatttacattctaaacaagagcctcaagtaattattaaaattaaaagatggccaggcacatggttcactcctgtaatcccagcactttgggagcctgaggcaggtggattgcttgagcttgggagtttgagaccagcctgggcaacatggtgagaccccatctctacagaaaacaaaaattagtcgagtgtgatggcacgtgcctgtagtcccagcttctcaggaggctagggtaggaggattggttgaggcagcaatgagccatgattgtcactgcactccagcatgggtgacagggcaagacctggtttctaaaaacaaatttttaaaaagtccagtcaaatatctgtaataattcagaataattctgtaatctctaataattcataaggtaataagtttcttgataaggatagttaaatcttcaaggaaagcacaaaaggaaggagatttcagcagaattaactactaagtttgttgactgattggacatgggaaataaagaggaattttaagaatggtcctgtggtttctgatttcaaagtattgggagtttggtggttttggacatgaggtgtacttgctatactcccgtatttctagagaatttttaacactgtaaatacaatgccattaccactgggggctgtgatactgtgattttataataagaaacatatattttggtctttgtccctggttcctgacacagagctcctaatctcttagaattttatggatactaggaatgtctgttgttctaatgagggactcttgatgggcttccacataggaaccagttatcagacagaccaagccatgtttggaagcttggaactttttttttttttttttttttttgagatggagtttcactctgtcacccaggctggagtgcagtggctgtgatcttggctcactgcaacctccacctcccaagttcaagtgattctcctgccttagcctcccaagtagctgggattacaggtgcctgccaccatgcttggctaatttttgtatttttagtagagaagaggtttcactatgttggccaggctggtctcgaactcctgacctcaaatgatccacccaccttggcctcccaagaagcctggaaattttagccccattccctttccttcaggaaagggagaggaactggagattgagttaataattgatcatgccaggtcaggcacagtggctcctgtctgtaatcccagcactttgggaggctgaagcagtaggatgactccagaagcttgagaccagcctggacaacatagtgaggccctgtttctacaaaaaaataataccactaatactacttataatagattgtgtctatatgataaagcctccataaaaatcccaaaactgtggatttttggagcctctgtgttggcaaacacatccgtgtgctgggagggtggtgcatcgcaaatccacagggcagaagctcctgtgcccaggactcttccagaccttgttctgtgtatttcttcatgtggctgttcaactatgtcctttgtaatatcctctaccgtagacgggtaaacataagtaaaatgtttcgttgaattctgtgagttgtcctgcctcagcctcccatgtagctgggaccacaagcctgcaccaccatgcccagctaactttttggttttgcctgtttttgaacttgttataagttatcataaattatctttcctttagagttagtttcatttctttttctttctttctttctttctttttttttttttgagttggagtcttaatctgttgcctaggctggagtgcattggcatgatcacggctcactgcaacaaccagctcctgggttcaagtgattctcctgcctcagtctcccgagtagctgggattacaggtgcccatcgccatgcctggctaatttttgtatttttagtagagacaggtttcaccatgttggccaggctagtctcgaactcctgacctcaggtgatctgcccacctcaacctcccaaagtgctgggattacaggcaagagccaccatgcccgacttcactgtgcattctcgctaacaatgtacaagagttccagttgctccacagcctcactgacgctttggattgtcaattgttcctcttcctcctcctccttctcttcctctttttcttcttctttttaaaatttctgtctgctttttaaatgtgattgttccttagggttcccccacttcatatagtctttttttcttggcctgcactctgccttagtgtttttatttacttgcatttttatttatactcatttgtaaatattggttgaacttttacattgtgccatgcattatcaggtgctgaggatacagcaaaagaacaaagcagaaaaatccctgcccttattggaacatatagtctgaaaacttccaagtctgttccacatctctttcctgagctccacacccgtatatctggctgtctactggccatgttcatttgagatgttccatagatatctcagagtcaatatacctaaccctgaattaatcatcttcttcagcctgcccccatgttgtatttttttctcggtgaatgatgtcacattcatccagtagctcaagctaaaaacctaagcaatattatttaatcctcctttccacattttatttactcattaaatgctattgattttccctccagaatatcttatgaatctatccccttctctctacccactctgccacttccctagtccaggctatcaacagatgagtgcaccattctccttacgagcctccctgacacctcctccctatgaatcaccagtcctttctacccaaccaaccaccattggccacactgttccactgttctctttctaaaatgccaaatctgatcctgtctttcccctcttaaaagctctgatagctctgtgttgccctccaggtaattccaaatccttaatattacttgatttctaaacattacctaagacccatagtcattaggttctttcataactctgtagcctctcactctagatattctggaactattttcagctcactgaacatgcctttgcatgcataatttccttttcctgggacattttccccttccttttctcagtactaatgcctagcaaaacctaactatcctcagtaattgttctgctggctagttatgtgttttaatgcatttttgggatagggaaggaaacttgcttatttaaaccggtgtaatttatcttatgacggttctgagctaaagtggtgagaatatggagctggcttgtcagagaacatgacttgttttttcatgcgttagagatgggcccagtagatgggatcagattattcattcaatttattagtacagtagatatttactgagaacttttatgtataagaaactgctgtggggtgctcaaagatgaggggcagtgtcctgcccagaaaggcttctttgggctcacaattgtggtgagaaacagcattgtcacttgcctggagcaatctaagttgatagacatattctgaggttctatgtgatttttttttccattttctttttaaaagaaatgaagtaattaccctctagcagttgctatggcaactgttctacaggagagtttttttttttgcctcccctccccccatggttagaaagtgaaataaattattacaattttaaaatggcacactaagccaacatatcctttctgagaggtgagaagaagagacataggtggtcggaataaagtaagtgcctaggaagaaaattggctgtcagggtatcactaaattaaagtctgtgattgattagtagtcccgtatgcccaggattgaggattagctcaagtactgaaaacagcctgggttggcatcatatgatgttcctagaatttcgagtcttactgtagactttcaagggagtcacacactcagaaccagtttgtgggccttgtggaccccacattgaagattccttagcagaccttgggactgtcagagggtgcaattctaggagttgtgtctttttttctgcttcttatttattaggactctgtaaggcaagcaaaaacctggtaacgtgacaaaataacaacaaatgctagttgctcaccatcttccagggactgtgcctagcattttacatattttttcctgtataatctttacagtaacccagtgacacttgtgttattgttattctcatattacagatgaggaaatatctgtaataactttctcaagatcatatagctagtaaatcgcagagccagaagaactgaatgttgactttaaaacccatattcttggctgagcatggtggctcactcctgtaatcccagcactttgggaggctgaggcgggtggatcactggaggttaggagttcgaggccagcctggccaacatggtgaaaccctgtctctactgaaaatacaaaaattagccaggcgtgttggtaggcgcctgtaatcccagcttcttgggagcctgaggcatgagaatcacttgaacctggggacagaggttgcagtgagccgagatcgtgtcaccgcactccaacctgggtgacagagtgagactctgtctcaaaaaataaaaaacccatattcttaattatgaagctatttacttcttgtttcttgagattaaaggcctatttttaatgatttctttatcacaattagtttcttgaaattcaatttgggtgtgggataggacttaattaatagtggatttttgattttgaaaaatgaataaaaaatattttcaattttctcctgtccttcaaagcttctgtgttttagtggattttattaaaaatttataggtaattcagaagaagtggctctctttaaggacccaataggctagagtggtttattacatattgttttaagcccctttctgatctaggtctctctcagaacaccatcatttaggagctcatatgtctttcctttgtcaaaataagaaaaattagatctctgtctctaaaaaacccttccttgtctctgcgttcaccaaacctgagcctatcacaataaatctatgagaagctaagccctgataccatgggtaagggagtctgggagcttacttagaagattaatttcttaagagataaacattgccattctttgaccttttaactttcagtagagaacagcaaaattgactatcttcgctcccagacaagggaattactcccttacccatggtatcagggcttagcttctcatagatttattgtgatgggctcaggtttggtgaacacagagataaggaagggtttcttagagacagagatctaatttttcttattttgacaaaggaaagacatgagctcctaaatgatggtgttctgagagagacctagaccagaagggggcttaaaacaatatggaagaagtaattttttgttgttgttgttctgtgggttttttgggttgttgttagtctctctctatagtgaaaggcagagaacaagaatactttgtagatttgtctcacatttggtagaaggcagaaactctatgttatgtaaagttagtagaatacaagtgaggtaggcttaagtaaggtaaggcacataataattgctgagatggggaaatgacttttgaattccttcaaaaaagtattttcaaaaattatctgctgcttctttgtggttttcttaggtcactggacctatttgggctggggagaacaacagagtacgtaagaattgaaattccttatcattttcttgatcttacccacaaagtacatactccctctgaactgtgaagctggatattcatgcatagacttccatttccctctcctctcctacttaaatatcgggagacaatgacctgtggtggaatgttatatcctttcaggctggtttcttgacgactttgtgtgtgtttatgtgtgttacaaatttcaaaccaaagtcccagtcataatcctgacaagatctcctaatttttattccccagaggcaagtagtagcatcagccccctagtgtggccttctcctttggtccctttggctaaggagtgcagtgaccagaaggagaaggttcattctaggatgaactagagtcaaggtgattggtgtgcattctgatttggctgattttcttgactaggaggatatgcagaacagactgctgtcttgggtttattggtctagcaaattgtgaatgccatttcagccaaaaacctgcttttgttaaggaaacaagaggctgaggacatggcttggctttccctgaagcagcccagctaaggccacctttgttctagagcttagagagtgggcagccagttctttgtggcaaaacatgtagccctaggctgacattactggttgtgttacccatcttacaggatctggttgagtctcagtgattaggtatccagtaggtactaagacgggccaaagtttgtcctgtcactggaatttctcatgaagtctgtgctttctgtgatttgaatcctgagtacttctgctattaggaaagtactcaaaagcagcttgacccatttatgcctagtgttccattattggaactctaagcatgtgggagttatttatatcctactgctcaaggtcatcgccaagcagtaggtgacctcaagcataaattgcaacctcaggcataaatgggttaacagagctcaggtaagttaaggttttcaagtagaaaaagcaactaagccatgaaaaaaatgtgaatgaattttctttcctttctttggttgctgaagttctattaataggtgtgctgtggatttaaagaccaatccaagactcaatccaggaataccacatactagagggcctcatttttctgtatttcactggattttgtttgagtgcctgctgtgtgcttggaggcccatctttgtttgccccaggttagatgaccttcccagcctacttttgcaggtttttaattttccataatttcctctatgtctttttatttacctatcaaatgaactacaaaatggtttctcaaaaatatatagcctttcctaccactgggcctttcatcatgccactgcttttatccaaattctagaagatatttcccttctgcctccaatcttcacctattaaaaatgaaccaattcttcaaagccatctcctccttaaagcttccttagttaccctatcaggaagtgattttacttttaattcatagcacttggtttgtactaactgccttgcatagcaattcaatatttgtgtctatatattctgtctcctattagactgactctatattctgagtcttctgtgttgtttagctttggatatgtaggcagtcagtgaatatttgagtgagtaggtgttcccagccttttaattttccatctttcaaatagactttaccaggggcttttcaactgttaccctcaaactggctctctagttccttcttaggctgagccaaccaaacctgcactcagtttctctctgcaaagccagggcttttctcgtctagccgacatggtgctgtgggatagattatggaggcagtaagagatcgtcagtgacacattaaaaacacagttatttaattcaaattgaagtgttacatattttcctgaatttccctttttagtttctaatcaggcttggtgccaggaggtttactttttaggaaaactggaggtgattgcctctcactacttttttctgtttctctcctttgtctcactttattccttagtatattctctctcttgccctctcctgcttttcatattctcttctactcccaacctcttctttccatggatgctttgtttcttaatatttgccctttatttctttagtgtagaaatgttgttagcctttagtaaagttgtagagtatctctgtttagcctagcaaaataaacaaaaagcagactattatttaggagtaataggtcacatgcagggagaaagtaaaacctgtggatttgggttgtgggcttctaactctggctgagctgccctctctggcctcaaaagtgataggattgtctgtcgcagttgcctccttggagactgaatcttgtttctctgggttatgtgctaatacttttcctgccagagtttagtagacctctggttttgtctcctttgttgcctctgccccttcatctgtatgcatgaatagtccagcactgacttctacagacttgctctttctgtgggttcagaaagaattaagtctgagtggcatatggttttgtctctgggtcctatttttcttgtcttcagaacaacagatgcatcaagggctaaaaacagtgcttccaaagtctctttttcttaatatatcatcagaatgctttgtaagcagaatgctttgcatccctcttgtttgcttttgttttcaagctttgctactcctgccctggtcagtggactacttgctccaaatgtcaagtattaactaatacttgttcctgaccatttgaacattagcttctttctcatgttgatatttttcctcccggagttctaatccctctcctctccttttttatgttcacatgtaaccataaactcaaataggaaaagctcataagatcatcttacccctgtctcccatctgtacccacaaatgttattgagagtccaatgctcagattttcttccttacctataaaacccacatgtttgtgctctcttttagtggaattcttatctaccaacttgtctaatgaagccaaggggggtcatttccctattatcttcaatatggccccatgttttacaattctgtctggaattttctttttctagttcattaactcttttctgtttccgctgtatagatgcaggtccttatctcctgcctgagcaattgtaaaagcctaatcttacggtcttcaggaggtttccactgcccacattgctacaagattatctttttttttttttgagacggagccttgctctgtcgcccaggctggaatgcaatggcatgatcttagctcactgcaacttccaccctctgggttcaagcgattcttccgcctaagcctccctagtagctaggattacaggcatctgccatcatgcccggctaatttttgtatttttatagagatggggttccaccatgttggccaggctggtcttgaactcctgacctcaggtgatccacctgccttggactcccaaagtgctgggattacaggtgggagccaccgcgcctggccccaagataatcttttaaaattactaacatgagttcattttgtgctaaaagtatctccattttgggatggtgaacattccttttcctcattgtaagccaaataggaacttgtcaagaaaggacacgtggaaccctgttaatcatacacataagggtatggtgtcagatacgacttcctctctgtaaaacaggcttcaaagcactcttaggttgagctccctttccaagcacagcgatgatttgtaagtgtggtctttttagttaactttaacaaaaaaactgtagccagtcaggtgctggtctgaaggacaaataattctacgaaattgtagtcactgctgttggataaacttggctgcattgtcagcaagatcccattggcagtgcataagttttttcttctctcagcccatcctctggatgggaattctgagcctagggtgtaggtgcttgacaggaattgttaggaaaagctaacactgcagcagcacagtaagagtgctgctgttctcagctgcatctagagcctttgacttgatttccaggccttggctttgaccttcctgatttccaggaccagcttctgatgttagacctgcttatttggttcaatccatatgtttaaaagtctgaaaacaccaagacaacgttaaataaaagttttggggtttttttccccaagatatgaaaaagctaacttttttaaacctctgctcctttcccctttctttaataacaggggaccagactgtatttgtgacatttaaaagcagtttttaattatggttatgatagttggagaagcagaattccaaagaattctacagtgggaaaatgcaacctagagctcctctaagaataagcactaaaattaaactaagtatatatctcatatgataaggaagagaaacttgtgggtattaattgagacagttctgctcatggctctgaggtcgtcactgggctcatgtgaagctcagcttgcttttgttctcaaggtccagacttgttactactaagttagaagcagaaataattctgaagaactaaataaagctggggtgctttgattgaatgtgcttattccatagcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcaggtgggtattgagcacaaagtactttctcttcctaatatccaggtctcatgatgcaactggcaagaagaatttggatgctttaacctgaagaggtagcgtaagtgtagcagtatcaccggccaaactacagtcattttgtgtagattattagtcttttttttcttccacatgtttatacattgccataaggaattttatgtttatatattgccataaggaatacttctcttcatgatcagtgattctcaactgatcagggcgatcccacttggggtgtatctgccccacttcctgactcagtgagtttgttataccctttgccaagattaaaaacagaaaaaatcacagattggatagtccttcttgcctaaatatttccctgggaactttagaagaaaaccagtatgatttcttatagcagattcagtatttttactggaactttgttttaatttattttatttcttaaatatataaaacaattatgtggttaaaaaatgtcaatacagcataaagagtttcccacccacacttaccttcctccaccccatcttcttcctgtttcataattcccttcctactgttgtttcttatgtatccttccatagactgttgtcatatatttatgagtataaaagcaagtacatacatatgtgctctcccctgccctaagattaaaaaaaatttcagacttaaagaaaatttggagacataattcaatgaaaacccatattcatgttgcctagatttaccagttgtgttaacattttaccacatttactttatctcattctccctaatatgtattcatatacacatacattttctctgaaccacttaaaaataagttgcagatattgtgttacttcatcagaaagtatttcagcatgttactcctaagaaaaagaactttatcttatataacctcaatatcatgatcacactcaagaagtttaatgatgcaatgttattacctaatgtttagaccatatttaaatttctccagttatctccataatgttctgtatgtatatttgttcctttctggtccaggatccaatccagaaccgtgatgcattgcatttggttttcatgtttccttagcttcctttaatttagcaaaaatttcattaccttggttttttggtcttttaagaagcttttttttttttttttgagacagagtctcactctgtctcccaggctggagtgcagtggcgtgatctcggctcactacaacctcagcatccccggttcaagtgattctcgtgcctcagcctccggagtagctgagactacaggtgcacgccaccatgcccggctaatttttgtatttttggtagagacggggtttcatcatgttggtcaagctggtctccatctcctggcctcaaacgatacgccttcctctgcttcccaaatggaattacaggcgtgagccaccgtgcctggcctaagacacattttttttttgaagagtgcaggccagttgttttgagaatgcctcttcgtttggttttgtctgattatttcttcatgtttagaatcaggttaaacgtttttggcaaaaatgctggatgtttccttcacatgcattcaggaagcacatactttgtcttttttttttttttttttttgagacggagtctcgctctttcgcccaggccggactgcagtggcgctatctcggctcacggcaagctccgcctcccgggttcacgccattctcctgcctcagcctcccgagtagctgggattacaggcacccgccaccgtgcccggctaattttttgtatttttagtagagacggggtttcactgtgttagccaggatggtctcgatctcctgacctcgtgattcacccacctcggcctcccaaagtgctgggattacaggcgtgagccaccgcgcccggcccctactttgtcttattattggtgatgtttagtttgatctcatggttaaaaaatttggtatatgccgtatttctccagtgtaaagtttcctcttctcctttgtaattaataatatctggagtgatacctgagactgtatcaatactctgtttccccaatagtcttttactcaatgatattagcatccattgatccgtgcctgaatcaattattttattgattggaggttagttttcaagaaatcattccaatttagcttatccttttagtttctaaaattcactagactggctaggtgcagtgactgatgcctataatcccagcactttgggaggccaaggcgggaggatcactggagtccaagagcttgagaccagcctgagaaatatagtgaaacctcatctctacaaaaaataaacaaaattagctggatgtggtggcgcatgcctatggtcctagctacttgggaggctgagttgggagagattgcttgagtctgggaggtcgaagctatagtatgccaagattgcaccactgcactccagcctggatgacagagcaagactctgtctcagtcaatcaatacaaaattcaccagaccataggatgatgtccttttcttgcccacctcaccaaactgctacatggtgagtttagacacagggtcttgcgttgttgctcaggccggtcttgaattcctgggttcaagtgatcctcctgccttggcctccgaaagtgcttggattacaggtgagagccactgcacctggccttctggaagatttttagtgactaagtgtctgctttgatcttgcttctgtttcctaaatgaatgcttttggatgttatatctataaagaacacactgaactcataagctcctagcctttaggttctttctccatccctaccttggtacacagaagaaggcagtctttaatctaagtgaaagaaagttcaggctatcttcagtattcattgttttaaggtgggcatgtagcttctgctgctataatcagtatagggaaagattttcttttcactgtgatcctcaatgcatatagcctttagatttcacaaacaacaaattataatgccttaggctgggcatggtggctcatgcctgtaattccagtagtttgggaggctgagggcgggtggatcacctgaggtcaggagttcaagaccagcctggccaacatggtgaaaacccacctctactaaaaatacaaaaattagctgggcctagtcgtgggtgcctgtagacccagctactcgggaggctgaggcaggagaattgcttgaacccaggaggcggacattgcaatgagctgagaatgtgccattgcactccagcctgggcaacaagagcaaaactccgtctcaaaaaaaaattataaggccttaaataatttgttatttttttgtagtataacaaagtttgacttctgctgatagtaaaaaatggttttatatgtatttttttcttattaaaagaaatatgtttgactatattcttggctacacatcctcaaatataactttcagaaagttaacagcttggcttctttttagactaaaaatttatcagcaaatttcgttttcttgaaatcccttgatatattttgctggtatactttaatattgcaaatacattctagatattggtacaacatgtttcatttttttcatttgtttcttagaaaaataaaagaattctaaaaagctcaccaatgaaaaatgattgcaagttgaagcatttaaaaattgatattatagctgttctttttctcatatggaataaactatttgactacattgatataatatttaagaacatgtggatttccttttcatatttttttagtctgaatgctttttatcacattggcaattttattgttctagtcttctcattgaacatgtattaaatcttataacttctttcttccttttccctgtctcttcctttttctttgctttattgttcctccaattttatcccttcacatcagacaaggctcacaggctaaagatgaaaaaattaggattatttcagctttctctgatgttgactatgaagagcaagaagatatacataaggagatagaggggaaaatatcacaagagtttctagaaaataataacataaacttgaaggaagcagagataaaagaaattagaaccctttcaaaagctgataaatactacagccaacaaaaacaaccaaagtataagaacaggaaaaagataccacctcagagccaacaaacagaattctctactgagtttaaggttgaaacttctgttttctccaggtatgctcagaaatatgatacactagatagaagaagaaaaaagaaatccttatacaatcattttgaagacagtgaaagaaggcaatatggtgagagatctgaaactaagactaactacaaaagtacatattctaatactgaaaattgtaccctttgccatactgaaaagaaacaaaatatggggtacccagttttgtacccctacaaaaatggatttgtggttaagagtggcatgcagcgcattaagttggaaagtcatgattatgatctgtccagttgtttaaggcactgtgaaaagtcatctggctcaaaccagcatgtcactaattttacctcattagatattcttgaagattctactagtagtacttctgatgaacttctgggttcccccatttctgataagcaggaaaatttacagtcaccaacatggcattcatccaatgtccaccatattggagattttcctgaggaatattatgtagcaaattcagcattgccattacaaaggatgaattgtgatgcaaaaacacttggagatctgtctgagtgctctatagaagagataaccccttcctctattgaggagcccaaggaggaccgtattgatacaatggatgagcttcagtgtttggtagaaacggtgtcagaatatttagcagagaaggaagaggagattaatagatttggttcactttcaaaaactaaaaaatcacataaacaaaatagtactcttgatgcagaacagagaacgcctggggatcaaataccacctttaactattgtcaagaatgacaaggacacggccatctctttccctgagttgactggagtacaatgtgctgttggttctttgtttagttcactcacagaaaaagtgggttcaggcacaaagcatctaacaaactctgtggaaaagttggtttccttagttccagaaaaaacagaaactcttaatcaaatagaggcaattaatttgggatctaaacccagagccatggcagtattggggaaggatctttccatgcaatctccattatcctctcaaaaagatgataatgtgaatatagacagacatagaaaaacctctgaaaatgagcacatgggtaataaaactgggagtttatactttcagaatacaacagaaagtattgcaaaggacttggctccacagagtcagagttcagttataaagtcggttttcagcaggttaaatccattgaagatcttttcagaaaaggaggaaacaaaaaaagatgatgaccagagtaagccaccaagaaaagaaagctttgttgagtgtggtttggagttaaataaaagggaaggcactcttgacaattacagtagtagcatcattgctttaaatgggagtgatgaagaaactacgggctggttccagatgcccacaagtgagaatttgttgtcctcccaagtaaccagtgaaccttcaaacttagttagttctgcaagtaaaaatgatgagagtctattggaagaaaaactctgtatagatctgtctcttttaccagatcaacaaaaaatatgtgccaaagatactccaggacatccttgtatagctggcagtagaactgcaaataaagaggtattttcaaagccattagaggaggacaaagttacaggtaatgatgatttccttgagccactcagaaaatcatttagccagtttttgctcacttcccctgagacttgttcaaaggaaagtttgtcagaacctgtgaaaattcgccaggtggaggaagatggtttagaaaggggctctaagaaagatggtcattccttttcctttagtggaaaactaaatcttccattttttagaagtcttggtcattctgaaaagcaacaggagttaaaagagaaaggaagcatttttcctttgtttaaattttctttcactgacagcaaggttactgttaatgaccagagtttacgtggctcagcagtaaccactgatgaggagagcaaaaaaaattgccatgaagataccaaacatagttcaataaaatctagttctgttccaaatattcatagtgatctaggaaaatttgacagtacagaggaatttaaaaagaatgaccagataaattgtcctgaagatgccaaacttaattcaataaaatctagttcagttccaaatattcatgatgatctagagaagtttgacagtataaaggaatttaataagaatgaccaagtaaattgtcctgaagatgccaaacttagttcaataaaatctggttcagctccaaatactcaggataatctagggaaatttgacagtacagaggaatttaatcagaatgaccaaataaatagtcctgaagatgccaaatttaatataataaagtctgattcagttacaaatattaataatgatctggggaaatttgggaatatagaggaattaaatccaagtgaccacacagcaggacagaattttgaaagggatggcttagccatccctggagttgtgcccaaagaacatataacttcagatcctttaggagaagataagaatcttatacaagcagcatcttcagtagcatcagactcttcattagagtgtatttctaccacttccaaatccactttggttaatgaaattaatgaagatgaggttatagataagacttccaagaaaaatacccaaggaagcttcctttctggcctgtttaataggttttcttctgctgaaaatttgtctagtcaagaattaaatttgaaaaatgatgactcccatcacaagaataataccccaggtttaatctctggaatatttaacctgctatcaaatagcggtatgattgatcataaaccagaggaagcaaagttcatgtctttaggcaacatgaagagtttgaatggagataaccatttatccttggatgaggtccctgctacttcatgtgtgacttctgagaacccgaagaaccatgttgaaaaacatgaaacttctagcttcatagaagcctccttattacctaaagaaaacataccattatctgatgctggggatgataatcattattgttcccctacagagaaaaaccagcaaagtgaaaagcatcacccctcctctgagaacattgtacttcactgtgctccaagtgctcagctaggttttttggagaaatctatggctaagaggcaaatgccaaaccatgttcttgaggcaaaactacatgaaaattcaaacaagttaaattcacctgtactaaataccaacattctcaataaatcaaacaactatcaggcttttgaagagatgaacagtcctttctgttttgaatgggactctgacataaaagatttgtctaaaaattccagaaaacttcagccagtttattatatgttaaatcaaaatagatttctatcagccgatgcttgcttgtggcttgactcagaaaactcagtgataaatttttgccaaaaagatcaaaatgcaaacatcttggagtggagaacaaatccaaacagtgtcatttggtgtgacttaccatatgaatcattcaatcagttagcatttaatgaagattacttattaagaggtgatgtgtgggcagctaactcattatatggaaactctggtcctcttccaattaatgaggctaataattcactagaagaattacccattgacttaagttcttcatcagatcatgaaaagactacatgccccgtagttgatcaagaatcattaagaatggatgaaaactttgttttttcaagttttggttatgagtaccaggaatggttgtcatgtcttgaacatggagtgtggtggccatcagaggatggggattatggatattatatgtttcatgatggtcaatatatctattctcttctcactgattctactgggcagtatgcatatttatttatacctgattcttatcaagagtatttggattgtgatttacagacaaatggtctatcaagtattacgttggatgacagcattatttctgcctgtagttttaaagtacttgataaggaagatgaaatattttggtatgttgaagaggaaccaattgatgaccctcttgatttatctttagctttgccaagaagtgaggaaccattgtatctaaatttagaaaccttttcacaagtacttaaagagtcaagttgtgaccaaagcgatcagccactagatttttcaggctataatcgtcaaaagtttaaaggagactttagatctttcaaagaaaggccgtgtggttctgaagacgctgaatgtacattagatctcagaaatcagccccaaactattagtaatcatgtctcaagcagagatcaaattatagagagagataaaaaccagcctctagctgaagattcatcagttcacctttccagtttccattggcttcagtcttctgttgaagaagttaccactttggttcatcctgaaaatatgactaaaggctcacaacaagcagaagagacatcattagtgaacaaagtggcttcagtattttctgttttgggtgcctcagttggaagtactttgaagtttgataagagtgaatccttagaggctttggccatgcagaaagtgaatcagcagtcagatttagcagagctcacaaatgatggctttcagtcattaatcatgagtaagcaattagagggtaactccccaaatgtggaaaaaagtcttcttaaggattcagaaagacagatagtatccaatgttcagcatccagaattgatcaaaaatataaggcaagaattctctttaaataaaaacaaccatgtgaaaaagcaaagtttgttaaaatctggtttccaggtaagccaaacaactcctcaggctaaatcaggtgtaaaagatgatgaaatcattacaacagactctatttcagtttctcctgcacctcagcatagtggggatgagcgtgagaattatgagcttccccagggccagtcatccaaagagtctgataaaacattatttaaaagttcattgaaactcttcagtcaagaagaatcgtcagttagtatgacagcaaatgaaaaacagtcatctggatttttgaatctttttaagactcaggtgaataaagaaggatcaccaaacttagaaaagattggtgatacaaatgtcaagataccacctcaagaaaagaaagaatcttctggtgtttcaaatttttggggtacccttggggatttctttaaagccaatgtatctcctatacagacaactgaaaatacgtctgtttcttcaatgactattaaggatgaggtcaggtcaagtcctactcctatggagctagctagccagggtgctgggaactttcctgctgcaccaatttcctctaaagggaaggctagagttagaagactgaacaaacagactactatcgatgacagtaggttagaggaatcaactagagggatccagggtaatgatttgactgaaaaagaggtaccattcagagaccatctaatccagcagtcacctaattcatctttttcaacaagtagtctcaaagagtcttccagggagtcttcagtagaaactagtggtgtgactacagtgacagaagtttcaaaaagtaatgaaatatcctttgataccctgagcaagagaaattcaaatgaacaagatcatttttctgacaaagactggagtttctctatggctgcaacatcttcatctcaaccagagttatcaaccaaaaagagtatattttcttttctcactggatctgaaaaatctgagaacagagcctctgctactctaccaagagccaaatctcaggcagaagggctattcacacttccttcatttttttccactgctagctcaagcattaagaaggatgcctctcatagtagttctacttttagtttcttcagcttgtcctttttggatcaaaaaaaggagacctctggggaaaaacaaagcatttcaactgttgttccagtgacctcccagccctgtaagaagacaaatgtttttgtagagagtggtagcacaatgaccagagaaagttccagtggtcatagagatagcatagcccaagaagtagttcatgaacagcaaatggcaccttgtatttccattaacaacaccattgaggttacctcccttgcagatgagctcagtgtagacaaggactgtcaggaaaaactgagttccaatattgtaccagggacatcagtggatttccagatgaatgaattgcaaaaagacattattcctccttcaccagaatttcaggcacaggctgaaacattcctcactggcccagagaaccttgggatagctccccatgaagaagaggctttcaaccacaaagccttccccagtgactcactgtccaactctttttcacatgctaaacagttaattgaaaaattcaatgatttagacacttgtactaactgccaccaaaatgagaaatttactactgacccagtgaacttgccattagaaaaggcccccgatgaggtcttaccacagatcctagagccagcctcttcctctccagagccagggtgtgcagggaaccttcagaaccaagatgcagataaagaggaagacaaatttgcattaggctcttcagtagacatgctttcagggtttgtgaccaaagtgaaatctttctctgggagcttaattgaacctcccaaaacactctctggacttttctcctctcctaaatctccaaagaaaaactcctttttctctcttgcttctgatgtatcatctcagcccctcaaaggtgaattatttggaattttcaaaagtcccaagccagagccatacaaacaagaatcatctctcccagctacttcatggcttcaaaatggttgttccagagatgctgtaggatcagtacctccagaaaggagagaagctgcctttacagcactaagttcagaatctactctcagtgactgtagaatgactgtggttagtgcaaagccagaatcagatatcttgacagatgatcctaaactaacaaccaaaatggaagacaataatactcctgaaaatattctggaacctcaacgttctgaaacaattaatacatcttctttctcgggtgatgatactgggcaaggagtattgtctctgagtgatgaaggagacatggggatattgcaagctacagacacggaggcatcgttagaagcagagaactttgcgctgccagcacagttgcatccagatcctacctgcattgccgaagagcttcctcctccaattcagccacctcttcctcttgagccagagccagctattcaaactgcctccacaaaccaagacttactggagctgcatccagccagttcactagaaactgatactatgctgttcaatgatgcaagtgtgagccagagcaccactctggaaaccgaagggcacttttctcatcctctgctggaggaccctgtgcttgctgccagagaaagttgtgagataattcatgcccagaaagatccacctgtagtaccccaggaaacagagcagtcaagaccacgttttgagatcccaaatgtgaccacttggccaaagcttcgtttgccatcctctgctactaaccatgggaaaccactgagctctttcttttcctcacctctcccctctggcaatagagcagcagagactggtttaatgtccagttttaagaagttgtcaactctatttgagggaagtagtgaggggaaagggagtgtattagcaagtgattcaaaactaggatttggaaaggtagatctttcatttccatggccaaaagagaacaaaggggtccctgaacaaatgcctacagaatcctcccctccagttttagttactagcagtgatcaggaccttaactccagtgaggctaacaaagctttgaagtcttctcaaatatctggggccagtgctcagccaggtaaagtctacactcagccctctgggacctctgagcagctggtggccagtccagaggtctgtgctcaggggctttcagggtctggagaagggggaaaccagcaggaaatctcagcatctggagaacactgggataccaaagccaacctgtctagccccgcctgtccttcagggaaacatgaggaagaaccctccactgtctctgagatatttcaccagctagaaaaacaagaagaggaggcagtacctgccagtactgactctgatttgaatgtacagcagccagtcactctgaatgacatcaaggagcccatgaccaacaaaaggcctgttcttaactcaagcatcataaatggctttaaggaattgaccatttatgatgcaagtgacttagtggtagattaatcatagcttgctttttatccttcttgtgtctttcctagtacccgagcttcatgttaattaggggttaaataacaagaactcagtgtgtgggtattttcatcctccccttctctctctgccaaatgtaattcatttactggaacaaggagcttcctgcttaaagcaaaagctgggcccccgatatttactcactctggtttgctctgccttgtataatgtgaaatggagaaaggagggcaggaagaggtagtaagtagttggtggtatatattaactacaactacatgataggctaggatgcttccttgggccttaggcacttatatcttgtaggagatggggatagatctattttgctttgttttttcaagtcttctaagatgctttctccagtggcaatgagtgtattaagcaaaatacaaagtgcaaaggatgccttgggatagtctgtattcccatatcctattccatacagatttgcatagtttcttccatggtatcatctctgccttttactaccctcaaggctgatgtctgataaatgctttgagtaaaatctcacaggaactcagagctgtcctttgctgtagttcttcagtctcgagcagtgtacaggatctatctgcagagggtactgttatttcccctaagaagcagtaccatacagtacagattaagaatgctaccttgacctctggcccaaacttgttcaaaggggttggtcagggtcagtgtgtgtgtgtgtgtgtgtgtgtgtgtgtgtgtgtgtatacttatgtacaagtatatgtgtttgtgtgttgaactactcagaacagtgacctggtacctattctgctggcatgggctagaggatcagaaatcagcctgaaaataccaggtaattaggaggaactttagggaaaatcccattggaaaataacagtgatttctcttctttgaccaagggtaaacacaagccctttagttaaaggcttgactctgtggtaagaaaattcttcaaaagaactgaagcccttagatgacagggccataaaactcaaggaagtaacttctagatactgctcttctttccaccactctgcccttcttgccactgtcacattctctgctataactgctttctctcatgactttctggatatgggaatacaggtgattgagaaaagattggcttgctggtcttcagatatagagatgcatgaatacggctctgacccagatcctggagttggactttgtccactctttccaaaactgagccttgccctgaaagaagctcagttacagatgttcatctttgggacgcttcctatgctgccagggatatcattgtagcatttatgttgatgagaccattcgtttgtgtattctcttggtcctggcctctatcttccaatgggttctattaactcatcttgcagatgaggaaactgagatgataactgaaagaacatgtctgctctcctttgctcatcctaaggtacaggcgtacacatttacaattgtagaggaagaaatgatgacctcaatgtaataagtaatagaaaaagagtggagttcattcattccattttactgtgtggaaattaaagaaagattaatcacagccactggacaagcttctttagaagactgaataaagaattttaggaataagtaacaggccattttaataatttttaatcctactcacaaatagcctattaagataaaatatacttcaaagtcaagtgcagaactgaggttaagtgtcgttggagaacccagcatgttgtgttgttttcctgttgtgttttcgctgaatagagactaattcttctagattatgaagtttggtcctctcttcccaggaacctcctatttgattcttgctactaatgtagtcattatttcctggatgtctcctttcttttgtcctggtccctgattgcatttatttacttatctgtctttctgtcattctcacagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagaggtaggcaacagctgccttgaggagctcacatggcttcctcagtacctgccctgtggtattgctgaaaataagtgattgtcatttgtttccctgcagctgggtatggtggtagttaacacctccaggctcaactctgtattgcttcctttgatttatggtgcactttccaagacattttggagatctctgaagaatatttgggtttttgtttgtttgcttttgagatagggtctcactctgttgtccaggctggcacgatcttggctcactgcagcctcaacagcctggtctcaagcaattctcccacctcagcttcctgagtagctgggactactaggtgtgcaccaccacacctggctaattgtatgtttatagagacaaggtttcaccatgttgcccaggctggtcttgaactcctgagctcaagcaatccacctgcctcagactcccaaagtgctgggattacagcggtgtgccactgcacccagccagcacttgggttctttgtagttagtgagctgcagtgtaccagggcttcttgagtctgcagttcatagcttactagttgaccttgtatatggcagcctctgagtcaggaactgacttgagccaggttatttcatccactggggctgtggtaggtactttggctgacttcctaacctattaagaatgctactttgacctctggcccaaacttgttcaaaggggttggtcagggtcagtgtgtgtgcatgtacttatgtacaggtatatgtgtatgtgtgttgaagtactcagaacagtgacctggtacctattctgctggtatgggctagaggatcagaaatcagcctgaaaataccaggcaattaggaggaacttagggaaaatcccattggaaaataacagtgatttctgttgtaacttttttggtgaacattttgttttgtttttccctggctgagaaacccaggacagagttaagaaagaattgatctagaagtcagatttaacccacccctcagcctcctcagggcctagcaatgtgtctgccaattggtatccataggaagaaaaatttaaaatgtatcctctttaacatctcataatgaagctgagtacagagtctgaatgttattactgagctaaatcggttagactagctgataggttggagcagagccagagttctcagtctcggcactcgtgacattttgggccagattattctttgttgtgtatattataggatgtttaatagcatcactggcctctacacactagatgccagtagcaatccttgcaaccctcagttgtgacaattaaaactgtctcctgacagatttcccctggcggggacagttgcccactggggtagagtgataagggatgggtgtgacttagagtttcaaatttcaagatctaataataaagcctctcactgaaacaccagagcactgaatgcagattacatggtaaaaattagggagtgactggtgcttctactttaccactggattaatagatgagtcgcaaacctttctgaagatattaacttattttctctcttcttcccttttttggtttttggtcatctctggtagctcatctaatagatgggacatccaggaggtgagctgtggaccaggcttcttattgggttgatgactcactgaaaaactgactctggctctccatagaccttagacttggcagtcactgttatcagggcagagttcctggtggagaagcagaagtgcccagcacaagtccttgtccttctctactggttgtgtcctctcaggtcctagctgtgagagtgaaacccagttctaccttggccagaagtgcccacaaatgttttacaacagttgacacatttagttggcatcagaaacgaccatatattttaacatgtctagatggtggacacttgtctgctgaattggctgtagacctcaaagagagaaaggagaaacattgttgccaagaattaaccactattctagttaataatgtggataatgagttgttctaatgcagggtagtgtttctgtctcaaaggtattttgttatgtgtattgttcattttactgaggttgttctagaagcagctcaaggaaccagatcatggcagtaaaagggctgtgtgttttttttcttttctttcttggcacttttcatgtaaaaaggaatgggtaagccttctaaaatacttagtggagcaggaagggtttgcaggaacaaaattctgccctaaggatgctatgcaaaagccccaagggaactgatcgttttaagaagtgcagtgagaggggttgaaaggcttattccacccctctctgcatggtttctatactacgtattgactcagggctctcgccattgcctctagagtcctgatcccagactgttccagggagctaccacattgggtaaatgacaaaaacgagtaggaaaagagggaacagatgaaaagctaaaaggaattgtcattttagagatgaattattttcacattgagtattcagtactatgctgctcattgggtaaatgaaaaagaaggaaaagaaggaacagatgaggcgcagtggctcacgcctgtaatcccagcactttgggaggccgaggtgagcagattgcttgtgctcaggagttcaagacaagcctgggcaacatggcgaaacatcgtctctacaaaaagtacagaaattagctgggtgtggtggcacgcacctgtagtcccagctatttggaaggctgaggtgggaggattgcctgagcccaggagattaaggctgcagtgagccgtgatcatgccacagcacttcagccgaggcaacagggtgagaccctgtctcaaaataaataaataaataaataaataaataaataaataaataaataaataaataaaagagggaacagatgagaagctaaaaggagttatcgttttagagaggaattgttttcacattggatattcaagtactatgctgttttagtagcctgaatcactaaataagtgtaggcatgagtacaaaccattttattttagacatttggcagtcttgccttgagcagtgtcaccttgtggccttggctatttttaagaaatgtactttttctctgttacaagttttcctgaggagaatgcatcttcaccatttacccaagccagagcacattggatccgagcagttaccaaggttcgactccagctgcaggaggtaggaaatctgttctagtactggttgggacaatttttcctttgaaattgggagacatatggtgctggagaagcaatcagtgattagtcatcttcttacagtgtgcttctgggaatgcatgacaattaagccagagctttaagggatgggaagtggccagtggctttcttctgtgctgattaatggaaatcaaatagacctagtgggctgagagcctgactgtaaagttagatgcttattttcaagtactgttcattgtctctttgaagccgtttgagtttagggcgagtttagggcaagaaatgatttcaagcccctgaggatagttgtctcccttacctagccggtccatactggctcatctgtagggccaaaacagggtacaaaaatatctatggaatttgccagtttaagtcccaaagtatcagcacactaagatctgaaacaacgtcaaaaaaatgtaaaaacaaagataaatatttttcattttcagtgttacaagtttgaagtgtctttatctgtgtgttaggaggtaggcagtctttaggcagaaggtacttttttttccatataaatttaggaggtacccgtgcagttttgatacatggatatgttgcatagtggtgaagtctgggctttgggtgtagccatcatctgaatagtgtacattatacccattaagttatttctctttccttacccgcttccacccttctaagtctccagtgtctattattccacactctaaatccatgcgtacacattatttagctcccacttataagtgagaccatgcagtatcccatggtgtgtatatatatatatatacaccacatttttaaaagccaaacatctgttgatggacacttaggttgattccgtatcctttttttttttttttttttttttttttgagttcaggtcttgctcctttgcccagctggagtgcagtggtgtgatcattgcagctttgaactcctaggctcaagcaatcctcctacctgtgcctctttagtagcagggtctacaggcatgcaccaccatgcctggctaatttaaaaaaaattttttttttttttttttgtagatgcagggtcttgctgtattgcccaggctggtcttgaactcctggcctgaagtgatcctcccactttggccttccaaagtgctgagagtacaggtgtgagccactatactcagcccataatatttttgctactgtgaatagtgctgcaataaacatatgggtgcaggtatctttttgatataatgatttattgaagttacatgtttaatgacaattggctgtcagtagtataatatctggcagatattaaaagcacaatcatgctcacatatgtgcacatatactttaaaaattaatttattttgaagcaatttcaaacttaaggaaaagttgcaaaaacagtaaagaactactatgtctcctcacccagatgctccaactattcacatttcacatttacttcattgccttccctccattatgatcaatctttttctgaatcatttgagagaaaattggagacatgatattctgtcattcctaaatcttcctttgtatttccctataaacaaggctacagttctgtataaccatgatataaccattcaaatctgccaaacaacaataacaacactattatcaagaccctatccatattttgccaaccatcccaacaatgtctctttttcctttctaatccagaatccaatccagaatgacatgttgcatttagtcgtgatatctctttagcttcgttcggtgtttcccatccttagcagttttaaatggtataggcttttcattttgtagcatgttcttcagtttgggtccattcagtgtttcctcatgtccggactgaggccatcctttcatggcaggaattacacaaaaaaaatgatgctgtgctcttttcagagcattgcgtcagaaagtacctgatgtcaacatgtcctaccatttataatgtcagccttgatgacttggttaagtttgcattggccaggtttctccactgtcaaggtaccatttcttccctctgtaattgttaagtgccttgtggtgcagtactctgaggatatgctggtattttgttccttatcaaatctctacctaccagctaagtagccgtctcctatctgaatctaccaccactaatgatggttgccaattggtaactttctgtttctattattctttctatattaattaattagttggcactctatttttaggaagagatttcccttttctctcattaatttatttatgtcaatattgcattatgactcttacatttctaatttattacatgagttataatccattattgtcatttattttggtgctcaaatcgttctggcttcatatgagcactcttaatttgacccttcagggagaagataatgttttagtaattattgaaaagatagctgcttggaaaaggtattgtgaatacagatatttgaaaatgctattatttgtatatagatgtgcgtgtgtgtgttcttttatcagaaacaatgttactgataaaaactcataattgcatgctctaaaatcttggaaagagactattaacatattaaaaatatttctaatgaagattttcaatgagttttgaacttacttgttaaaaatatgaaaatatttctcacaattttgcaagaacggctgactgacatcagagaagaggaaaaattactagccaaagtttaacaaaatctctgaataattagtatgttggaaccaattgctcttctttcattagatttgatatatcattatctttttcggctgtgacagctatgaaaaccatgtattgaagtaattgaatgtacaatcagaccttaaagtcattctataacaaaatattaaaataagatttaggaaacaattaggcacattatatcacattgttttaaaaaaaagtatcactgtgaatatttttagttacagcaaaaaaatttttgttaataaacattaaaaaacttttaaatttgttatgcttttcacattttaatttttataatatatattaatgcagttatacatctatataatttttaaatgaataagcgtacatatgttgagaggttcatgctaaaaaaattttccatggatagggctgcctaactgcaaacactgggagtctgttgatatagactgacgtgaggcaaacaaatgtttgtttatttatttattgagacagggtcttactctgtcgcttaggctggagtgcagtggcatgatcatagctcactgcagcgtcaacctcctgggctcaagtgatcctcccacctcagcctcccttgtagctaggactataggtacgcactaccacacccagctgattttttttaatgctttgtagagatggaatttcactgtgttgcccaggctggtcttgaacttctgaacttctgagctcaagcgatcctcctatctcagcctcctaaagtgctgggattataggcgtgagccactgcatctggctaaagaagcttttttttttttttttttttttaagacagagcctcactctgttgcccaggctggaatgcagtggtatgatctcggctgattgtaatctccgcctcccaggttcaagcagttctcatgtctcagcctccctagtagctgggactacaggcgtgggccaccatgcctggctaattttttttttttttttttttaatttttagtagagatggggttttaccatgttggccaggctggtctcaaactcctgacctcaagtgatccacctggctcagcctcccaaaatgctgggattacaggcatgagccaccacgcctggcctaaacaagcatttaaaatgaacatttatggaatgaatgtcataatacttactgattttttatttctaagttttttaaaagtaagggtcttgtaattcttcctataaagcaaagcaaagtaattagccttatccatgtaaaaggaaagctctgaattagaaaaataagaatatattggagaagacacagtttaagttatggccttttctttttcagaagtataataattcagtctctcaaaaagactagctgaaaacagttgccaaagcttggaatcatacagacagaggcatggtttacctaagagtaactaagaacttaattgaataagagaacaatagtaaagatattcttaacacaggtaaagtaactggcaactgattagaaatgtccaagaggagaacaagaagccagagtttaaagagggttctgataacagtttaagattgaagcagaaatgtaccatttgtacttaagatgagatttagtaacatattggttgaagttatgtgagagaaagaagttaagcacaacaccaaggatttttttgccccgctgccgccccgccaccccaatcactccttcaccctccactcaagataatcttgttagtttcctatttatcgttctagaatatctgtctacaagtacaagcaaatatgaatatactaatgcttctttacccgtttttatacaaaagatggtatattatacataccaagcatttcttgattttgtatttggagatccttccatatcagctctaagaaaatttttcattcttttttatagctgcgtaatattccattgaatgaaatatttgttctgcaagtatttagtcctttgttgatgttcatttggttgtttccagtcatttgctgttaaccatgttacaaatgaataaccttgtacatatgtcattttgcatgtgtgcaggtataccaaggggatatgcatttataattttgataaatattgccaaattgccatccatttgtctatggcttaaaataacaagggcttgtttcttgctcgtattccacatcaaggagttttgctttaaagttgtcttctctctgcaatccaggctgatggagcaaccaacacctggaacactgccagtcacaatggtaaaaggaagggaaagataacaagtgaaagaaaatatagcaagttgtactttggctcttaaaacttctacccagaagttattaatacatatgttgcttttgctcatattttcctagctaaaggaaatcatgaaaccaaacttaactttttaaaaataatttcaacttctattaatattttagatacagagggctgagtgcagtggcttatgcctgtaatcccagcaggagtttgagaccagcctggccaacatggtgaaaccctcatccttaccaaaaatacaaaaattagccgggtgtggtggtgcatacctgtaatcccagctacttgggaggctgaggcaggagaattgcctgaacccgggaagcagaggttgcagtgggccaagctcatgccactgcactccaacctaggtgacagagtgagaccctatctcaaaaaaaaaaaaaaaaaaaaaaaaaaaaaaaaattagatacaggggatacctgtgcaggtttgttacataggtattttgcatgatgctgagatttggggtatagatcctgtcacccatgtagtgaacatagtactcaggtagtttttcaatccctgccatcttcctccttcctccctctagtagtccacagtgtctattgttcccctatttatgagtacccaatgtttagatgccactcattttttaaaacttttttttttaattttatttttttgagatggggtctcactctgtcacccaggctggagtgcacgggcatgatcacagctcactgcaaccttaactcctgggctcaagcaacccttcacctcagcctcccaagtagctgggaccacaggcatgtgccacttatgcccagcaaattaaaaaattcttgtgtagagatagggtctcattatgtttcctaggctggtcttgaactcctggcctcaagcaatcctcttgtctcagactcccaaagtgctgggattacaggcatgattataggcctggcccctagctcccatttataaatgagaatatgcaatatatggttttctgttcctgcattaatttgcttaaaattatggcctccaactgcatccatgttgttgcaaaggacatttcactgttttttatggctgcatagtattccatgatgcatatgtaccacattttctttatccagtccactgttgatgggtacctaggttgatttgatgtctctgctattgtgaataatgctgcgatgaatatatgagggtatgtgtttttttggtagaacaatttgttttcttttcattatatacccagtaatgggattgctgggttgaatgctagctctgttttaattaaagtggagcagtatgacatacttttaaagagatagagaaggatatttgtcaatggctttaatgcctacccccaaaagtatatgcttcccatagggagtgtaccaatttatactcccactagtaatgtcttaagagtggttttctctttcctaacccatcagtaatgtatcaaacttttggattttcacttatctgctaggctctttttgctatcctgtttaggtgaaatgcttccaacatatagaattatttatatttcaaaaattctcagagactttatatttgctgtttcccatgcttagaatgctctttctcttaattcacttagctaacttttcattcacatcttttaaaacccagtcagctgtcagttttggggtaaagtttctagactctttgcatatttttttctactgcatgatgatgtaatggagttacttgtttactgctatgtcttacttttctgtgtacttcttgtaagatcctttaatgtcaggctaagctttttaaggctgatattcaagagcccagtatggaatctggcaaagtgtgtttagctaaccttttgtggatgcttaaccagccagagatgccccgcattatttccacagaagtctccatgtgcttctttatcttctaattaatactatttttaattattcccaaggcccagcacttaaagtcaataatagcagaatattaactattaacattagctatattttcttatataagctttatatacatgaacataaatttactgaatttagatcataatatgtgtggatttaaacattttttttctcactttgtttttgtgaactttattctgggttattaaatatttttgaaaacatgatttaatgacttaatagattaatattctcttatataggtattttataatattcctcttgtttctttcttttcttttttcttcttttcttttgagacagcgtcttgcctgggctggagtgcagtggtacaagcacagctcactgcagccttgaccttccaggctcaagtgatcctcccacctcagcctcccaagtagctgggactacaggcgtgtgccaccatgcccggctgatttatttcttgtagagatggagtcttcctatgttgcccagcctgatcttgaactcctgggctcaagcaattttcctgtctcaacctcccaaaatgctgggattacaggcatgagccctcatacctggctcctcttgttactattatgaataacgctgtgatgagcatcattgtgcatacatctgttttcatttctgattatttctttaacttaaaatagattaaattactgagttgaagggtataagtttttaaatttaaattttattttttatttttaattttattttttaaaatagagaccaggtctcactacattgcctaggctggtcttgaactcttagcctcaggtgatcgtcctgtctgggcctcctgcaatgccatgattactggtatgagccatcacactcggcttcaggggtatatatatattttaagacttctgtcaaacttcttaatttattttcagaaaagcttttccggtttgtactttcagtatttgagtgtgctgtaccaacattaagtattcttattttagaaaatttttgccaatttgacagaagaatggtataccattgtttaatttgcatttctttgattatctgtgatttgaatatatctcataagtttataggtcacttatacttcttcagctaatattacatcaaagagactttgagaatcatagaaacctagttacacttatgctattcctataagattgtcagtcacttgagggaagaggttatatagagtcatctctgtgtcttctgggctggctgagtacatggccatatgtacttaataagtgtttgatgacattgctattgctgatgaggcagtaatgttggtagtgtgggtgggagtggatatgaatctgtaccttatttggcttagctgcagaaaaatctgggggaggaggtgagactttagctctagaaacggagattgcggtggcagcgggtgggtgggtgttccaggtggaagggacagttcaggagaaggcatggagataggccaggaagaaggcttgacaggagctcttgggttgttgaagaaagctgaggaaggagagccttggtaagcagagacagaacagcaaatagatgagaaggcctgggtttaaatggagcagtctcaggagaggtaggattacagctgccagcctgagaggtagatcagcattttcttaggggcgatcattaagacagagaacgaatcgaaactcttctgcaaagttccgttctcacttgttactccctcccaagaaaagtgacttccttcttgttctataattgaagcctcaaaaatgggtccctaggggaaaaataatgaggcttaaggagagggcttttgagaactgcaccattcagactttgcaccagggaaatactctttccataatcttaaactctggaattttttctgatcatgtctgcctatcttaacttctcaactctttgccctcatggagactaccaatttccgatccctcctttttctcacaacttttcatccctctccctaaccattgccattctaacatttctaaaaaaaactgaagaatgttttgaataagtaataaatgtaaaatataaaattgaaaaggatattatatatagatatatatttataaatatataatgcacagttttcctacttcagattcccaggccccctcatctccttttcccccatcttattatttgtgtctcatggatcagtccagagttaatccatccatttatgagcatgtgtgtgccccaaaacttgtatgtgtgtattacacacattgtcctacaccttgcttttttcatttattgctctatctcggagatttttttccttattagtataaatagagttcatactctattaacagctgcatagtttttctgttagtataaatagggctactgctttgtaaatagttatatagtatttctttctgtagatgtgttataatttatatactctgcccccattgatggatctttaggttgtttctaatgtagttgcaatgcaaatcctgtacataagcctgaatacttcaagacttatcttagccacagcttttgagacccctcttcaaacttcatggtaagccctacccaagaacaggccttactattgcttcacaaaccagagtgaccttccctggccctagctgctcctctgaatgctgtgagacaacccttgttctcaacagactgttttcgccttctgagaaactgcagtgcctttacctgatatctgagaccagaaccaacatattctctaccttctgaccttgactggacctggctgttccttgaagccctctttggtagagactatgccttttatatgccccatgcattactgggtcagaagtgaggtttggttttctctggcttcctctgccacttccaagccattactagatccttgcctaacctgtttctacagccaccttccttgttgcaattagattacaactttcccataattccccatttattcattgaaaattttagtacctgcatcacagttttcctttttaatctcaactcttgccataataataatatcattatagtaaccacatttattgaatactactatgtgtaggcactatatctttacatgcattacctaatgaattcataataataattctgtgaattaggcttatgttattaggcccactttattgattaagcaactgagtgtttagaaagatagaaacttgttcaggatcacccagctagtaagatttaggaccaggattcaaatctagatctatttaacttcagagcttgtctttttaacactaatcttagaaccctactttccaaagcatgttccacaggactccagtttctagagtcattaataggtatcatattatacacggttctatgtcaaagaaatttgggaaacacagaattcaacagagcacaaagccaatagattgccttatatcttaggacttctcagaaacttcagtatacttaggcttattgtgattctttaagaagggaatataatatgcacagctttattgcagacttatttgaccatgaaacactcttttagagacacattctgtgggactagttttccaaggaatatacttgagaaaagtctgcgtcagagatcccattgtcatttcattaaaactgtatttgtgaaggtcatcagtgagctcctaactgataacttagtggttgcttttcagtgtttatcttattggacctctttgcagtatttgacacttctgcacagtccctcctgttttgacatctaagaaaccatctccaactctcctctttgatctgtcttcagtctcttttctgatttctctgtttgctcatttcttaaatgttgttctttccagagttctttcctcaatgctcttttcatataaatctatacatttttcttttgaaatatcatttattatgtcacctatcacctatatgtgggttgctctcttatccagcccagaccctaaacccatatttctaactacttcttggacactcacttgtcccatcagcatctcaaattcagcttgtcccaatcaaaagacatcacctctctaaaacctgttttacgtcctgcattttgttcccatgcttcccaaatcaaccctgaacccactagatgtgattgggctcctgagagataagagaaagcgaagacattctttttaagatgtagaagaatgaggagctggagtttcacttatcctcagagggagagaaggatgaggtaactatcttatgcacataaaaagtactccataaatatctgttggcaggatgaatgaacaggatgtagagtaaggaagcttgtccttttgcattctgggcagttgagttgtgaagaggaatgaggggggttttcttgcctaaaaatctctagaaaaggagaggtccatacccattctcgcctattctcacttttggttgagaaaaaaaattttttttatttccaaattttatcttttaccagctacccatggctcttccctctgcttacacagcttgcctccacttccttttactattctaagtgacatagagacaaggatacactgccgttgtactcttgcagccttctcattcagccctactttcataccatttcccctcagtggcttgacaacaaattcttgttcctttgtttttagtaacaaatatttttaaattcagatataattaatataacataaagccatcttaaagtatacaattaagtggtatttaatatagtcactagatcacacaaccatcaccactacctaattccagaacattttcatcacctcaaaaggaaatcccatacccattagggattactccctattcccttttccaccagcctgtagcaaccatgaatttactttctgtagatttgtctggacatttcataccaatggattcctatcatatgtggcctactgtgtctggattcttttatttagcttaatgttcttaaggttcatccatgttgtagcatggatcgttacttttggctattatgaataatgcagctgtgaacattcatgtacaagttcttgtgtgaacataagttttcagcttttttgggtatgcacttaggaatggaaccgctaggtcatatggtaacgttgtttaacattttgagaaaccgccagactgttttttaaagtggttgtgctattttaccttcccatcagcagtgtatgagggtttcattttccccccatctttgccaacacttattgtctgtctttttttattatagccatcctagtgggtgtgaagtgctaacttgtgattttgatttgcatttccttagtaactaatgatgttgagtatcttttcatgtgcttattggccatttttatatcttctttggagtttagtagtctcctcttaaacataggggatacattcccagaccccaaatgggtacctgaaaccatggatagtaccaaacttcacatatactatgttttttcctatacatacatatgataaggtttaatttgttaattttagagacaggatctcactctgtcctgcaggctggaatgcagtggttcactgcagccttgaatcctgggctcaagcagtccttctacctcagcttcctgagtagcttggactataggcatgcaccaccacacctggctaagtttctattttttagttttttgtagagacaagagctgtgttgcccaggctggtcttcaacttctgggctcaagtgatccttatgccttggtctcccgaggcactgggattgcaggtgtgaaccactgtgcccagccaatgtttaatttataaattaggcacagtaagagattaacaacataataaaataaaacaattataaccatatactgtaattaaagatatgtaaatatgatctctcaaaatattttattgtattgtacagcaggtaactgaaaccacagaaagcaaaacagtggctaaggagggactaccgtaatatctattcaaatcctccgctcatttttaaattgggttatttgtctttttgttgttgagttgtaagagttcttcacatattttggatagaagtcccttatcaaacatatgatttgcaaatattttctcctactcctgttcctttttaattttttcaaacctcttttgaatttgccatgttttgccttaattatgccctaacttgcaacctttcttctctttctcttgcctatctctggggaaattggccacagcagccaagcctctgaagcaataaggaggagctgttttttctagggtgtggaagtagcttgcctagttggtcagtgtattattagggttctccagtgggagagaaccaataggatatatgtatatataaaagggactttattaaggagaattggcttacatgattacaaggtgaagtcccatgcatgataggctgtctgcaagctggagaaagagaggagccagtagaggctcagtccaagtccaaaagcctcaaaaccagggaagctgacagtacagccttcagtctgcagctgaagacctaagggaccccaggaagcctcttggtgcaagtcccaaataacctgttcaagggccggagaagaggaagcaaatgtccacatgggaagaaaaaagagagccagaaaactcagcaagcaaatttattccaccttcttccacctgctttgttctagctacactggcagccaattagattgtgcccacccacattgagggtgggtcttcctctcccagtccaccaactcaaatttctatcttctgtggcaacaccctcacaacacccagaaacaatacttccccagccatctatctaggcatccctccagtcaggttgacacctaatattaaccattaccgtcaatgaaagcatgttctggagcattgcagccatgaaagcatgttctggagctgccagctcatgtagcatcctgatggtctcagtccctccttttctgtttctctaatatacgcatctagctccgtccttggaattcaaccatttaggtaaaaactaaagttgtcagtagaaaggaattcaaaagatgaagctaagtagatgacaacagtgatttctttaggaataaagcttcaaattttcttttctttttcttttactttttcttcttttctttttcgagactgagtctcactctgttgcccaggctgtagtgcagtggctcgatctcagctcactgcaacctctgcctcccaggttcaagcaattctcctgcctcagcctcccgagtagctgggactacaggcatgtgccaacatgcccagctaattttttttgtatttttagtagagatggggtttgaccgtgttggccaggctggtctcgaattcctgacctcaggtgatcctcccaccttgacctaccaaagtgctgggattacaggcgtgagccaccatgcccagcctaaattttcttttaaacatgagcaaagtccctccacctctcccacctctattgacactgaaaagagcagagctgccagaaggattcatgtggttctcctgcttctgttctccatatctgctaagcagcagcccagagtagggatgaaagctgagactggtctagttctcattctccaaagccaccaactgagatgatccttccactgtattccaaagtttccctacaaaggaaaggaaaaaaccagagtgcctggcttctggttctgaattgtccccttccttccttccttccttccttccttccttccttccttccttccttccttccttccttccttcctccctcccttccttcccttccctttcttcctcccttccttccctttcttcccttccttctgttccttcctttccttcttttcttttcctttcttttccttccctttccctttcctttctttttgacagagtctggctctgtcgcccaggctggagtgcagtagtgtgatctctgctcactgcaagctccgcctcctgggttcacgccattctcctgcctcagcctcccgagtagctgggactacaggcgcctgccaccatgcctggctaattttttttttgtatttttagtagagatggggtttcactgtgttagctaagatggtctcgatctcctgaccttgtgatccgcccacctcggcctcccaaagtgctgggattacatgcgtgagccacctcgcccagccccgaattgtcccctttcttcccttgccttttaaatatctgataccactgagttcctgatttcaccttttcctcctctcatgggctgagtttgtccccattcccaccccaaagttcataatgttgaagtcttaaccttccccaggggttggatacctaaccccaggtatcttagaatgtgacattatttggagatagggtcgttaagtgggtaattaatataaactgaagtcatatgggtgggctttactccattatgactaatgtccttggaagaagaagaaatgaggacacagacacagagaggaaagaccatttgaaggcagagaagatggccattgacaagccaaggaaagaggccttgggagaaatcaaccttcttggcatcttgatcttggatttctaatatccagcattgtgagattttttttttttttgagatagggtctcactctgttgcccaggctggagtgcagtggtgcgatcttggctcactacagcctccacctcctaggctcaagtggtcctcccatcccagcctccctagtagctgggaccacaggtacatgccactatgcccagctaattttttatattttttgtggagatggggtttctctatgttgcccaggctggtctcgaactcccaagctcaaacaatctgccccccttggcctcccaaagtgctgggattacaccacgcctggtcaaaaataaattttagttggttaagccacccagactgttctactttgttttggcagccctagaaaactaatatacctcccatggcagaagagggaagagggtggcacaagcctcagtatttctcgcctgtcaatatttgtttcctgaggtccacttggagagaaatagggtttccagactggtagacacagagcccaagagcccattcacaatattgtgtcttttgtatccgtttactgttaaattgttactaacaaaatttagggctggatagaaatgccgagaactgggtttttgtattagctcacccttaaaatctgaaataactaacaaattcatatttgttgttcttctcagttataaaattagggatagcgacttgttctctctcacaggattttggtgagatcacagaaaaatgcatttttgagtacaaagctctacaagcatttgcttaaaagtctctagccagcctcctagtactttccagaactgttggcttttagggatctgtcatgacctttctagcctagacctgaggcaactgaatgacccatcaaaggtcattgctgaccatggctggaacctttgctgctaagtgaggatccattgacactgctgtttttttggctgatgtggcaatgagccaatgccataggatttcaggctgttatagggatctaggccaccaggtctcccctgtggtaacagggttgctagggtaacttatctatggatgactccaatgaggctatttggtatgttagtgcttctctgggaccaccaaagaagaggaagaagtcaacggaagccaaaggctgacctgtgcaatgtgggaacattttcaaagagcagctttcatgcacttgtcagtagcaatacggatgttttttgtttgttttacctctgaaatattctggacacatttatggcctggatctggatgttcatcaatggtggatcttctataaaccttctagttctgggctgtgactgagcctggtgaattataggatgtcacacctggactgagatttggggcagtggatcatttggaagggtggatttggctctggtttccaaggagcacatagaacatttccaagggatgccataatgtcatcaacctgtccagagttagagaaaagggtatcagatactggctgcgggccttagctccaaatggtaggtattttctgggcatagtatcaataaagggaggtacatagttaactcttatggaataagtcagattcctctacaaaattacttgcttccaagtaataagcaaagcatcctttctcactctttaccaccaccttctctgattcctgctgcttatttgaccatccaaccaatgagaatattcattgctggctgttcctctgtgaaaaaacatccttttgccaaagttatccaaaatgaagcaacttaagtaattattcagggttttttgttttgttttgttttttcgttttcttttgttttttgagacaaggtctcgctctgtcacccaggctgcagtgtagtggcgtgatctcggctgactgcaacctctgcctccagattcaagcgattcttgtgccttagcctcccatgtagctgggattacaggagtgcatcaccacacccggctaaatttgtatttttaatagagatggggtttcgccatcttggccaggctggtcttgaactcctggcctcaagcgatctgcctgccttggcctcctaaagtgctggtattacaggcatgtgccactgtgcccagcactttttcagttttaaatcaagcccctaataagtgggtactgctgggtactgttgggactatttgtaagacattttcctattctccaagagcttataggccagaggggaggtagaaataattaacagttaagtatttaaatacttttttctctcagtcactttttcctcattcttactttctgtgcagcattccatagtgtttttaaaactcccttttttcgtttcctattttcttctattattcttagattctcccaattctcttccttccttagctcctgcctcatttctttctacagtcttccctcaagcatcacttttaatctcaaaactgcatctcttcagcctctaatcaagaatctttaattaagcaactactctatggaaggtaatgtgcttggtcctacctactgtgataggtaaccagtaggcttccaactagccttttttttttttgaacggagtcttgctcttgcccaggctggagtgcaatggtgcgatctcagctcactgcaacctccacctaccaggatcaagcaattctcctgccttagcctcccaagtagctgggactacaggcatgagccaccacgtctggctaatttgttttgtatttttagtacagatggggattcaccaataatccacccgcctcggcctcccaaagtgccagggttacaggcttgagccactgcacccagcctcccaactagcctttgtaagcagatgttcccaaatctaaaccttccctttttccttaggctctattcttcctgtctagttatctactagttattttcactataatttcccaatgtttaaaacttccctcttgagcctattccttttcctttgttctctatttatattaaagttaccatcattctactagtcacccactcaaaatcacggtgtcactttttattcttccttctctcttgcctcccacttagatcatttgccagctcttgctcttcttttctttgtggtttcttttaccagtctctgtctcttctctgtttccctttgtgttcgggttctctttatttgcttagactatagtattagtcttctaatggtttccttgcttttattttcttagaagccattttatgtattactgccagatttatctttctgaaatagagctcgagtcatggctaccatttataccaagggctcaacttggatgtcacattctttgaagcctttcccaaagtgcccaggccaagttagagtctcatcttttatctttctatagcatttcatatataatcaactttgatgttaatcacattgtcctggaattatgtgagcatttgccctcaagattatatatttcttaaaataatatattttgtatgattctttttgtattaagttcaaaaacaggaaaaagtaacctgtggtgtcagacatcaggatagtgattacctttgggggatggaatttgtagtgattagatatgagcacaggaggcttctggagttctggttatattgttttcttgatctagattctgtttacatggatgtaaaagtacacttttgacttgtttatgttataattataatgtatattatcattcaataaaaagtttaaataaaagctaaatgaaaaatagcattaaaatacagagtagagaaaatgtctgactttatatccctgatgcctggcacccactaaactctttgcagatgagtgagtgagtgagtgaatagagaagtgaatgaaagtttatcctcaaaaaaattaatttttctttacattggtaattaaattatagtctcaacagagcctgagttctccaccacttacggcctgtgtaaccttaggcttaggcaagttacccagccctttggaaacataattttttcatctctgaatatcatagttgcctcagtggatgaataagggtttaataatatcatacatgtagagcagggcatggtgtgttgttagcattcagtaaatgttaatatccttttctttccaacgccttcctccttctccctttcatctctttacccatcctctatcctctgccttaaatatcctttccttttagtttccacatatccaaatattatccattctttggatcaatctcagatatcatgctcttcacagagccttctctgactcacatccaaaccagtgtttctaatgctggaaatatttccctctctcaaattcttgtacattttatctgtgtcccttatgatacatattagtcactcactccaacctttaggagttgctgaaggctgccgtctgacttcaggcccaaagaagaataagcactgtaattgggctaatatgctggaggcaggagctctgtcatttggaacaaacttgggaatgaaaagtcaggttgagaaaactgctttgggcttttcatattcatttttttgtttgtttttttttttgttttttgagacggagtcttgctcttgtcacccaggctggagtgcagtggtgtgatcttggcttactgcaacctcctcctccctggttcaagtgattctcctgcctcagcctcccaagtagctgggattacaggtgcccaccaccataactggctaacttttatatttttagtagagacagggttttaccatgttggccaggctggtcttgaactcctgacctcaggtgatctgcccgctctggcctcccaaagtgctgggattgcaggcgtgagccactgcacctagccctgatattcatttttgtacctccccttacacttggagaaattcagatgtctattaaaaaatatgggcccaggggctaaagtttaagttgcagactgtttgacctgccttttgaaatggttaaaaacctcttctgctaaagacgtcttttggcccagcttggcttatcaaggtaaaaggccatgcagatgtttgagtctcaagtcttaggaattaagagtagacattcacctggagtatcttctctgcctaatatccctagtgcatgtaggtagaaaaacagttcagggaagaccccattcctggccacttattttcttattattttggctttctacgtgtattttccttgcatacttacaggctttaaatcctttgctagattgctcttgaggtcaagaactgatcaccaattcttagcatcaattcctcctgatacttagtaaaaactcagcaaagatttatggaatgaacacttaaaaatattaggtggccgggcgcggtggctcacgcctgtaatcccagcactttgggaggctgaggcgagtggatcacctgaggtcaggagttccagaccagcctggccaacatggcgaaacccccatctctactaaaagtacaaaaattatccgggcttggtggcgggcacctgtaatcccagctactcaggaggctgagagaggagaatcacttgaacccgggaggtggaggttgcagtgagccgagatcgcgccactgcattccagctgggtgacaagagtgagactccgtctcaaaacaaataaaaaattaaaaaaattaagtggtattacacggccctaagtaactgattgcaaaagaaataattaagtcttttaactgaaaatagttgccacaggactttaaggaacaagccctttggattagggtgatcagagaagtcttctcagaggaattcccagagaatactaagttagcagttaagtatcaggaaatggccaagaaataaaataacatgagcttctaaagatggaaatcaagggataacttgcttcctgtgtttgcaagcatatgccatgggggagatccatggcctcttgcaagtggcatgttgcattcttcctgtggacaatgcagctgctatttaccactatgccctgaagtacagtcatattgtaagacttcagtaaacttcctgaagccaaagggaaagaggtaagttgtagcccattctttaagctgcttcttctctttgctggttgtcaccttcaagcatgctaaggaaatgtgtttattcagtcctcacctgagaacactcagacttaaacagccaaagaagacaagttaggaagatcattttagatgaaaaccaacctcctggagcatttgttaacgacagatgagataaaactgttgactgatttctctctaaaatattcttccttcttggcctttttttttttttttaaaggggtcttggtctgtcactcaagctggagtgcagtggcacaatcacggctcactgtaacctcgaactcctgggctcaggcagacctcctgcttcagcctccaagtagctgggattagaatagctaggactacaaggatgtgccaccagacctggctaatttttaaatttttcttgtagagatgggggtccccctatgttgcccaggctggtcttgaactcctggcctcagtccttctacttcagcctccataagtggtgggattacaggcctgagtcactgcgcctggccccatctttgatttcttcatagcatttctctttctctgcttgccccttaaaacttgataattcccaggctttgttttctacctcattttcttttctagttaatctcatccatgtcctaacctgtaactgataaatcccaaattactatctctacctcagtcctctttcatgagttccagacttttttatccagcttcctgtggatattgtcacctgaatgttcatagccacttcatacaatgtgttcaaaccgtacttaccatcttttttttctcctccacttcctcttctatatatcctttcttactaccccgtcaaacataaaatctaacactcctctccctcagaatatataacatgggtataacaatgcctcttgctttaacatttcccccgttaggttatgaacttcttaagggcaaggattgtatcttttcattacgcctgttaacaagatgttgttacttaataggtgttcatttattttttgttttttatttattttattttttcgagaaagagtctcgctctgtcacccaggttgaagtgcagtggtgtgatcatggctcactgctgccttgacgccctgggcttaggatatcttaggttatcttcccacctcagcttcccaagtagctggtggaaggggcaaaagaactcctgtgggcctcttttataaaggcactaatcccattcattagggctctgccttcatgatctgttcacctccccaaaggctcacctcctaatgtcatcaccttgagggttaggattttaacatatgaattttggagtgacacagacgttcaggcaattcaacccattacaggtaccaaagtagtttttcatgtttatttacaagtcttatcttctgacaaagcacttgaaaaggttcctaccttctcaccatcctgatgtttactctctgatggcactctacatagggccatctggaaacagaaaggatgagatggcacattaagtgagtgcaaggggtttgctttgactaaagttagggtgttgggaagccaaattcctctagacatgggcaggtcaagaaagaactttgataacatgtaaagaactaggacttttttttttttcacagtcactgacggattttaagaaaatgagtgacaaaaacttatgtacatcttagaaatatccccctagcaaattgtgcatcacggatcaagggtaaagaggagtgagtgggaggtggttctggaggaatggagtctagggagaatgaatattttgcagtagttgaagtgagaaataagcctggactaaagattgcagaggagacactgatagataagaaggtaaaatagattatggcagaggcacaaagggctttgcaggggcttctctcactgggtaaagaattagaatatatggattccaatgatccagtatctgagcagagaagtcatctctgcatgggttgatatgggtgagctggcagcctagtcctctaaacacgtagttctctcttcagacttacctagttgagtgcttccctttctttccaccatgcttccctcttactgtcagagatccccagtgaaggatacgccttcattaagtcttcttttcccctttgtacattagctaccttcctgtaattcagtacctcatatcagatacttttgaatatttggagaatcctgtagggaaaaacccacctctttgggatcccttcattgaatgtgaagacacttgaaactcatctgctggttagggacatatttccacaagactatagaaacaggggcctaagccaggagaattctccagatttgggtttgccctatatcttattcttagatgtatcttagaacaagccataaagaactgaggggatatttgatcaatattaacccagttagtctccacttagtacaagaggttcatttctccctgggatgtcaaattttggattccttttagaggatcctcggtatatggcctctttgtttcctttgggtatagagattgaggcagggccaatgcactctgtggcttgggctgggatatatatataaacaaatactactttaggaccggcattagtcctaaatctgggagctgtgacttttgatcgggtttatgtgagagggcagtagacatataggtttcttatgatcatgaattgttaattatttggtcctgaaatagatagggggccacagcctttggaggtacaggctgaaaacctaactggttagctggccagttccaagaagtttatcagctccttatgttcaagtttctgctaatcagggatggtccttgacctgattgtaggactaagacttgtcagcaatttatgactcttagggcctgccttgcagcttgtcgggtctgtttaggtaacaaagcagctatgtcttagtgcatcagtaaagtcagcacatctctgccaggcttgtcactcccctaggatggcatgctcctcagggaaggagcaggattacctcctgctgcccgtcattctctgctgcatatgctttctccatggtgtagggagggcatcattctacagcgggaaaaatgacttttcttagccaccagaaaaatcatcttcctcatgaaataaatcccagctgtgtgactatatgtcagctttttcatgttgcttctggctttcctcagcagtagagaaggaaaacagtcacaagctgactcttgcatgatatagatattggccgcacccatcctttgtactctgcgtctgtgttgatattggacaataaggtaagcacctgctggtcctgacccagcctgtctctggcattgacacctgaaaaggcaggccaggtttggagcaggcatattctttgcttctagaccagttgtatctgacgtcagggagacttagactggtttgtatgagtagggagaattgtgattggtgaggccctcctccagtatttctgtgacaccactcagttgctttagctgaagatgaattttgtatgccaggtggttttctgactaacccacccattcggctcccctttagaactcctgcaggtctgaaccttcccacaactctgcgtgagtgtcagtgtatcatgttgagtttccatcttgactcatctgtctctaggcgaagatccctgcaaggatttaaattgggaaccagaccttgagaatgtctgttcagagcatttcacagcttctggataaatgccttttccttcttaacccaatctgtttttccagttctgcccagctagctcctgagcagcctactttgaggaagcttcccaactgaggtgggtgctgtgctatttcttacctctaaaaagcaccccatcctttcggcctactcaggcttccccagggccagatccactgtgatgagggggctgcattgttgcccatgtggctcacaaaacaaattgcctgcttgtcccaaagagctagtccactgaggagtcctgatgtcctttggccatgtggtgtctggcactctgtgggccctgtagaacagtggcagaaggggccatgctcttttacaagagcttccactgactgtttgccacttccccacttactctgtttcttgcttttgctggaacatgggaaggtggatagatacaaaggtaatttgtggtcaaagctgcatgagctctcctgtgaagtttgaagattgtaactggagatggcagatttgttgtgcctcatgtgctaaccacgtcttctactgcctgagcctttgtttttctggaaagcccaagctgcttagaaaaatgggctggatgtgtttgggtgacaagacagggtgggttccattagcctcagaaatgccatctggaggccttagccaggccttagggccactttgtcaattaggcaggaagaagtaggttcttttagcagggtcctacctctggggaatctttcccactcttgaaagtttgagcttctccttagcctaggaagcctgaccaaacctgatagtgacagccactgttctgggctctttatgagtggctgcagatttgggggagggaattctaatttaatcaatcttccctatatttcttgttttaaaccttttacctccttctcctggctgaaggatgggaaactccacagtaaattggctgtgacttccacagaaacttgacagttttcaagttatttttttcctctgtgtttagatgcggttatagttgtgctgtcaggccttatctcttctgtcatctagccagctcccaactaggttaggaggtatgtgctctgctgttagtgttggctgtgtaatgaggtggatggctaagaaatgggttgtttagcatctcttggaatctaaattttcttccttggttgagggggaagcaatgttattggaagaaggcagtagggaggcacatgttggctctgaaatcaaccctttcttctcaggatcttggataagccaaacaaatcattcttaatttaaatgcttgttttatctaccataaagggctgcctgttctgcaatggcagatcctaggatggtccccatagactgactacctggtttgtgggctaaagaggccatactctgttgtggattgccatgaggaatgttgcagggcagcagaagtcacaaggtttgagagcctggtttgggcatgctgggtaaatcaaacttgcccacgtactgttggcctaaggaggaagagggccttttctcttaagatcaagctcaggggagtcagaagaggaatgacttcactggattgttactggctgatcgagctctatattgagaaggattctgaggttatctaggttcattatgcgatgtttttcatgtcctatggttgcagagtggaaaggggatatcacatttcatgtatttggcattttatgctacagagcttcaaggggtcctggcttgtgctcggacattatgttgcagtgaacaacttgagtgttctttgaagataaggacattcaatttcccagtgagtcctaactagaattgttgaattattaggaattagggtcacatgagagccacctggctagtgagtctccagggagatagggcatccattggcaaagaagggttatgaaatttggggtcataaaaggggccctgaaccttaggcagctttttggtcatggtgatatcactttaggttacttcgttcctaattctggattctgaaaccatctttggtctagacttctgcaatacagagttcatctcagctcacctaacttcccctccttctctcgggttgttgctttggcatagcctgagggagctcttattttccagttgattctcttgtggtggttgttcagtaagaactggaatagatgtctactccaagaacatggcactgtttgattttaactgcacttgatcactgtacctatccttcagctttgccaaatgctgacaacagattatatatacacgaaaccaaccaaccaaccaacttagagcttgtctcagtagaagggaagactccctttgtattgtgctccagcagttccacggctggcatgctgtgttccggcttccctctgagactaggagctcctgaaagtataggtctccatctgtgtctgtttatatcctatagcccagatgtgagagaggtggataggggaaaagaaagcagggaggagaagaacgagggaaggaaatggaggaggggagagagtaagatctatatttagcaaaagggagagacacttaccaagggtgtgtgagtgagcttgctggcaagggttgtgtgtgcgtgagtgtgctgggaagggggtgtgtgcgccaggaacgtgtgaggagggctggtgccctatgggaggttgcaggcaggaagcagctggagaggaggaggagcagcagcaggagcaggagctgccctgctttctgcctcagtctcaaagcccagaatcgattgagttagaattccacatccagttgaagtttggctgctgttgccttcagcaggctgatctcagaatcccccttgccagagaggtgtggaccaggttagatttctacgtttgcagccagtgagactcctgccaagcccttcactgaggggtttttttgcagggcattgtttctgtcatcaactttgtgccgtggagccagccagctgggtgcaactgagaatattagctccttgggtctgtttgtcggttgggcaagcagtggtgctttggctcagaaagttcgtcctgtggcttctctgtcaaaccaaggagtgctcctggatggatttcctcttaaagacagcatttgccttctaaaacttgagaattcatggttttaatttttttttttaatttccttaacccttattttggttgcagcagcaaggtaagtggtaccgagtgtgtatgactgactgaacaacaagcagggcaaaaggaaagcatttgtgggtggaatatggagcagctacattaattacgtaattgcttgagtcaacttgctggtgaggggggtcattataatgagtgaaaagtagcatatgccgcactggggtagaatcttcacatgcatgtatttgtgtgctgataatctgaccatccattcctctgtggtactttcctgtatgtatatagataacccagccaccctctggatgtgtgcatattcatatacaaataatctgtttctcctttttcatgtgtccatatgtgtttatgaataaatgacctgtccattcctctcctgcatgtgcatatgtatagacaactcattcatccagcttgcatatatgaatatgcaaaattcgtctctccctacttgcacatacatatataatccatcccttcatctcctatgtgtatgcatgtactcaagtaacctttctgttcttgaatatattctgtatcatttccacccttcctgtatgtgtatatgtgagagagagagaaagagagagagagacagagagaaagagaaaaaaccaccatcctaatgtattaattcatccctttcatgtgtgtatatgccatataaacagaaaagtcatcttgagttttctcagtcttgaatatatgcacacatgcgcaatagacagtctgtccacttgtgtcttgcatgtatgaagaaagagcactaactttgcagattgaagactcacttttaaatcctagctatactcagtgaccttggtcaagtcatttagcctctctgagcttcatttttctcatctatgaaatcagtataatcagaacagtaacaacaaacctcctgcctcacagggttgttgtgatgataaaataggaatcatataaactgaaaattctaaacaaatataatctcttactactgtgtgtccctctagtatgagttggataggatagcgtactcttggtccagttttattgaaattatgttcttgtctgtgagaggtttctaagttttccatgtgaaggggaagcatctattgaggtaaccaggtttatcctgtggttttctgcagagtattggaaagaagcggggtaccgtgaaagggtcaggtggagagggagaaaagctctcatcttctgtaggctggggccttgatactttgttttttgtaccttgaggaggattgaacctcacacaaaatggaaatgggctgcttccagccaggatcaaagtgagcaggtgaaaagatgagtgaaagaacgtaacattcgactgcctctgggatgacagtgtgccctttgcagtgagcttctactgccaggtttggaaggctctccagagtatttcccaccccagaattctagacccatgctgtccaatgtggtagctactggccacatgtgactgctgagtacttaaaatgtggctagtctaatttgagatgcattctaaacataagatacatactagatttcaagaacttagtataggaaacaaatgcaagtatatgattaataattttttatattgattatatgttgaaataatactttggctattgggttagataaaatatattaaaattaattctacctgtttcttttttatgtggcgattagaaattttaaaatgacacatgtggttcacattatatttctgttagtcagtgctgctctaaactcacccatcactagcacaaggatcagggcagcttttccaactcggggtaggggatgggagccctgtcacagcatccctggggtaacaggaaccacagcaggatctctccctgccagtctcatacactggagagataccagctaattgatggtctggcagagaccggtgctgccatgcccccacactctttttttgtttttcttttttctttttttgtcctgagtgagttcccagataattttaagtacaactggggaaagatttccaccttagttttacaatgaaagaggactgtaagccatcaatctagaaggaaacctagaacttgaatgcagcatgttgtcatggaaacagaaatggatgagaaaattaggagacctggattctaattcggctctgccatcaattcatttatgctttccatgacaatgaattctcactgtgtgtcaggcatagtaatgccctgttctaggcactggaaattcagaaacaaataagacacagcttccaatgtaatggagttcacacccgctgcggatctttgaataggagcctcccatctagtagtctgccacagcaaaacagattaatgacaacaagggtctcattctaggtcaagggtagtagggcttttgagaagctagagcacctgccctgcctaaagactttcaaattcaaagtatagaaaagcactatgatggtaagactactccataacctagatcacaatgtagtgtgagattccaggcctagacaccctctaaagggtttgtccaactatgttctggtttcttttattcaatgacagggttggtttgttttgggtttttgtttgtttgtttgtttgtttttagcacaggcactgttttaggtgctgaagatacagttatgaacaaaacaaagtccctgctcatgttttgggatacagaggtcagggagggagacagataatgaacaagctatcagatgggaatgagttctatgaaggaaattctagaggaagaggatagagatgggtttttttgtggtggggtgttcagtgagtagattctcctgcactcgtatctttttcagtgtactcacaagagcaggaggtagtaaggaaaaagagggtatgtgagtgttaaacaaaaaattattttgacacttgttaaagatgataagacagactttatgtggggggacgacaatactggggttttgtagtgagggtgaacaattgagctcaactccaaatataaggaaaagtgggaatttagccaaggagcagggtggggtatcagtggacggaaattactaagatgaagtatcaaaggggattttggctaaacttacttgacaggatttttgctgaaggcaggccaaggtggtaagatatcaggggtaggggataagaaatttggtcagataccaagcatagacagatactaagggtgaaagatgaggaatttgatcagaaatcaagggtgggaattttcactaaaatgacctggctggattcttgttaaaactggactaaatgagccaatgtcaagggcctactcagaaagaggactcagaggagcctgacttatgtttcgtcaaagaagagtctttgtcatgggttagattctgggtgtgattgtatttgttgtatgctttgttatactccttggtataaaaaaccttgctactgctgaaagggagccctgggcagggcacagaatagcctgctctcatgcctggcattcagtctccattatgaggtattgatatgccctccctctgaaggctaggtccgccctcatgccactgtcttttaactgtatgttacctgagattgtctcccttcttggatatagaggcttgaagttttctttcccttgtatatgtctagcttctggcctataaatggggctgctcttaatgctgatgaggatggatggcaagtcctaggaactgcaatactgggaccttgctaagcctttgatctagggcatttctcattccctttggctaatctcacttgccatatcttgtgccctgatcattttgatgattaacatcctgagaatccccatacctgctgtggccctagaaatccattcctcttagcccatattagccatacaacataattgatatatggcccagaaatgctctgtcctctgttgggggctcagagctcttggatttctgcttgctgggattgtttcacacaaactgggaagctgcttgatatatgtacatcgagtcctggccttttcccagaggtcccctggttgtttcctctaagccagatttgggttagaagcagtttttacaaggaatagttacattcctaatcacatttatttgataagtcagagagaaggataaaagaatcagccatttcaaaaaactgaggtgttttcctttctctttttcgttggtaggctggtggtgatgcaatgtggtttaagggatctactccctgcagtaattgttagctttccatcattaaagctttaatctttttgattaattcattttgttttgatgtgctcccttttcaaatgcagatagtccttgaaaggggctgccttatttttcccagccttaggcagtcctgaggaaaagagcacagaaaggtatggtttttgtcggaatgtgtgtgtatgaaatttggagagttgtccagagtcaataggccaacaaagtagggcagacagataacattgggtatcttaaaggaaactccaaggctaggtggactccagagcctacttaccccatcccagctcaaacattacttttctgtggccttgtatgcctcgttttgctgggcctctcacctcctttccattcccaacccctgaattaaatgcttactttctttttcattttttttttttttaaagacagggtcttgttctgtcacccaagctggagtacagcctcaacctcctgtgctcaagcgatcctcccacttcagcctcccaagcagctgggaccacaggcacatgccaccacatccagctaattttttattttttgtagagacgtgatctccctaccttgcccatactggtctctaactcctgggctcaaaggatcttcctgctttggcctcccaaagtgttgtgattacaggcgtgagcccagctaaatgcttactttttattataacttttattataatatgtatcactttatattgtgatcatctatatatatctttctctccaaatcttaatgtattagagagcaggtactgcatcttatctccctggcacacacagtaagtactcatgcagttcaactgacttggagatcaaatggtccttcttacagtttgctccctgtcatttcacttctgtggacagtagtagcaaagagaggctgggaaggaggtgaattgggcctcctgtccctgagggttgccctttcagcccattctggcttctgatattctactgagctcagcacagtgactggttggtcctctgagcatcacatcgagctccatcccctgcttcaaagcccaaagactggattactaagtgagtttggtgcccttcctatatcaccagaagagattcttgagttcaaagttcatcccagggcagtggctaccaactcataagaaggtgtggaggcttttgtttgtttaatatggaaggaagcatctttgtttgaggctgggagaagctgctatggcagctctagttgaaaatttcctatttgtcagtaacatggggaaccaggcagctctgccttcagtcttcaggaggccacaggaaaggactctgaacccagtggctatgccatttgccccctgtgtggctggccagccagtgtcgtaagcactgtagtttggaagggaataccttgtaaggtgtccgggaaatgaggccaagtatgtctggagggctgggcacggtggctcacacctgtaatcctagcactttgggaggcgagatgggcggatcacctgaggtcgggagtttgagaccagcctgaccaacatggagaaaccccatctctactaaaacaaaaacaaaaacaaaacaaaacaaaacaaaaacttatgtctgcagtattgatctgaggggcagaagcagataggccccaggttagcctggtctacactgaatcagtagcagtagcaggggagtcagcttcattagtgttcccgacaaactgccttatctggaccaaagtgaggctggccttagaagacctggcaatgaattctgggcctcaccagcattggaaaaataaagcttggcttctatagccatttatctcttcctcagcgttcaggctgtctgagagacggccggcctcctgacacttgaatgaggtgttgggaactgaatgatttactcctccttctccttaccttaaaaagaaaacttctaggagaaagcaggactaactttaagggtgacagtctcctcgtaggattccaggcactgctgcagaccattagaagggagtgggaaaggcaggagtctggggcagaagtagaagtcatggctcactcaaattgtgccagttaggtggttggatgcttgctttagatatgggtttccctactttgttgactcagggacttgccacatcagtagcaataacaacaggacagtgctttacagtttagtaagtacagttctctcattttagctttatataataacattcctgtaattatctcccccactttacagatgaggaaactaattcacatagaggtcaagtgtttaatccaaggtcactggtggaacaagacccaaacttaagtctcttgatgccagtccagtagcacttgctcatggcttcatgtagttgtacacagagcttccatcttagtttactaagcttactaagcaattctaatttttttttttgagacagtcttgctctattgcccaggctggagtgcagtggtgcgatcttggctcaccgcaacctctgcctcctgggttcaagtgattctcttgcctcagcctcccgagtagctgggattacaggcacctgccatcactcccagctaatttttatatttttaatagagagggggtttcaccatattggccaggctggtctcaaactcctgaccttgtgatctgcctgcctcggcctcccaaagtgctgggattacaggcgagagccaccacgcccagccgcagtacttcttttttaaagacaaatttgaaaggccacttgccagctgcagcccttgtaaagccaggaacattgttcatggctaataccaagagcaaatcagggatacccaatccctacatggttggggaggaaaaaaaaaaaaaaaaaaaggagtatctttggaaattcagattttgtccttgtgggaagagagaaggaagaatttggcatcctctagactttggagcgtggtctacctaggcagctgggcaccaagcccaagacccagaaattctggttgtgcaggtagtgcatcctcgcaggctagactgagttggccagattaggggcatggctgttcctggccccatgagaccttgaggtgaagcagtaatgcctcacaggatggatagggttcttagatgaagaattcctcaatgaattagagttgttagataagctggaaagaaaaggagagatgtgaaatgggaatacatgcagtttctgtctcttggttcttggcctagttatttctagtaaaaagaatcagcttcatctttatcccaagtcctctgactcgtccttctggttcctcctagtctggggaagcacaatgcttttaaattccaggcccacagactagatgtaggtggtggcctttcctgaaaatgggttgccatgagagcagtctgcctgtgttctttaaggcattttcccacttttaggattaacttgagtactgggaaaataaaaggaggcagagtttagaagatttagaaatctccatcaaatctagaaaatggggaaagcatccctggtcaaagaacatgaagagtagcatgtctcccaccaatccatcttacccctcccaggagacctagcaggactggaatattagttgtcccatgtgcctcctagatctctgctttcctccttgtactttccactctactgcttccgtacactctccacattctcagtaaaaagggaatgtattctcactccacatgaggtaatcatcgtctctgcctctgtaatgcagtcaccaatagcttagggtgtagggactagactggtggcaagtctgtctttaccttattggagaagagtaaagcaccctggagccctctgtgaggtaaccctcccccacatgtcccatgtgatattctctctgggccaggcagaggattagagcaaccctttgttattaatacttgagcagtggacagtgtgctggacaatcacttattgtggtgctctgaaagatcctctgtgggccaggaaagccaaacccagatattgactagctgcagcaagcccttagagagtattaagtggagctcaggagcaccaagctaagcctaaacctccttcatccccagttgtgagttcatgatacctgtctctttggctacctgcctctctacctgcctctctcatgctaaatgccacctacgtctggacagtgtgtgcgtactgtgccactttattctagaattaggtaaagaaatatttttcctgctaagtttaaaatacgtaaaccattgtcctttctccaagtgaacggttgccatcactcaacaaagggaaaatactttgtgctataagcacaggcaggggtaaacttttgagtaagtggagtcttcaccagaacaacaaactggaaaagaaagaaagaaagaaacattccatgtcttgtctttcactgtgtatgtgatttgagccttggtggttaagcatttgtttgtttatttctgagccagactcctagtactgaattttgtgaaagttcaaataaggacttactcattgaccttacttcatctacctcccagcagcttgtctcaatatcgttgactttgggtacttgcccagaacacaaggactttattttaattttacattgatactctaaggggaagctaatgagaaacaactgactgcccatagcctttaagactggggttgggaggcaggtcagggttgattcctataatcttaggagataatgtttttattcctgcttgacaacttgattcaaactaaaatcatcctgctactttctgacctgagtgcactattttcctttttcactagctacaggataaatcaagccaggatccaggggcatgtgcgaggtttggaggccacacatggggccattccaggcagcactgtgggctaagcccaaagcatcagccagcaataattgctagaaacaaactgaaaagagcaggacaggctgttgccttccaaggtaatctctattaagcatcctgaccagaaataagaggaagaagcagagaacccctcaaaccctgagggagaaaatgaagcgattgttgcaagagtcagaggaagaaatcatggttaccttgggaccctcctccaggctttccccagataaggctaaggcagagaccatgtgtggcaccaagagcaaatcctctggccctgctggatccttaccagaggacaactccctgcccccttgctgtgggtcagcagccttagccattggtggagatagagatggggacctggcccagctttgcagctttgggcagcagaacaacagccagcttcctctgggctccactgcctatgtttcagggtctggttctcaggatccctcatctgtcagcattaccacaagctgtcaggagccctcagagaggaaccaaaccaagacccttttgtccagaggccatggccaaggctgtagccgtgaacagcgggaacctttgggggatgtagtagaatacatcatcagagagctgcaaggcatcagccgtcttcagactgagattgctgagctgcagcagcacttgagccaagtccagggttccgtggatgaagtctctagctgtgtagactcagtactgagtgaaatagaaggcttacaggtgagcacctgttccctggccaaggtgtgtgagggtgaaaaggcccaggaaccccacgtggacagacccagtgaggaagccattctgtatttgtacggacttcctgaacaagatggagaaaatactatggaactggtggaaagctttctagccaagcacctttgtgttaatggcatgcagtgcaacaggtacattaaaaaggcttacagggcaggcacatccccttcccctaggcccactgttgtgaagcttgcccatctagagcatagagacttcatcttgcagaaatccatcctcttgcagaatgtgggagtccgaattgccaccagagaagaaccaagctgcccacagggtaataagaatccccagaaggagtctatatcattttttcaacaacaacatcaggattatagtcagacttctttaaaccaggatgaaccagttcttcagatggaaacaggggacaggggacccataacaggaacatatcagatgaaggctcaggatcaacagagagagcaccaggcccctgagcagcaaggcccttgctttctactcaagaacaatttatcaaaggaaagtgatgtgcccaagctaggggatgaaataaaaggagcatcaagaacatctcaagttatcagtggcagctgtgatgaactgtcagagaaaaaggcttctctgtctaccccccatcagtttgaggaacctgccctagtattaatctcaaaagaggaggcttctgggaagtcccagtttttcaaacagtacagccaaaaacatgaagcatgtaaagtaggaaaaccagaaaatgactgccacgataaaagtgaggccagcagctgcctgtcattgtctgggttactgaagacagagagaataaacgcagaggacaagctcctgggctgcgaagctgggctcgatattctgagctcaaaggaactagaggaccttttggcagacaagtccagaaggcttgcagctctgagctgtgacagcatgatggaggaaattatcatagggcctgagactttcagtgacatggttcatattgacctgaatgaagaggaggaatgtgctgctcacgtcctcaaggatgtctttgacaagtcctcttgtgttctgggtggctctcaggaggatgaggatgtggaaatcaagttttatacaagtaaactgggccgagcaattcaccactttcgttctgctctgcagggtgtgtttcagaagctggagaacagtgggtccatcagtcctgaggacctggaaagcaatgagagtggttcccagtcagagaacagtgatcgacttcttgggacagtgagttcagggggtgcccaggattgctcactggagagccctgggagtcaggggagtgaaagcttgctcagtgtggtctctggtggagttggcgtctccacacagggagagcaaacccctcaggatccaagcaccttctctcttgcttctaataactccttgccaagtgttgctctggctccatgtctgggaagtgagacttgttccaggcctggatctcccaagcagggcagactgagcctagagcaagtgtgtacagagaccgtttacctcaacaagtgcatcaacaattttaagaatgttctaagagagaaaagactaaggcagaaaaaacttctgcatgagctagtacagaaggcaaaccgtctctcagtagaagacatacactcaggtattctgagtcactatttaacagggtcccagctggctaaagtatgacctccatctggccagcatgagacctggtgtggtggccagtttaataaggtgttggttgacgtccatagcttgaatcaggctaaattactcaagtagagagcttaagctaatcctgtgggaattggagtgaaagatggttctcaagcaagaggaagcttgaattggagttaaagagggttctcaagcaagaggaagccgtccttatcttccagtctcttgttgtggtgctatacctgttcaaaagagggaggagcatctggagcagaagtagtttgcagctgcagagcttttaggatatcagatgtaaagaaggggtgggagtgagaggcaggagttggggatgacacatatttgctcacaggcactagaagggctgagaaagaatcctgtgttgcatttaaaaattcttctctgtggatttgttgctgagataagattgccatttccccagtagctgatggggcttctctcataggcccctgtgggaatttcccctaccccaggtacctgtctcttcctagtacctgacttgctgacacagaaccttatttctgatttggggcatccaggagctgcttatagtgctgacctagccctagagcccaacgttgccctccacaggtcttattccctttcttccatctccccctaaaagctgctcacctgcaagctggcaaatggaatgttttttgactacaggaagtaagagaacatttttctaggcagtttggagatatgtagctttaaaattactcttcccaatcaaaattaaatttatccaaagagcatatgctatattcatccagttttaaatttaaatggggttgtcctcttatgcatataacctgattaatcttcctaaggcaacatctaaattgtgaagcatattgtgttggcaaaggtgtgagggaatatgcacttgtacgttgctggtgggatgggagtataaattggcataatctctaaggaaggtaattggcaaaatttatcaaaattacaaatatatatataccctttaagtcctcaacaccacttacaggaatgtatcctgcagacacattttcacatgtggaagtgacatatggacaaggctatttttgaagcatagcttttaatagcaaagattaaaaataacctaaaaattcatcaggaattactggttaaataaattattggcacgtccaaacaatgggatatagtactgtgtagctataaaaagaatgtggtagctctttactgaaatggaaagttatctaagatatattgacatacaaaaaaaagcaaagtgcagagcagtatgtataagatgctttcatttgtataaaaagagggaaagaatacaatacacacacttataatgtctgcttgtatatgtatagattatctaatgaaagatatgtaagaaacggatacattgttgcccatggggaaatgtattaggtgaacaaatggaatgggagggagatttttctctgtgtgccttcttttaatttttagaatttgaatcatatgaatataatactaagccataaagttacatttaaaaaatgaaaattacgtcattctcttttcaaatttccctagagctccttcttagaacttatcaaaaagagtctaaattccttcactttgcattcaaggtcactgcaattggtctctagtttatatttccaggcttatctcccattgtcccaccataagtctttcaaaaggaagctttgctgtcatacaaatttgccttgcactttctattcttaatacattcatatatacatgcttccttctaacataaaatgctatgtttgccatttcaacctagcagaatttacctattcttcaacatatatcacctcttccaggaagctttctgaggcagtaatttctcagctgtgagggatttctctgtcttcataactttgcagcctctttttcttcttcccaggcaatgagaaattatttcagcacagcaacaatagaaacaacaaatatcaaagcaatacttcttacaagctctttaaatattggtgggagctgatgttagcatgagcaccaatgatgaggacacttgtgtctaactcttcagcttgcagagtttcctttctgggctgcatccttctaggcaatgcagaaacttgtggtgccatggtaggcaggtggtagtagcagcagtcttgatgaatagaaggaggttttctaaagcaccaataagaaagcaagtcacagttctgggtcctatccaagactcagtactcagtctggcctgagggctgcagacagaatcatggacagggtgctccagcactcccttgcatagagcaggacaagcacacaggccagactctcaccaacatagacttcactggagcagtcccctaacctagtaaactgattcagtatcacagagactaccagcataacgaagcttttgaaaactctgctttctttactgttctgcttgggatcttttaggccctaagcttactagttgtagcttatgattaatttgagttagttttcatcttttttttcttggtatgtgccaggtactgttttaagtactctcatgtgcattgtataaaattcaattcttttattcctgtcactccaccaaaatagctttgatcagggccattagatgtccaccatattgccaaactaatggttcattttcagtcttctttttatcagtcagcaatttgacacagttgatgatcactttcctctttttattataacagctttattgagttataattcatgtgccataaaattcaccttaaagtcccttaaaaagtattgaatcgaatggtttttagtttattcatagttatgcagacatcatcaccatctaatttcagaacatttccatcaccccataagaaacctcttacccattggcagtcactccccacttctctttgcccccagcctctggcaaccattaatttacttcctgtttctatgaatttgcctattatgtacatttcatataaatgggtttataaaatatgtgcccttttgtgtctggcatgatgtttttaaggatgctgtagcatgtatcagtacttcatttctttttctggctgaacaatatttattgatggacattttttaaatccatcagttggcggacatttgagttattattaccacttcttgcttattatgaataatgctgctatgaacatttgtatacaagtttttctatggaactatattttcaattctcttgggtatttacctagaagtaaaattgctgggtcatatggtaattctgtttaccatttgaggaactgccagactgttttccaaagtcattgcagtatttacattcccacccgtaacatatgaaggttctaatttctctacatccttggcaacacttgttattatcttttttattatagccatcctagtggatatgaagtggtgtctcattgtggttttgatttgtgtttctctagtgactaatgatgttgagcatcttttcatgtgctcatcagccatttttctatcttctttggagtaatgtctatttaagccttggaccacttttaaattgaggttttttttcgttttgtttttgagctgtaagaattctttatatattctggatataagtcccttatcagatatattatttgtaaatattttctctcattctgtgggttgtcttttcactttcttgacagtgtcctttgaagcatacatttttttattgtttttttttttttttttaaattctattggccaggtctgttggctcatgtctgtaatcccagcactttgggagaccgaggcgagaggatcacttgagctcagaaatttgagaccagcctggccaacatagtgagaccttgtctttactaaaaatcaaaaaacaattttttgtggtaaaatatacataacataaaatgtgttatttaaaccatgttttttctgaatattatgtggaacattttaaccatttaaaaatatatagttccataacatcaagtacattcgtattgttctgcaaccaccgttcatctccagaatgcttctcatcttgcaaaactgaaactctatacctattaaatagtaactcctcatcccatctcaccccagtccctggcaaccactactctactttctgtctctatgaatttgattgatctaagtacctcatgtaagtggaatcaaataacatttgtccttttatgactggcttattccacttagcgtaatgtcctcaaggttcatctatgttgtaatgtgtcagaatttcactctgaaatttcactctggaatttttaaggctgcatcgtattccattgtacacatgtatcacattttatttatctgttcactcatcaggacacacattgcttccaccttttggctattgtgaacaatgctgctataaacagtggtatacaaatattttttgagtccctgctttcagtcttttggctatgtaccccaaagtggattgatcaaattttatggtaattctaattttttgaagaatcaccataccattttccatggtggctgcaccgttttacgttcccaccatcagggcacaagggttccttccaatttctctacattttcttcaacacttgttattttctgttttgttttttttaagtaatagccattgtaatgggtatgaagtagagcacaaaagttttaaattttggtgaagtgcaatttatccatttttttcttgttttgattgtgcttttggtgtcatagctgagaaatcattggttaatctgaagtcagaaagatttgctcctattttttttatgagttttatagtttttactcctatatttaggtctatgatttttttttttttttttttttgagacggagttttgctctgttgcccaggctggagtgcagtggcgtgatttcggctcacagcaacctccgcctcctgagttcgagcaattcttctgcctcagccttctgagtagactagctgggattacaggcatccaccacgaagcctggttaattttttgtatttttagtagagaggaggtttcaccatgttggccaggctggtctcgaactcctgacctgaagtgatcttcccaccttggcttcccaaagtgctgggattagaggcttgagccaccacgcccagccagttttgagttaatttttgtgcatagtatgaggtaggagtccagctttattcttgtgcatatgggtatctagttgtcccagaatgatttgttgaaaagattattcttttttcattgaatagtcttaccactcttgtcaaaaatcaatgaccataaatgtaagagtttatgtctggactcaattctattctattgatattcagtctgttcttgtgctcaattccttctttttgaaacactttcttcatttggcttccagaacacctctctgtcttggtttcctcctctcccccaacattactggccattccttcttagttatctttgctcttcctctccccaaccttgtagcatcctgggattcaatcttgacttcctatgctcacttcctagatgataatctttcaatcccgagtttcataagcattcccaggtttatatctccaacccaaacatcttccatgaacaccagactccaaatccacgtaacacctccttatggatgtaaataggcatctcatttgacatatccaaagccaaactcctgatccttcttctgaagcccctgccaaacctgcctttcctattgtctttcttacccatgagtggcatctttattcttgcagctattcaggcccaatccatagagtcattcttgactctcccttctctctcacaacctgtattcagtccgttagtaaattccacttcctccacttttaaaaaatatcttgaatcttgccattatctctacctccaccactgtcatccttgtttaagccaccattttctctcatctagattactgcagtggtctcactgctctccctgcttctagaaccttgtccctctacagtctgttctcctcacaacaatcagagtaatccccatagagcatgagtcaggttatatcacctctctgctcaatgatttcctgtctcactcagaatggacaccagcattcttataaaggcctgtagagccctatttgaactggtactttattgcaaatttgctgtttctccacaccaattatgctctcacctcaggctttgcatttgctatatgttcttccgaaaatactttttcccagaactccaaatggcttctttactcatttctttcaagtctgctttgatatcacctatcagtgaggccgccctaacaaccattttttggatttttaataacaactctacctccatcatcagggggcattatctttttcccttatctgaatttttcagccaagttcctatcacatgtgacatagtatattgttatttcttatggaaagcagaccctggaacaagaatgtctgttaggaattttggctttgccacttgctggcatcttgcttaacctctctgatcttcaatttaattatcaaagaagtggaggtaataatggtatttacccagtgtggagttgtgagaaataaatgagcttacccaaataaaatgccagatacaaaataagtgtttgattagtatcagctactgtcatcatcttcatcattgtttattatctgctcctcttactaaaataaaagcttttcaggatcagggagtttgtgtcattcactgccacatcaccagcactgattgagaacagtgcctagtgtgcacattaggttcttttaaaatttttttagttaaaaattttttttgaaagacagagtctcagtctgtcacccaggctggagtgcagtggagtgatcagagctcactgcagccttgatctcctggtctcaatggatcctcccaccccagtctcaagtagctgcactgcacgtgcaggcacatgccaccactacaggcatatgccaccacacccagctatttttttcatgttttgtagagatgggggtctcactttgttacccaggctggtcttgagctcctgacctcaagctatccttcctcctgccttagtctcccaaagtgttgggattataggcatgagccaccatgaccagcccttagtataataggttcttaagaaatgaatccttgcaataaccctgggaggtagttgttcatatacctatctttttatagttaaggaaatgtaggctcaaataagttgaacgtctcaagtcttttgactctcaataatggagttaagattgtattattgggtatactgaggggagtgctgatgaggaggtatgtcacttccttataaaatggactgtctggaacagtgagagagatcattcttagggggtcagggattttcctgcaaagcagttgttttgtagacatttataacttaacctgcaaactaaatctaagtggaaaaatcctaaggcattttagggagttgggaagcacagaaagtttgattcttaagaaaaaaagttgttttttaatgtttgtccaacgggtaggacaaactgaatagccagtatagcagttcctcagggtctggaaaatggtacagactactggttaagagacttataccttctctggttgggcaagagacacttcttagaatagctgttgttttctaagtcctgaaagttatagttttcttttactacatagaaatgataggcgatgtgctaagccctcaggctacaaaggtgaaataatatataatccttttttctgaagaagtagtataaagtgagaaatattataaaggaagatgtttatacagacaactacaatatatgatactacaaaacagtattaacaacatactgtcttagaagtgtggacatagaatggtggagaccagggcagctagtggagaggcacttaatcctaccttgggaaggaaagcagacagaaatttcacagagtcattagtatttgaactaagtcttagggaatatgcctgagtccacccagtaggctgggtgtgggagggaggtgtgaaaagtctcagatgtgatggagaatgttcagtaagacttgaatacaggacacgtgaggagcggaaggaaagtaagctagaacggtaggggaagtacaaatcttgaagcactttatgtgctacagtaagcaacggggagaattgatgcaattaagcaaagaaaaaaatgcgatcagaatttcgaaatgggaaatgtggagtatggattggagaggagcaagtctagtggcagagagatcagcttggagtctcctgttatagtccagttaagagatgatagtggcagtgtgaaatggaaaggcagcagtggatgccagagatatttaggaggtaaaaagtacagggctgagtgattggatagggacagagtgcagagagggagagatccattgtctggctggggacaggaggagacgtttagagatggaagatagaagtttagtgtttggatatgttgaatttgaactaagcatgcgatatctaggtgatacacactaagcagtggttaatgtgttgtgataaagtaggtatctgaaggttaggtataactcctttgagaagtggaagagggagctgactaatggaagaagagacttatcaagtgacacagagggcccagttgaagttaaaaatctgcatctagggcggggcgtggtggctcacgcctgtaatcccagcactttgggaggccgaggtgggcggatcacaaggtcaggagatcaagaccatcctggctaacacagtgaaaccctgtaaatacaaaaaattagctgggcatggtggtgggcgcctgtagtcccagctacttgggaggctgaggcaggagaatggtgtgaacccaggaggtggagcttgcagtgagccgagatcgcaccactgcactctagcctgggcaatagagcgagactctgtctcaaaaaaaaaaaaaaaaaaaatctgcatctatttgctctggttctcatctgtacaatggtgggacttgtcaaggcattatgtgttaaataccaatgagaaggatgaatgtaacttaggtgcactaggatggccttattaactcttgcttgggtgggcatcagagaaggcttcccagaactatgccttggaggaagagttggattttcctctatggaaaggaggtgtgagatgctatttcaggctaatggaacagaatgagtaaataaaaatttggggttttgagtatgtgacgtctttgtgaaacaagacaattagattgtaggaatgtatatggggtcaagaaagagggcagaggagaggaatttggggatttgggccagatcatggagagccgtgacggctctgtcaatggattgatttgattttaatctttaggcattatggggaaacctgtggagaacagaaggacacaatcaactttgacatggttgtagaatatatttaagatagtgaagggggagaggtacatttccagtttgagtcatggggtcagttaaaggattgtttgcctaattttcttactcaaaaggaacacattatcctgggggggttgagatgtagatatggaagagatatgtccccattccagggagtgtctttctcatctttcccaccttcctggagctgcactgttttggaggattccttgtcacctagtccaggacaggtgacccattaagtaagcagaaatagcttgaaaaattgggaacctgtgaattcgattcttgaattctcccctctacttgtgatgtgacatcaatgggcctttaaaagagaaaagaaaatggaggggcactaatggaccaaggtgggtggactttccttacagaaggaagcctgtgggcctatccatgtatggcctagaaggcaatgtagtctctgatgaataggaaaggagtaatctctgggctttatttttatcctgttatggcttgatcgggcccttctggaagtgtcagtttcctttagagtattgtcctgggtttgataaataatcagatttgggattgcagtcatggttttatcatctagatcactgtgatttctattaggaaagcagccagtcgatgcccccaggcctgtagccattcagcatcctggtcctggacttaactccaggccctaccctggtccaacttaatttcaggtccgagaaacgggccagagctcattgagtgaatgcatggccaagcctgcattgcaaaatggaaaaggctcagtcaccagggcctttggagtttgaggacttataccagatctagaataagctcacgtggcttctgaggaaggaaatcactctgtgctcagccagcttagatagtctgttggagtggtcattggtaacaaatctggtcttgcaaccttggcagccctgacccttgatgcaggccactttggaaatgggaaaaggatgactggaacccctgggtagattttgtcccttgatttagtttggaacatctccagggatgttccaaactaaaaatcctgggccagcaaatacaggcaggaaggattctggaagccagtcagctgggctctatgaactgcctagttgtcccgaggacctctccctctcttccatgtcccttggagtttagctggcattttctttgggttccctacttataggactgactctactaacctttctgcccttttttctgctctttctctccttgcagaagaaaagcgaggagcccttcaggttgtgcctatgaccctttgggtcgtccttttttgtctatttccctcccctccttcccaagcactgtatgtgtgtgtgtatgtgtgtgtgtgtgtgtacatgcacatgtgcgtgcatgatctgtgcctctgagctttggctcatgcagtctatttttctgaaaagcagtttgtgtgcatgctccttgcttgtgtgtgctcctgcagatatccctggagcacactgcgagaatgtgtgtgcaccagcatgggtgtgcattcaatgtagcatgtgtgtgcttatactcagtttgactcccccagacactgattaccctccttttctcctactcagctcagtgtgtgtccattttctacctgttgctgcaaactctggcatatgctgtaaaaccttggctgagcccagcacgcatgtgtactttgtatttgagagcaggctttgctgcaggcatttcctgcctcttgcctgaggccctaagtgtgaaggtacttgtgctctgaacaggcttcctgacctctctgttgagcacaggcttctgtagccctgttacgtggtttccccaaaccatgtgaatgcatagtatactaatgccctgtgcttgcaagcactggctcttgaagaccatgagggtttgctttgcctgtgatttgggccatagtaaacactgtgaatcctcctcagatgagtttctgcagatcactgaatactctgaagcttatgttctgaagccataagcctaggatccatgctcaccatgtgtttccttcagacacaagttgtgtgtactatgtgtgcaggcttttgcagacatgttgttatcccttctgagcacaggaaatgtgcatgatctgagccaggttctcagactttttgtgactttgtttccttaagcccagtggtttctggcaaatatctcactctggataggaaataagaacctgctgagtacggtggctatttccagagggaaaataagttctggttggtaagatctggggatttagggattggctccccaacactcaacccttaccccttccataagcaaccttagaagacttgcagcttttctgttatttcccacctactgttgtttcttcccacctactgttgtttcttctatactatccccattgtcttttgcttcagccacttctggctgccttttggacctggccctcccattaccaatatcatcctacctatagaaaggataggaggcagatggggtggaatgggggctctggtccgtagggagataggcttgattaaaacatagacaacctaagaggagtcttaaatccaaaattcatgtgagcctattgctgacccaggtaattctccctcacttttccatcaccattagctctgtcctatctgtccctattctcctctgtattgcctcattgttatccataacttctccccactttagctctccaaaacatcactcactgttcaaagctaagcaccttaattctgcctcccttctggagctcatttgctccaggatagttaggaggcagggaagttgttgggagtggaagaaaacaaggaggggcaggaagccccagacctgttagcctgaaaaaagcatgtgctattggacctctggagcactctggcagctttggacctttctgcatgctgcttgaaggatttgcttttgtttattttgttttcttttggtacagaaacctttaaaaggtgatttttgaactgttcccttccttgaattatttggtgtctcaagtttcgacttctcattctagggcctatagaattcactagaatgataatccaagtgtctaatctaccctgggttctcttgttatgtagaatttattaaatagagagaatatacttagtgtcagtgagtcagaggttcaaggcacccaaactaaatccaaccacaaaatgagataggaatccagagagaccaggtctgactctgggacattaagggagtttaggaatatagctggaagaagactggactctatatgaaggtgtccttttgctttagtgaggcctggaagcctaagtaggcccttctcctgtgcttggtttactgctgtctacactaatggctcatataagagtgatatgagttctgccattccagtagacttcagccctgcaaactcagtgagctttgccctatctcctattcaccaaggagacaggtaccactcatttcagcagcctgcttgttgccctgactgatcaggacattggtttagatgtcagacaggctgtcaccacatggtgaatgtgacttacactgctctgggcttgtactctactgctcgctgctcagattacaggcaatctcccatctttcccaggatctaacttgtttcctatctctttttaaagattccagatgatggtgacccctctctgcctcagtggctcccggaagggtaagtaattcactgcaaggtttctgtggattttattcagtatctcttgatgcttttagcttttcccctgggaagcaggggaaccagcttcataagctgcatcctggggaaggaaaaggttccactataggttggttggttctctgaggcagaggagagaactctgctgatggattccttggaggcagaagagggaactttgcagaatggttaccctggtgcaggggagggagctttggggccttctcatccttgcctctataatttctggtccatcttttcatagtggtgaaatactctttaagtagaacaaagaggaaattagaaaaatatctgcatttggaaacattttctttccatttcatttgtttttaatttttgtaggtacatactaggtgtgtctatttatgggttacattagatattttgatacaggcatacagtgtgtaatactcacatcagggtaaatggggtatccatcacttcaagcagttatcctttctttttgttacaatccacttacactcttttcgttattttaaaatgtgcaataaattgttgttgactgtagtcaccctgctgtgctatcaatactagatcttattcattctatccattccattgttgatggtgtggctgattaagttactcctaggcttgatcctgctccagctgttgtgagtcatctacttattccattccactgtagtcaggatataagtaacacccctttctgagctctgtatgttctgtccgtgcttcttgtttgggagtttcagacctgtgtgattgtaccagagtcattttaagctgctcagtgtagcctgtaactgactgttcttaaagagagaagagagttcaagtaccttctcattccccactccttcccacaaataccaccaattagttatctagaccttccttttccctttttcctacaaaggcttctgacatcagaagtctcagtagttgcttcctcttgtggccagggaagaagaaagatcaggtagatgatctactatatttttacatgctcctttcccttgcaatttgtcatctttaaaaaaaaattttttttaacttttgttttaggttcaggggtacatgtgcaggtttgttatatagttaaactcgtgtcacagggatttgttgtacagattatttcatcacccaagtactataacaatagttattttttctgctcctctccctcctcctacccttcaccctcaagtaggcccgtgtctgttgttaccctctttgtgtccatgtgttctcatcatttagctcccacttataagagagaacatgcagtgtttggttttctgttcctgcattagtttgctaagaatagtggcctccagctccagccatgttcctgcaaaggacatgatctcgttcttttttatggccacatagtattctgcggtgtatatgtatcacattttctttatccagtgtgccactgatgggcatttagcttgattccatgtctttgctattgtgaataatgctgcagcgaacatactcatccatctgtctttatggtagaacactgtatattcctttgggtatatacccaataatgggattgttgagtcgaatggttgttctgtttttagttctttgaggaatcaccacactgctttccacaacggttgaactaatttacactcctgccaacagtgtataagtgttctcttttccctgcagctttgtcagtatctgttttttttttttttagtttgtcttcttttaatcaagggtgaatcattgaatgagctacccccttcttcttttattgaaagatcatttatgtttaaaaaaaaaacttcttgccttaagagatacatattgtagtttctagaattagctacaaagttgtggcatcagttgcttcttcagtgatctttagtttttttcttctaataattgtaaaatacacacatgtcaatgggacatatccagactacttctgaatgtagctatgtagtagttttctaaatgattccctattgtctttcttccttttctttcaccttcgtccttagaagctgtcctaagtatagaacttccctcagtctggtagtctcattaaaaacaaagcctactgcctatgttcagggagctgttttattagaaatcagcatattgagtggcctgtttcaactcctggacttgacccaatttgtggttccattctttgcctagatagctacaagtacctactttttctgttgggatatttctgtctttagaccagccgtggtatacagcccagctacccaactttcccaacgtctttgctctcattaaaaccaagtacatgagttctttgcattaaggccagagagttttttgttgcttatccatctcattttatagaagcgtcaccaaggcccaaagtgaagaaggaattttgggagaagacatagtacattaatagaagaactggagttaaaatccaggttatttcagtgtagtttcttttgggtacattttctgtttttattgcatattgttataaaagaacaataaaattaatcagtatagaaaaggtgtaaaagttttagaaatgtccagctgctgtagctgtaatttttctccaggctctgttgatgtgtccatagggctaggccacactcatacagtccctttgctgtttccttcctaaatggtgttttgttttgttttttcttcccttaggtggtcttttggaagtctctcataccacctcccctattacacttgattatgagggctcctttctccatggagaaggcttttcttcaggaggcctaggtagacagaactggtgactcttttactcttggatggagacggtctccttctatgtgccattgtctggtatagtcttactcacctagactcttgccgtagagccaccctgtgggttctgttctagcacagccttggcaagacttatctttggggagcagtgtctttgccctgaatgtggggagaagccctcttgagtgccaattcctaccttgccttatggagcataaaagtgccttcaaataaatagaaatgccttgaactatcactgggataaaagagcctcagttctcagctgaaactgtaagagacactgaggggtcctgtgagaacagattctattgctcactcttccatgactttatttccctgactttctgtctttccttcccgtcctaaaagcacatggtagaggtcagttcatcttcctctggggagagggagagcaaggtgaatggaacactgaacccaccagctaactcaaagcaagactgacggtcctgacatattttcttctctcctcaggccagccggagggctctatggcattgacagcatgccagatttacgcagaaagaagccactgccacttgtcagtgatctggtgagtgaagactcttgtgcaggcataggcagtagccttggggtatcccccattgggccttggcaagctgtcaggattggaagtcgtccatttaatgactcaaattgatctgatgatcaatcatttaaagccttcggagacttagcagtggcttcacaggggactgtgttctacctcactccctagtcagagtcctgaatttattagctcaagctcctacctggaatatttgtgacttgggctctcaaagttaggattttgtgtcttcctataggcatctagctcttataggtatctctacagccttctttgatgacctgtaatggaaattgcctccagcccttgacctcttgatcattgagcttggtatgggatgagcatgactggagcttgatgccttcttggaagtcaagcaaaagtctcttctcaagacataggcttttgagactatctctgtaacctagtgtcaggcactgagaggcaatgataaaaatttgtggaattgaattgaaacaggcttaagagttaaagctgatcccagggcctccatcccatcctcccaggatgaccagaagccccattctgggtcataccttctgaggcacaaacaacccaaggaattttctgtagccttgtgggtagttgggggtgaagtgaggtccaggttctctcagagctctaaagctagaaatcgggtgtaaggattcagttaaatgtgaacccttttcccttattaccattttctgtttctgttttcttttttctctctattctatctattgtttttcctaaccacccctcttccctcttccccatttcctgctccactagtttctccctccttagttgaccgaatgaaagtatcatctgccattttctcttcatcatttttcttcccttccattatttcttaccatttgttcatcttctcctttctctctctttctttctttctttttttttttttttatagagacggagtccctgttacccaggctggtctcaaactcccgggctcaagtgatcctcctgcctcagcttcccaaagtgctgggattacaggcgtgagccaccatgcccgactcctcctttctaatgtacctcttcttccactagctcttcatctagctggttgaagataaattctgatgccatgtcttcttcaataccattttcctttccttaatgtctctcatctcctcttttttttcttcctcttcttcctactttttttcctcatcctttctcactgtttgcccatgagcaagtatctagtttatttcttgctatccctctctgtcttttgccctatctttggctttatggcataatactccttagagtaggtgctctaggctttgggtcctggccagtggtctgggttgaagacagtttttagtggacagaagcagagtggattgggaaatgctccctgctttggactatagggaagaacctctcagttgcctctgaaagttttcatgccctttcgagcctttaacatcatgttgttcttttctctgctgtcctctacgcaggctatggtgagtgtctccagagccctttctcatcctctttaaaagtctgcatccctggctggttgcagtggctcatgcctgtaatcccagcactttgggaggctgaggcgggcggatcacaaggtcaggagttcgagactagcctgaccaacatagtgaaacactgtttctactaaaaatacaaaaaaattagccagccgtggtggcgagtacctgtaatctcagctacttgggaggctgaggcaggagaatcgcttgaacccgggaggcggaagttgcaatgagctgagatcgcaccactgcactcctgcctgggcgacagtgcaagactctgtctccaaacaaacaaacaaacaaacaaaatcctcatcccaaatcacttgggcccttcccagctgttcctcctgcttaggctgatattatgacttctgccttctcagcgtcctctgcctttaggaaaccatgtgcctctccaggggctgcccctaaagcttgggcttggcagatacatgggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatgggcccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatgggccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatgggcccctgtgcaagagtgtggctagcaaggcagccccagctctcagacttaactctctgtgcttggcagatacatggggccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggcccctgtgcaagagtgtggctagcaaggcagccccagctctcagacttaactctctgtgcttggcagatacatgggccctgtgcaagagtgtggctagcaaggcagccccagctctcagacttaactctctgggcttggcatatacatcgggccctgtgcaagagtgtggctagcaaggcagccccagctctcagacttaactctctgggcttggcagatacatggggcccctgtgcaagagtgtggctagcaaggcagccccagctctcagacttaactctctgggcttggcagatacatggggccccctatgcaagagtgtggctagcaaggcagccccagctctcagacttaactctctgtcctgcttgatttgactgaggcttcaatgcccttttcacttgccaagtgccctacttgtaggcctgctggcctctgcagccatccagggattatgtgggcttggggaggtgccaaggtatagaggttagcatggaatcatttttctccataatggctcttgaatgtgactctgacagagttgtgtgtctctattattcttaattacctgtttcctactatagttctaagcttttcattttcctttgccttcccataaacaaggagtttctgtggggtaggacactaagaagagtgaaagaaaaagaaactctttggatgatagataccctgaagaaagtgctgttctaacatagttagagcagccccctgagggccttgggttttgcatcttaacctgggacacttgtcacctgttagggcggttgctgtgagtgacaataaaaatagaaagtactgtagtaagctatagtcaagtggctttggtcactgaagctccctcccccagactttgccagcccttggcagtggtcagggctaacagcagatcttccctgacagtcactggtccagtctcggaaggcaggaatcacttctgcaatggctacacgcacttctcttaaggacgaagagctggtaagtgtcccaagtgctttcgtaagtccactggcctcaggactggtgatcatctctgtagccatgctattaataattgggaattctgggaattcaagagtgctggacacacattgctgatgaaaaagatagatagcatcaggtgttagttttccacactgggaaagactctaagcaagtctagatcagagagtaagcccaagtctcatgttgaagggtgtgaccactgaactcaaggttttatgatggacctagtaccttctgttttcttagaaagcgtgaatgctggaacaaggctcggatccagcatcaggtccaacctgtgttggacaaccagaagcacactatattgtgggcctcattctgctatgctgggctctgggctgggccaggatagagcatcttcttcattgccagaggagacacgaaatcaaggtcctgattgtcccacagggtctcagttctggtatctccctgcagaacccaaaagtcatggggaccaggcatgttggcttatgcctgtaatcccagcactttgggaggccaaggcaggtggatcacttgaggtcaggagttcgagacaagcctgaccaacatggtgaaaccctgtctctactaaaaatacaaaaattagctgggcatggtagcatgtgcatgtaatcccagctacttgggggccaaggcaggagaattgcttgaacctgggaggtggaggttgcaatgagccgagatcataccactgcactccagcctgggcaacagagcaagactctgtctcaaaacaaacaaaaaacaaaaatcatgggatggggtatgtgtctttcagaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgtgagtgccctgcgggatgaggggcggggagtggggcagcaggggctttccaaaatagtctgcagcaaagagctgggatggctgaaccaatcattcccccagtccacctgattctgaaaccctatccatttcagagaaggtaggattctgaatcaaggggcattgcctttccaaataacaggtcttacactaccttcttaagcacctttaggaaaaattctttgagctttctgtggtagtgtagctagaatcttataggattcagttgatcccagagactgagctttgtagtgtatacagcacagcggccttattgtccaaatgacaaaagcatcaggatctgaggctaatgagaggaaagaaatagagttttgtggggttccaggccccacagaggaacctcctaaagcctagaatctaggactcagggaaggcagcattcattacttgtttttagacaatagtgccagaaatagaaatgtcaaatgaatctggtagaggtccaagaggagagtataccagacccccagggccttggctaaatatatgacttgtcctgccatgatggagtggggacaataggagcaggaaaagcaacaagttcttgttagaggaaatggtagcgctcaaagttcatatctccttgctcccctcctgctggccttgcactcactgtggctggaccccaggaaaagcaggggtgaaggaagtgggaaactattttcctgccctccagacctcccaggtattacccacaagccaagctgtagcactgaaagctttaaagattgtgctaggagaagggaaggtcacctctagacccacaagtacttcattatcccaaggacagctatgacatataaaaggggaccagggagaggccttgagcaattattcatggaaaatgtcctttgaagagcctcaaattggtgccaatggcaaggctaggttagacgtgaagagacaggtaggacagagtcagcggaagagatgggctctgaaaagactgcctgaagacaaatgctagtaatgacttggccaaaatccatcatgaaggggtggcaagtgcaggtgccagagggcccttgcttaattgctgagaactagcaaccaggctggctgcatagtttctccactgctctgcagcctctcccaggccccattcctcagctcaacccttggtctggtaggtgacctgttgtgttcctggccaccttcaggggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactggtgagcaggccacagtttgaggggacaggaaggcctgggctatggggaggagactggggaagaaacatcctgagcgtgagggagcaagggattagggagaaagaaaaaggaaatcactgggaaggaaaggcctctttattaatcacttctccttacctagaccctggtgccggagaggcaagattgctatctgcaaacaacatgaaccataatacaaggatttgctaacaacctaacgctgtagacttggctaacagtttgatattataagaggtggggggagggggaaggggaagggcaggggaccagggagtagctaaccagtggtttgctaactgggtggggctgaagcatgtatatatcagagggtgtaaagatcaatatagagataagtggtcagttagggcttgggtagggagatgggatgcttgggctttaagggaaaggctggtggcccaggacaaagaataaatatggaggaatgggattacggtatctgtgcaaggagcatagactgctctaagatggaaagcatatgagtagtgttgtggggggcttctgaacgactctgaagcctcctatacatgcttgggttgcagtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccatttgtaagtcacagagagctttgtcttacctgggactgtgtgtattgggggagcaggatcacatcctgccattctgggcttgagcttgaagattgggcaaaggcaggggagaaaactcatttctcgcatgcttcgttcagacatcagccattctttctctggttttcttctcatgagctgttgtgtcaggattactgtgcccatgccctgtcttcaccagggctattaaaggggccctagggcaccccatcctgctttttctagcagtagaaagattttactactttactgctcagtgacagaaccagggactgactgccttattgtacctcctacccttgcctaggaaggtacagtagggttaggctctcataaggaaggctcttataaggagtggggagggagtgtccttgtcctaaaactgggtaattctggcttaaaagtggaaatctgggttctgaagaagatgctgtttcccataaagatagtgtttcttcctgcctcagcttctacactcactcatttttttattatctcactttcttacaaactatttcttatgacagtaaaggatggttattgaaaaatggcaaactaatgtctgagaatccacatgctttgtcgctccctaataaggcctagggtcaggattttggatttgaatcagccaagcaggctggctatgtagaggcctccttctgttggctcctcagaagattcagaaagggattaaggccagcgtggtggctcacacctgtaatcccagcactttgggaggctgaggcaggcagatcacctgaggtcaggagttccagaccagactggccaacatggcaaaaccccatctctattaagaatacaaaaataagccaggcatggtggcaggtgcctgtagtcccagcttactcgggaggctgagggaagagaatcccctgaacctgggaggcagacgttgcagtgcaccaagatcatgccactgtactccagcctggtgacagagtgagactccgtctaaaaaaagaaaagaaaaaaaaaagggattaggatatagtaaaattcatctctaatccagagataatattaatagctaccaggagaaacacctgtttgagaatctgaatagttcctgcttgaattcttcttatgactaatttaaaatgaactagctcttggtcatttttgcccacttttagtaaacagtttattaagctcatattctgtacaagacactatacataatacagtgtatccaaaaatgaatagaacaatccctggcttcaagaagctccttgttgatttgtctattatcttctcacagagcagtggttatactgtaatattttaatggaatgtggaaagataacataagaacatagggaaagtaagagcacattttgccagttacaacttttgggtgaaacaacagatcccagaaagcaactgttggagaggagagcttgagacaagacctgggaaaactcctttctccaaagcaaacccgatagacgagatgacaattcaatgggatatgataggctaatatagaagttcaccaagcacatagttaggcagatgagagagttagatagaaagccaaacagttataaccctatgggcctaccatgaacatgtctagcacctttactgacttcatgtcctgggctctgaggatggagctagcagttgcttcctggagctccgtggcatgtctagctattttcctcttggtgttgctgatacagctagctgtataggaagtcagaattgacctgaattactcttccctccaccccttgccctttgttctaggacaataagaactgtacagtggtagatagagccacccaggccgaggaatgaagagtcatttgctaggatagcccaactttcttggaacttttgtactgctgtcctctgacttctcctctttcagggcctcaagtgcagctgtcggagcttttgggagggaataggaagtaacaggatttggcgctactgggtctgcccctaacagagcctgcctaattctctcacagtgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttgggtgaggaaactggacccgagaaagttgcttggaagggaaagcatgaaggggacctgggaatagtccttctaccaaaaccaccatctgtccccaaagcatacctctatacagagcctgtctcacctgcaaagaactgactgtggggagggatgggggacagaggagtggcagtggctgtgagtcactctggctgaatgttctctaggtttcagaaggccctttaatcttcatactagtgcttttgtcccccctccacactcctgttctcctacccagctagttcaagggtacttgtggaatatgtggtcactggagtgattcaccctatttggtgagtccttgggttggccccttcttttccttgggttggccccttctcttccttgggttaagccagaatggaactatctatgctgtctagttgcattggtgtcaatctccagtcttctttccttcctagagaagaggacagacaaatcagccgtctcaggggctatccgactacaaatcagtgtggagatcaagggggaggagaaagtagccccataccacgtgcagtatacatgtctccatgaggtgagccagcccttggtaggtgggggatcagaaagcagtgctgggagaggcctttggccataagtaggattgctaggtggttggaatccgaggcccattttaaattttatccttgattcactctgttaccctggagagtccgagtgactgaactcagactgcattctcttccactaatgtgagaacagcctactggggccacaggaggaactgagcaatgactggaaggacagaatttctgtgggaccttgtgcacattcttctgggctttaccaccaagtttgtttttgtctttcatatgtgtttaacccattccctttctctgctctgtctcctgcagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgtgagtctctgctgcggcaccgggaagtggctactaatcactggggtggctaattaaggcacactgacatggtgggcaggtccttagtgaggtagcatgcagtgattcctttactttcctctctgagctgggtgagatgggtctatgccccaagacaagaagggtatatgtagaaaaagaatgttgtaactcacagaaaaggtatttctgtctgcctcagagttgagggaactctgcagggaaagaggcatgtgagagtatgcaaggacaacctgcctagacatcacaggcctgagcagacagggtatgtgtgctcgtgtacatgtgtttgtgacaaccggtctggcctagactggcctgggggttcaaagagaacactaaactgcagggaaagcagctgtgtatggagttgaccaggactccttgaatgggaattccagattgctatgagaagcagggtagcctttctgtcagtgaggctgcccctagagctgtgtgcagaaagtagccctaggcaagagagggcagcaattgccctggctgtgcttcatttatcccataaacttttagagttcctgcttggcttttgctgcaagccctgaagagtctttgaggctgcgggtgctgtgtttttcaggcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttggggtaagtatcatgtaaacacatatgtctgcatttgttaccaattaataaagtttgattttttttttttttttttgagacagagtctcgctctgttgcccaggctggagtacagtggcgtggtctcggctcactgcaacttctacctcctgggttcaagcgattctcctttctcagcctcctgagtagctgggattacaggcacccgccaccacgcccggataatttttgtgcttttagtagagatgggggttttgccatgttggccaggctggtctggaactcctgacctcaggtgatccactcacctcggcctcccaaagggctgggattacaggcttgagccaccgtgcccagccaagtttgatttttcttggctggtcctatagagttacttgatgtgcttaaaattcagatagctaccattttgatagatgaatcttgtttcctgtttccttatgggtatgcggactatactaatagcctctcctcacacacagataaagaagagaaggtggttgggggtggtaccacctgggcttggccagaacccctctgggccaacaacttggttgaattacgatagtcttccatattcttcagtcttgcaggtccacaaatggatttttaaaaatcttgttcagtctgtctgtgatggattcatattacttgagttgatatgagactgatgtctaagcaatgatgccagtgtgcacttgaacctgttccttttctagtgtccagactgttttccctatccagggtgtgcccttcctgggttaaggtacctgagaagttgagtcattactcagaatgtcacctgacattaattcagtataaactagataaaataattctgacccaacacaaaaattaccattttgggcataaagttactgatatcaccccaattcactgagtctatgaaatctgacttttttgtactaatgaattttttgttgttgatagagcctttctgtagatgtgtaacttattaagccagtcaaatatttgttccattttgcctcatctcattatgtattgacttaatcaacatctactcatataatcaatatatgagttctaggagtgggatgccaacatcctgcaggcatatgattccacgtttaattatactttttctatgaaaatcagctattaaaatagtatatgttagatattttaacatttaaaaagtatacacttgggaaatgtgtgtggaatgtggtttaaagagagaccccttcctgcctgtcctgttatctttcatatgcatcagattctccctcctatcatcactgctaggctgtggctgtataactgttatgcactaccccgagataagtcaggagacctcagactcaagagagaatgtgtttggagtttcttcttatctaactaagataagttacagtcccaaaggtatagagatgcactggtcatgccctattgactctcatatagaaggagccatttctccccccagggacttggctttttccttgtcagtgtgagatttcccagattgggacagagctgcaaagagatagaacagggactttctatctcattttttccgttacactgtttgttgttcttcccatgggcagggatgtgtctccaacccaatgcctcccgactctttctactcatccaggggtggttctgtttctgttatagtttaggggactcagacacaggttctctttttcttcccctttatttgtttctcaccctcagaaagagagatttgtaaaactgctggaccagctacacaactcactgaggatcgacctctctacatacagggtgagtgaagacacggctgtgggcaggataatagatatcaagcacggtcccagagagactgtaggccaatcttggctataaagattgaggccagggaaaactggtctgtgtcatcacatccacccaaatggccaatgctactgacacctgtggttcttttaactccagggaccatgtggtgtataaatagcagcaggtatggttagtttttatagacagttgtctttccaacctcattcttaacactctactaaactctctggtgacattctcattagggagtttcctgaggataatctcttccaggagtatccttttaaaaaattagatacctaattacatttcttttttgcatttttccatactctcctcgttttccagcggaggtgtgagaatctggctaggggacagagagtagcttggcttttgcaagtaatctgtatcagagagcatgtccattcctagtataaagggaggaaataggtatagtaggaggatggttactgggacgggacaggataaggaaatgggcagtttcttagttcctcctatgttagatcttagaaatggcttcattacttgctttaaagtgtgtgaattttcagaacaggcaatatatgcacattaaaaagtaagtataaaaacaaccttaaagtcaaaaagaaatgaggttttaattgtctgcactcaagtgccctccatttgcacaaataatggacagctgactgtatatcttatatttggcatataagtagccatttgaaggtttaaaaactgaccattaatgtgaagacaggctcagcatctcccttcagctcttcatagcagctccctcctaagactcgtgccaaagtgaatgaagtaaggatggctggaaattcctaaggaactcactccaaaagcagttctgctcagagatctgccatctgctggctgcagaacagtagaagagctgggttctattgtacaaaaagtacaggtcctggacctcagtttggtctgtagtgtggctccacttatattccaggatatacagttagattgtaattttcgaagaactcactgttggtgtgtaagaatcttcatccaagaaaaaagcatgtgtgtaagtttgtgtgtgcctgtgtgttcctttgtacaagtgcttatacattgcatgggaagtagggctggaggaggatgtgtcactttctagggtggggagtattaacccctgcttttggcaagagcctgtttgcatcaatagaaaaaagagaaggagacctgtaactttacagtgtttttggccagctcaactagagaaaaacccagtaggtaacaattagggaagcttttgatatcatcacttttggcagggaaggttttcatagtcctctgttcctttcttacatttgcttgatttgcaacagaataatttccctgctgggagtcctgaacggcttcaggacttaaaatccacagtggatttgctgaccagcattactttcttcagaatgaaggtaagaaatggactggggcttgggtggtgctgggctggagacctggctacaggaacgtgaagaatgagaatcattgggcagagtctgaggctacaggattcatcacctctaagcttacatttctgtgtacctgttccctgggttacttctgagagagcacatagactatggatccatgaggatggggtggaagttttccctgtcaactatcctggcaatttcatcacagggaaaagtctagggacccagacagggatgaaagaatctagagtaggtttggggtagtgctaggagaatatcccacccaggtgagcaggtccttgggcccatatttcttcttttaattggcaggtacaagaactgcaaagccctccaagagccagccaggtggtaaaggattgtgtgaaggcctgtttgaactccacatatgaatatatcttcaacaactgccacgacttatacagccgccagtaccagctggtaagaggttcaggatcaggtggggccagctgtcagtggctctttggagcctcagttttccttcatgatggtggtggaaaagcactcaggacaaagtacttgatgttctcaagggtgagtgagttgtggagtatgaaccatgtggaccatgtgagatatgtggatggaaagagacccctgggcaagatgagacatacctgaattgaacagaaatggcaacaataatgatgttgaagaaagtaaacctaaattcatgcacagttcaggggttgagtaggggaattctcagtccatcccagagtctttttttctccctcaagtttaactttattctgactcttgcagactcttgtaagttctgggcttccttcctctgagatctgaagtggtctctgagctgctggctcctggaagctttacttttccctctaattacttctctctgaaatgtgtggttcttctgggttgtattcatccactggctatcaagactgaccctatccttctgtgaggctgagctacttcacctgttttagcctggcaccctaagtcagtacctggtgacttagtacattttcccagatccttctaatagtgtccccgatccatgctcccaacttatttgaaagccagaacttacttctagctccaattactcaattacagttccaatcttaggagtttcttgctgaccatacatttgcagagtggattcccttcagtccaacaaatattgaatgtttgttctaggccaggtctgaggagagcacagtgctccttcagtaagtttgcagtctcataaacatatatataactctaatcaaaagagtctgtttgaagggccttgaaaaagggataagattaaaggaattccaaggaggaagagtcttttcgcactcttgatcagataccaggaaaagctacataaaacaaggaacatttgagatagaccttaaaaggcagtgggatttggacaaccaatgatggcaggacaacctaaatgtcttggacatttatctttaagtaactacatccaatttgtaaagcttcctaggaacaccctcataaagactaagatcttgttcctactgcctcttctcattcccaagtgtactttctgtgccagccatgtatttaaggcttcttccttttaaggtttctaaagcctcctgttgattctgaaatccatgggaggttttcctgaggcctttgttttacttgatacattctaggctcctctgtcatctgtctatgaagtctctggttgaggaaagacactgttctcataaactattcagggatactctttagcctttgtattttagtatctgctttttactttctctcaatttcattttttccttattccatatttacactggcataaactcttgatgtcttttaaaatttccatctgttgaccttcagtcattggtttattcgtccattcatttacttaacagagcattagagacataaagttgagtaagagacatttcagcctttggggatctcatggtttagtggaggtcagggcaaattactacatttattgtttttttgttgttgttattttgttgttactatgttttattgtagttgtagttttctgatacatctacaccaaaggttcacagagggtgctgtgggagcccagaccaaggatgtcaggaaaatctctcagaagaggcaaagttcaatctgaattttgaggaaggagtaggaattaactaaagaaaggggctggagggaaggggcataccacagagagaatagaatgcttggaggcacagaattatgtatgagcttgttaatttaaagaaatataagcaggccgggcgcaatggctcaagcctgtaatcctaacactttgggaagccggggcgggtggatcacttgaggtcaggagtttgaaactagcctggccaatatggtgaaaccctgtctctactaaaaatacaaaaattaggcaggcatgatggtgggtgcttggaatcccagctacttgggaagttgaggcaggagaattgcttgaacccaggaggcagaggttgcagtgagctgagatcgtgctgctgcactccagcctgggcgacagagtgagactccgtctcaaaaaaaaagacaaaataaaaataagataaagaagtatagcaatttagggtacttacggcatccagctgtgggattcagctatctgggatcaaatcttagttctgctctttaaaactgcatgactttggacaagtcatgtaaccttgctgcccttcactctcctcatctgtaaatgaaggtgataataatttctactaaatggagttgttgtgaggattagataggataatgtgtgtaaaggtcttagcagagtgtgcggcacataataagcagtaaataagtggtggtggtgtggtaatagctggaacaaaaagagttgtaaggtatgaggttgagagtcatattctggaaggtgtaaactaaggaatttaaactgtattgaacgccgttgaagggctttaagcagaggagtaacacattgagattttctttgtagaaagatcacgatagctgcaaggaggagggattggattgaagatcaaagaccagttcagaaatccttgaatgataagagcctgagccaggacagtgacagaaaaataaaaggaagagatgtatttaagttatattaaagattctgtcctggtttctaggaacttcttgataatgcaggcttattaaggactgtggaagctttccagtgacatatgacatcccacataaaggccctgttcctgtccttctgggcagctccaccttcacctttgacttagtgggagataatgtgtgttccaccctccctgtggtgactcctacttcacttttctgggctgtgaatatagagtgatttctctttacctgaaagtcaccattgtattcccttgcctcttcccaagtaaggccctatcttatctagttaggcagatagcttcctagatgcagttcttccccctaataacttcaggggatcaagggaagtcctactccactgaaaggctgaaatgcgcaccagatctgttcagtagctcctgcagaagttgaaagagcttctcagagctgagatgtgtatgtgtgtggtcgtggtgtgctgtcagtagaggaataccaccagaagaggagggctgcctgcctgtaggggccgcatagaagtagacctatttagtaaggctggaggggctgtttcctttagccagcgagttactctgcccatagcaactgagagaaggaaggaggatgggcatccttatgtctcttggactgaccaagtttatcagagagaacttctcagcgataggctccctgtgttcagggatctcacaatagtcactcttacagaacagggatagtcttgtggaagacaggctctaggagaggaaaggtccttgattctagaggaagaggtataggaaggggaagagaaagaggatcgttggagacaccctctacattctactctgactctttctccctctctctcactgtgtcctctggatcaagaagcaggagctacctccagaggaacaagggcccagcattcggaacctggatttctggcccaagctcatcacactcatcgtgtcaatcatagaggaagataagaattcctacacacctgttctgaaccagtgagtatcaccctctttggccctgtctgttggtggttggtctgtccatctgtctaacaacctctttctttcctgtctctgtatgtttgcagtgccacctcttcttcctgtccatccatctgtccctctgtcccttgtatctgtctgggtaactgtttctggagacaggtgtggaaacataatgggggtccctggccagattgagccagcttccctggagtgagagacttctgggactgggactgccataggagccccaggggatccagagaccatgtgtgtatgtgtctgtccactgtgaatgaagtgggccttcttatagcccacccccacttgccctttctcctccagcttatttagcctgcgcctgctttccagcctctgcctggagagtctctacctctcaattccctgccttctgggcatcttctgcccccaggcccatcttgcctatggggatcccttctgccctcacttgtcctgccactggcccctggcccctgggccccttttctccagattggacctagccctgttccctaagcatctcctctctccaatatgacttccaagaactaggcactttagccttgaaatgaatcaaatcaaatggctcttgccttattctctgactgtggtttcttctgtcatccaggtttcctcaggagttgaatgtgggaaaagtcagcgcagaagtgatgtggcatttgtttgcccaagacatgaaatatgcattggagggtaaggatctgttcaaatcagtgggctgccaggctcctagcccaagctcctcgttcactgtccctttcctcttctagacaactacaagttctgggtgagtggtatagtgagaaactaaaggaattctaggcctagtgggatgtaggccccgggagaccttgggtgggcaaagttgcagccaaaggacatatgaaaatggctgtgtggatgtagcttcctccttccagctttggagcaactgcctgttcaagaccttcccagcccagagatgaaattctcccatggtgggtgttcttaggtggcccacttcctggagaatggtcttgggaaacttcagttttaaagaatcagagaaccttaaatacacagatagatgtaattgttttcttatgttggggactctctggcctggcttttcttgcaagctgctctggattagtatgacaatgccaggaagatacttcttccctcacttctcctatagagcagggccacaggcaaattattattcatcttactcattcagcttgttcttttattcatttcctaccttggtccacaaagatatcattccatacctgtattagaccttcctatctgtacccatctgtactcacctatttagcagcgtttcctgccattttatgtgtggtagtctctctactcagtctgtgaaagcccatctaggaggaggaggagccatctgggcaaggacaaagcagagtctggatctgttatttgggtgggatggcagggcagatgagccaccctcagatgcttgaatgtgtgaggtttagaatcagtgagtcttgagattgaaagaaaccttgaagatctgtgttacatttgagccagccacagactacacgcatacattctgtaacacaagcccagagcagggctgcctgctgtcaggccagggaggaggtcattggtctctccctccagatgccacttagtgagcctgatggggagtacagtctcagttcttgaagaactctggctccagtgggtttgggggaaaagagaaaacacctgtgaaaagtgaatcaactccacaagagaagtagtgtgaggtggggcagaggttttcaaacagaagtatcttaggagctaagttgaaggggaaacccagaggctaggctccaggcctcttgcatgatgacagctcagccagccctgcatttatcaatcttacatggaattctagctgagatttcttttgaaaggggagttctgctaatgtttaaaacaaacacaaaaggattgaaaacttctactttaagagaaagaattaatgttggcctgatttcatacctcaatttcaccgcctatgtagcactgtgaatttggtccaaactacttaatttttatgagctcccattttctcatctgtaaaatgggagtgatgatagcatctgtttctttgaactgatgaagtactgagatgtatttagcatactgcctggcacttactcagcactgactaaatcttagttcttaagaacaataagaaaccattgcaggctcttgagcagagatgcaatgtgaagccagcagtattttaataagatctacctcagtgggagatgagggcagctagaatagggagagactagaatcagagaacgcagataatgaagagctgttgtaataatttagggatagagggtgctgggattagagaagggaagtggagagaggagaatgggctttgatagacattggaaggaagccagaacaggacttcgtgattgtcagaatatggagggcaagagaaggggaggagttttgggggcctggatgataggagagtggcattgactctgactaaaccaaacaccgcatattctcactcataggtgggaattgagcaatgagaacacatggacacaggaaggggaacatcacactctggggactgtggtggggtagggggaggggggagggatagcattgggagatatacctaatgctagatgacaagttagtgggtgcagtgcaccagcatggcacatgtatacatatgtaactaacctgcacattgtgcacatgtaccctaaaacttaaagtataataaaaaataaaataaaataaagaaaagggtgaaacattaaaaaaaagaaaagaaaagaaaatgctgtccgtcaccaaatattttgtaagtcaacattattaaggtatcatttatagacaatacaataagaccactttaagaatacaatttaatgagttttgacaaataagcccaactgtgtaacaactctcccaattaaaatatgaaacaaaagttccttcttgccactttgcagtaaatccccactccattcaccaaatgtttattgaatattttctctgtgcctggctctgtgctggttattggaacccaatgagatgaacaaggcatagcaccatcccttaagaaactcacagagcagtctagaaaacagtcgtataaattggtagttacaacacaaagttataatgccacaagaggagtaagtatagggtgctgagagcacacaggagaaccatgtaacccagattctgaggacctgggaaggcttcctggaggaggtgatgtacaagccgaaacctgaagggtaataagatttagccaggagggtggtagtgacaagaaagggagacacagaacatttcaagcagaggctacagcatgtccaagacctggggtctagagagagctggcatgcttggagaactggaagcagcagttcagtgtgactagcacttcagagggtaggggaagagataagtaagacctgaagatggagaggtgtgacggagtcagatcgtgaaggaggttgtaagccatgcataggcttttggactctctctctttttttttttttttttttttgagtctctctgtgtcacccaggctggagtgcagtgggctgattttggctcactgcaacctccgcctcctggattcaagcgattctcatgcctcagccacccgagtagctgggattacaagcgtgtgccaccacacccagctaatttttgtatttttagtagagacggggtttcaccatgttggccagtctggtcttgaaccctagcctcaagtgatccacccccctcagcctcccaaagtgctgggattacaggtgtgagccaatgcatccagctgacttttggactctatcttgaggtagctgggagccactgacatatgtcaagcaagggattgacatgatcagattattatgtagaaaggccagtcgctctgtctacagtgtggagagtggattgggaggcagaatgaccagtctggaggctattatagtaatccaggttacagatgggggtaatgagacctaggcaggtaatagcgtggctagaaggaatggatagattccagagacatttggaggtgaaatcaggggctggcgatttaactgggtatgaataaagaggtagaaagaagatttgaggatgatgctcagcattgaacaagagggtaagattagttggtgtactctgttccacttcagctggagattttaagatagtgagagacaggggcaagttaaatctaggcatgatgaaatgttccatccgaagcttatataggccaggcatgggggctcacgcctgtaatcccagcactttatgggcctgaggcgggtggatcacctgagttcaggagttcatgaccagcctggccaacatggtgaaaccccaactctactaaaaatacaaacattagccaggtgtgctggcacatgtctgtaatcccagctactcaggagcctgaggcaggagaattgcttgaacccaggaggcagaggttgcagtgagcagagatagcaccactgcactccaccctgggtgacagagcgagactccatctcaaaaaaaataagaagtttatatagacgttaccagaaccaaagagagattagggggagataccagcaaactgggtagttgaaatcatgaggttggaagagctctccaggaggaaaggagggagttaggtggaagtcaggggcaggaggttatggattggcctttctgacagattaccccacctcaaacaactttactggagcatgactccatgggacttgttagaatagtttaaagtgtgaccggtgtttcagaacttgtcagttagtttttataccagagaagttaatacagaaattagggataggggccagagtgcagataataaattgacagagaaagtgaaaattatatgtagaaacagtaacttgaaggtccctaaaagaaagagttagggagttatggagtgatgggcagtcctgcttgaaaaggaaggaggagggccctcctgatgtttctaggttcttagactggttccagaacagcaggggatgggggtggaggagaggggctctcttttgatgtccctgagggtctctctgatgtccctgattttttcactctctttgttgctcattggtgtctgctctgtcacaagcaaccactgtcattcatatacgaaaagtcctctttctgggtggtaagaacatttagttgtccttttgcctctagtcttacaccttttccctcttctcctgctcactgcttcatagaagagactgcaaatgcaactttaggttgagacagtgctgcctgcagtgccagggaatgaaattcctgggacttgaagccctttgaggcagaatcccgggcttccatttcctccttcagtgtctgctacactagttcacaagggccagctgccccagcctggatgttccgccttgacttggaggagcatcacccatggcaactcaaagttgagcaacaaagtccccaaggacagtggccttctcttctctgctgcttagtcctctcccacatttgcttgcttttaccattatgttgatgtgtcagcatacaattgatttttattattcaaattagtgcttcaactatgaagcgggtagatgaagagaacctatgggtgtggccagtgctccagactctgagcaaattgtgagttatctttgtcttagattttccagaaggctctggagattcagcaagatgacttttcaaattcgtagtaagtgccccattttctgcagcatgatatgtcctttcatctggctgtgtttccatagtttccaaactgactattcatatttgcatacttccctgagaattcattttttcaatgtctcagctctgccctggagcccttcagtttgcctcaagattccattacaccatggctgcccaactgctctgtcaacttgggcccagtttgattttccctgtctctgtagttgtcactgacccattcatgccatgtacacctgctcatctctgcctttaagcctgtctgaaggatgactcagctactgtgatcagaaaggccctggaaaaccattgtcctctacagtcatgggcagtctccctactaatcagcatcagcacccatggccctttctcctcttctacaccagaggccagatgctagaacaaaaagaccacttccaaacgctagagcaaaaagactgcaggctttatctgggagtctggcttagtctttctagaggaagatttgggccaagcttgtggagagttgctgagcagaacactgttggggagagatggctgtgagaaggaggttgggagtcacccttgtcctaagacatctgatggagctgcctgaccagatctgctgccttgggaaggctcaggaaccatggcctctactgctgggacctgacccaacctttctccctaccactagagcatgagaaagaccacctgtgtaaaagtgctgactacatgaacctgcacttcaaggtgaagtggctccacaatgaatacgtgcgggatctgcctgtcctccaggggcaggtgcctgagtacccagcgtgagtcatcatgtgggcactacagagggaagggagccctctgggtgggcagggctagtatccccaattcatttcagcaagccagtctcggggactgcctgttcaggtaccaccgtagacaaagaaaagtgttaaactgtgccctgccatcccgaggaccccagtctggtggagctgtcaggaagtggcgtattcccaccgctagttctaagcccctgttctcctgctgtggctgcaggtggtttgagcagttcgtgctacaatggctggatgagaatgaggatgtatccctggaattcctgcgtggggccctggaacgagataagaaggatggagtaagtcaggggctttggctgcaccgggttcaggccaggtctcccagcaattagctattggcagaagttcctgggctttggccaggatggctatgcctgccctgtggagttcacaggagggctgttgagggccattagccactcttgctggtcagagccttttcaaactctacaagcttgggaaaagatagcagctgtggatggtgaccctgtgtgtggtcttccttagttccagcagacatcagagcatgcactcttttcctgctctgtggtggatgtcttcacacaactcaatcagagctttgagatcatccggaagctggaatgcccagaccccagcatccttgcccactacatgaggaggtttgctaaggtgaccataactcttcctactccctcccccttaccaccaccacactcacagtctcatcacaggcctgagctcagcacctctccactgtggcctcctggtaaagctcgtgtgacccccattctcctttgctggtttctggggcagacagatggttctgtcttagtgctgttctgtggttgagagagagctttctcctgtactgtgggattccccctttacctccctgttgttattgttctgtgatgagaagtgccacctcaggcaagatccccatagaagagctaagagttccctttccttttctttcctttctcctcttctcagaccatcgggaaggtgctgatgcagtatgcagacatcttgtcaaaggacttcccagcctattgcacaaaggagaaactggtaggttcaggccctgggactcttacagaaagagagtggaagacatttgaatccttgcttttgaagctgtcctcagaattgagggttggggtgacactcctgatgcctgattcccaccatggctttgcttcagatccatgccacaaaattacgagaacttgacagagttcctgtgagtctcatttggtacattatcctctgctaagctagacctttgcttagtcttttttttaatatatatataaaaactttagatattcagaaagttataaaggataatacattaatacttgagtacctaccacccagcttaaaaatgaaaacatttgcttttagtcaaggagaattatctgaactggccccagctcttagtgctgagggagaaacctatgtcatatgtgaagtccctgtggcttttgtgagagagggagggaacctaggctaatgggtcctatgctgaaaggagccaagactcaacagctacatctgtccccaaagccctgcatcctgatgaacaacgtgcagcaactgagggtccagctggagaaaatgtttgaggccatgggaggcaaggaggtaggtcttagggtttgggagtcactgtattttccctttattcctgagctccttggccatagaactccaccctctcttaactaggtgtaggccaggaatttagcttggggtctgggctggcttaatctgaggtaggcattcgggtaaggccctgcgagggaggaataggcactggggtaagccctgcaaggaagtagtaggggtgtggcagggtagaagagggtaagaaaagcagcctagccaggcttacctcctgtgaatacagctggaccttgaagctgcagacagtctgaaggagctgcaggtgaaactgaatacggttctggatgagctcagcatggtgtttggaaacaggtcagtgaccccacaatacaaggccctcagagccagatgtggtccctagccaatcccagagcccttgccccacacctctccatatagctgcaggtgtgtggatcttccctgtactcctgctgactgtccctgctggaaatgcaccatgagcatatgggaatgggaccaaatagctggtgccgctccagggacagtgtgtgtttggggagggaaaggctacactgcgggcacatgtgtagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaagtgagtacagcattcaggactatcctgtggggatgagcaaagcagatgctatcgggcaagggagccccttggggagaggggttctcaaactctcaccctggtctcacctgttgcctggacttgcagcctcaccctctttgccactgtgtgtgagaagacggttctgaagcgtgtactgaaggagctctggcgcgtggtgatgaacacaatggagaggatgattgttctgcccccactcactgaccagacggtaaggacacctccttccacttcctcctgctgtctcccttcccctcactccctgcttcctgatggagttggggtcctctgcttttgactgattccctctctgcccagggcacccagctgatcttcactgctgccaaggagctgagccatctttccaaactcaaggtactctgggtgtggggtcctcctggcaggtgtggtccttctgaagtcatggagagagggtggctgcggggaaggaaattggagctttggagactgaagaggaaaaggaggagatgaatatgcactgggggctggcaggtgggtgcaagactttcatgactgctgtgagctgtcctgatgctgctgatttctctgaacaggatcacatggtacgagaggaaacacggaatctcactccaaagcagtgtgcagtccttgacctcgccctggacaccatcaaggtggaggccccccctttttcagacagtcttaaccaccacactcacttggccctggcattccactctcccagaccaggtgtccctccaattcttaacactccacatccagaagagagttactatgtactgccaaggatacagaatcagatatggttcctaaattcaagatgcttatcattggtaaggtgatataaggcaggaacatatgaactgtgcttcaaggcacctgggagaggtatgtcataggtctcaagttctctaaggttcagatgggtaaaagagcacttttggttcttctccgtgcctgaagtgtttctattccatttctgtgcctgtccagaaagacccatccttcaaacactgccgtacctccaggaatgtggccatcccctactaatcctgccaaatacccaaataatactcatccaagagcctatgctctggttctgtgggtgttcctgaacagcctattctcacagtcctcttcttgcttctctgaggacaatgttggggagctgctttctgtaaggggatgaagcagtcacgggtgctcttttatcttgcagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaaggtaaggccctgagggctttgggtatccacctctcctctctgatacacatcttcccctagggagtctgtatcttcatgcccttgggagcagatccagttacttcttcagagagcccttcaaattcagatctctattgcttgatgggacctcagtacttacctccaccccatacccattaccaggcaggagaatcacagaggcctgggaaatatgtctaagatttcttttcccagacattgcctggcccatgcatgtttattaaactcaaggaatataccctgactggtaagcggcaagaatgaaaaatctgtgaggaagccttgagaatgaatggaagccatgagaaatgtgaaggctcatagtgtgtggagctttgctgggagttgttctggggagagaaggcaaaagactttccagactctgcagcatggatagggagacaaggaagagaggcaaaccatggcagctgctgaagggagggtgtggatcctggggccctgtgcacagctgaggctccagtctcaggggtgctgtttatgcacaggggacccaggaagccggttttctcccagtgactttcagtcctcagaacccctccctacctccagcatggcctgtccaaaacaaaacacatctgcatagatgtagctcaggttgaaattctgacgctggagcagagccctcccaggaggcacctcaggcacatttgttactgcttgttccaaggaaacctgagcaggctgcctgggggagtgaacctggtgggggaagttggcgcttaggcattactgagctgtgtgtgaatctggggcacagggctgacctagaggggagagggctctaagcaggtagactggtgatggaaagtaagaaaatggaagggaccgaaagtactgctctattccccatctgttctcatttccaatccagggagggaagaatagagagcaaaagaagagctgtgagtctcacttaagtggacaggtagaacttttacagagctgggtacatgttcaggcatacaccatcaaggaagatctgagttaatccagaaaggctttttagaagcattgagctttaagcttgataaaagatgaggagagcctggaatgagcacacatatgatgagagcagggttggcaactgcgggaagaatccatgtgtatgcgtgtgcattttctacccgttgctttatcatttaagggtctaggaaattaaagcctacagcctgtctcttgtcctgcttgtctcagatacctcctctctgtatttttctactgtttctgcccatgatttggttggtctctgacccatgaagtctaatttggagcattcacacactgactgcagctctttcacttctttctccactctgccccacctctgtgctccctcagaatatgtgtagagctgctttgaatggctgttaactccttagactgctaacggattcttctttctctgttctgctgctgctactacctctgacttgcctgtcctcattcagtgcatgatgggaaaggtattagatttactgctaatgaggacattcgtccggaaaagggtatgttgtacaccgtgcagatatggatctaacatgggctaacactgacccctgggagctagaatgagcaactcgtgctgggggtgggggaacaagctgtcaaggtttaggagctctatctcaagtcttagagatgggtaatgccttcatatagcccaggaaggggttctgttgttgatctctgtcgtattctcagcattctcccacccctccacctcaggacaaagaaggattttctctggggtgtaagattgtggtggtgttttctttttttctttttttttttttttttgagacggagtctcgctctgtcgcccaggctggagtccagtggagcgatctctgcccactgcaagctccgcctcccaggttcacaccattgttctgcctcagcctccctagtagctgggactacaggcgcctgccaccactgccagctaatttttttgtatttttagtagagacggggtttcaccatgttagccaggatggtctcaatctcctgacctcgtgatccccccacctcagcctcccaaagtcctgggattacaggtgtgagccactgcacctggccaggtgttttcttaaaatagggtggggtctctgctaaggggagcctgtagattggctcttttcagagattggaactggggagttcattctatagaggggcccaggtttgagggggatgaagtatttcagagcacagcagcctcccaagcagggacctctaggaatcctgggcataggtgggaggttgctgcttttggctagagaggacccacatttttccattaagagacactaccaggtcaacataattcccagacacagatacaaggtgatggcactgccctaccccaacgtctttcagttaaaagtccttcagcctaggagataagagttttggggatccttgagagagagtcttagtgcacttttggaaaatgttgcgcctaagatgctgtcagcttaacttgtgttacaagacacagccttgttctttatcccatttctttcccttctcctattgcttacttcccatggttactgtggtgattgcttcttgcttttgggtatagggtggtgacctcctcacccctcaggtttacctcctacagttctccaatggggaatcatctctccatttgtccctcagggtctggtgtggacgatcctgtgggagaagtctctattcaggtggacttgtttacacaccctggtactggggagcacaaggtcacagtgaaaggtgagtgatggacttacaggtctgccctttccttgcccagtggcctcactcatcactcaaaagcaggggctgctcatcccagccctccagctcagccctcctccaaggggaaggtcacctggggttcaagaactgggaaatcctggtgggatccctcacaggtttcccttgtttgggcagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttgtaagttacgggggggacatacaggactctgggatgggggtaagacttgaggggtggggggagaggagggcccggggggatggcagactggggtgaaatcagctgaagactcaactctggcctcataacttctatcttgtgctcacagcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcctttggggtttggtaattctgctaatgtgtggaaagccatggaaatgactgtcctttataatggtagattttggcctaatggtcctttgctgcttcacactcctccacccccatacctgacagccagtgggtgaagcctaaagtggttctggataaacaccactgggctaacatcctgtcctagacctgagaccaccaatctaattaacagagtcatgggacctacggcaccagcttcctacaaaaggtccaaaagagtagcaggagaggtattctggtgaaaactagtccatgcttctcttccctttgtctagaatcactaggacagatcacagcctgggttgtgaggacaaggcaggggcccactggggagaggtgtgcctgcccgtcttggcagaggactgaggctgccacagacaggacagaagattaggcttaggactgtaccttggactttcattcaggctctattcgaggaagaagagctgcagtagaaagcccactcccaaaggggaagaaataaggtaaaaggcctcatggcgtggaaatgggaaaagctgaaacaagaaagagagtgctcacctactctcaacctgcactaacactacttgtggggcagggactaatggggcaccagacagggaactagctccgtttccactgcttgctaaataaatccttagagttcagttgctcatttaaaaacttcctcctccccgctcctctcccaagccagccacttaacatttctgcctcaaaattacctcttgaatccattgggtcgcctcaagttcccaccaccacaagagtcgtggcagcttttaggtcctcatgcctgagttactgtgataatcccctgcttccgttcttaccctgctctcttcacgcactccaatataaagtccttctcctattaaactattcagtggtcacccatagcctccaggctgaaactccaagaccctccaagatagcgcagccggcaccgccccccttgcccctatcctgcagctgttctaaagtactgccccggcaggtccccgacaagcactgtgtgctcctacccctccgtgcctgcacatgctgctccccttgctggaaaatctgccagccttttccactgctttctaggctctgctatctggacgcctccccacagcactctacattgttataatttacttgtctctttcccctcatcagcctgtgatctacccaaaggcaggatctgagtgttgtatctccatttccccagcggccagcatagttcgggtacttcaaagccagatcggcccctaggggccctctccatggagaaacggtgggtctggcacctgagggtaggggtgtggccagaggcgggctcatgggagatgggcgtggtttgtgggcggggctctgctctacgccggaacctgggtctctagggcgtctgcgcaggaaggtgcgttgagatggcagttgccggagttggaggccgggcggcgacggtgagcaagaggctcccaaagtgggtgcccgagtagaagttatcgccttctccctcccaatattccttgaagagagactgtcccctctcagtatttccagtagctgtctatccttatactttcttgagacaactccccatattcgagtatactggttttccagacactcccacagaggacatatttgtcgagattatctaaggaaggggagctttatcccccatgtaactcctaaagggcacacatttttccagttatttcatgaagagatacccccaaagctccagcaattgcacattcttgttaactcagggagttttccacttttccagcactgtgcagattctcgaagaagtcataatccttgtcccatacttgatctgaagtggcacgtttgctatcattccctcccactctttggcataggatacctactctagagggaagaatcaaactctggctggctacccatggcttcagcaagctttcagatttgaattag

SEQ ID NO: 13114 - DNA, 19857 bp, Human
tgcccccgcttccatatgtgagtgtaggcaagatacttcctctctctaggcctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctcgtctgcctactacatatacttgcgtgggaaggcttgtgaccgtctagttgagtgctagttgtctatgatgccctttcctgacatcgtctaccttatgaacttgaagtctgggtatgaggaaagggctacaggaatcctcactttggaggcagtggctttagtccttcacattgcctgaatgcagagccccaaagcccaggacagtgacaatgagtggagttgggtctgaagggtggtctagataggcctctcaggacaagggcaggtacctgttacttagagacaggcaggtttctctcagagtaactcttcactcccttcctaattccaaattctagaaattcgactcgtcttagtcaaatgtgtctgtgtgggtacagggtgaaaggtgaattgagtcagcatatcaccaacagctgcctgttgactactaacagggacccctgttatttggggcccaaggattttcaagtcccagcatatgcagttttcttgctaatttgggttctactgaattggctgtgtgttctgtggttgccctttgacttctctggatttgagtgccttattataaggtattaatattaatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcagggtaggcccggcggggcctggccgtgggcgcgtcagagaggtggagaccaggaaagagggaagggaagctagggggcgagtgaggggccgtggacccggcaggcccggctggggccagctgcgcacccgcgcgccccctaggcggggcttgcgttgggtccgggtcggagcctgggccggatcgtgctgtgtcatgcaggccccggcccgcccgattggctcccttagaacggacgtctgggcctggccaggtcttccggcccactccgccggggcggcgccccggggctttggggcgccagtctgccgtccggcctaccacccgccgaaagcctttggtccccggagagagcaggccccgcgagcccgaggccccagccgggcccggtgggcgtggactttgcgccatgtgaaggcctcaggagctctgccaccgaggcggagcccggggtcggggaaggcccgccgagctcagggaagctcacagccgcctttttggagccgggtcggcggggccggaggtgggcatcctctgtgtgtgacctgagtcgtgaaggactgttagggagagggcgagccctacctttcgcttctggtcttcttactttaggcctgttgttcatactagaaagtttgagccagttttccttaatgttatgactcgtgggtggggagaaaggaatttttctttaacattttaggttcttgctaaagttggaatctcagttcgtgttttgtgcgcctttccagatttccaggtttcgtggtgtgcagtttagagttgcactaactcttcaaaaacacaaacgtgcgcgcactcctttccccaaccagctatattgagaaattacccgggctctggggctttctgaccccacctccatccttaggaaagcgttagataaaacttggctacctcagcccattcaatttagaatagagagcttttagaggcaaaaaaaaaaaaaaaaaaaaaacacagccagcccaaggaaactctatgcaaattaccttccttccttgaagagattagttttttgaggtgtgttcctttttctcaagtttctgaattcggataaagtattactcagttgcttatttaaaagagtcacttattctgaaagtattcttttggtttatatgcagtcagcctcttattttcaaaagtaaaaatctaaaattcttggaacctggcatcatcagctgtttctaacctcttggtcaccttgatgactcttagctgaaacccttccaagtcccgtggagtcccctgtgcagttctggaaagggattgacttatacagaagacaatggaggattgccccaaagagtgtccagaactgctgttggcccatggtcaggccaaattcagtcttttagagattaccacatctgatctcagtaggtagatggggaattagaggctttaccttaagaaaagggcataccactcatctccagagccagagtccgggatggtaggcagaatggaggttttcctaggatacagctttgagattaaaatacaaactattgaccgggcacagtggctcaggcctgtaatcccagcattttgggaggccgaggcaggcagatcacttgaggtcaggagtttgagaccagcccgggcaacatggagaaaccccatctctattaaaatgcaaaaagtagccaggcatggtgatggtgcacacctgtagtcccagccactctggaggctgagacaggagaatcacttgaacccagggaggcagagattgcagtgagggagatcgcgccactgcactccagcctgggcaacagagggagactccgtttcaaaaaataaaaaactatggtgactagaggcatctggcgttttatttttctccagtcccagttctataagtcaagcaagaagatgggcagtccctggaagagtattttgatgggacaggagtgggagagctcgtgggtttacattgctctcaactgtcacattgagcatgcttggcctctagtgtgttgataagcattggaagagtctgcctactcagcagcattgtgcctggagtggcagacttttggaatgggggaagcaaatttgagcagaggaaactgtcgttagaaactagtttagaggcagtggttaaaaatgcagcctatgtgtgagggttagcagaaggcctaccattttgttagatgaatggggtttgtttttctcttgggtgtatcaggacccaaagatgtaagaaccccatggcttcctagctgagcacagcatttttctttgtctcttgcaaattgtgaggatatttccaatgggaatactattttgtcttgttttgttgacttcagtatccccagcccttagaacaatgcctggtacataatagagactcatgaatttgttgaatgaagaaattcgttttaaaaatttattttctttgcttccttcattgtctggccttcctactttggttaatgcttatgttttcctgagccttactaacacgaggccgctcttaaaaaagagagagcgctgggtgctgtggctcacgcctgtaatcccagtactttgggaggccgaggtgggcagatcacctgaggtcaggagttcgagaccagcctgaccaccatggtgaaaccccatctctagtaaaaatgcaaaattagccagttgtggtggcgcatgcctgtaatcccagctactcgggaggctgaggcaggagaatcacttgaacccgggaggtggaggttgcagttagctgagatcgcagcattgcattccagcctggacaacaaaagcgaaactccatctcaaaaaaaaaaaaaaaaaaaaaaaaagggagagggagcttgctgagtctagtaagtgacagctggaaacgggctaggtaataagttggtgtcactgtctggtgaatgatcctagcttctaggaaataacactgagtgtagacccagtcgactttgatttgggtgagagggatttggatttgccccatgtctcagcatttcttggttttgattttttgagccaactttatggaattgtgtacttttgcagatattactgtgaagttccttttgaccttgagcctctttctggcggtttgatgtctgttagtgttttttccaaatatgatggtctttatgcttggcattcctttggtactatggaatgccctggcatcagtaggtttagcctataaggagggtagcaccaatgattctgcttcgttgtccccaggcttgcttggtagaacttaaggcctccctgagcctcaagggaggttgtctggcttacttaattccctggaaagttagcttatgctttactctatactgttaatcatggtgaccattaataccatgtgccaggtattatgttaagcattttacattcattatctcccttaagacaataagcctctgagataagtattatattccttcttttatagaggaggacatcaaagttcagaggttaggtaacttgcccaagatcacaattaagcagtggcataattggaattcagacccaatgggtctgactatagagttcctgctcttaaccactcttctgtaagtctaagactatttttatttctctaacaactattcagcctccatttctattatgtcttcttcttaggccattattttctgaccctggggcaggatcactcacttggggccttatagctgggacactgacgctcaaaataccaggagctgctggaatgggtattgtaatatgtatggtagatactgctcctcgtgaccttggctgcctttccttcatctgagctttctggtctagggacagcttcatctattcactgtttctttcctaagtatgagttttagagactggcgaggcgcttggggcaggagtatctactgactccatttcctccttctagttcaaaaggtgatgacctatcaacagccattctcaaacagaagaaccgtcccaatcggttaattgttgatgaagccatcaatgaggacaacagtgtggtgtccttgtcccaggtaagctgtggccacagactagtctttccttactgcacttacttgagggattttcccaggtttcttttctcatttttcttgcagtgactgcagatagagtggggtttactgggaatcccaatctccagggctgctgcttactccccgtcagcccaatgacccaaaggccttaactttctttcctcagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcaggtgtgtgtggggtttttggcttcacagggatgggaggccagagatagcctgcattacaggcaggacccatgtattacaggcaggaccaagttcttggcacctgtcgatgcaggaagcctcctggtcatgggaagacttatgcttcagggttgtctttaggttttggttctgcctccctgggacttcaaaatccatttctgcaggtcccttgagacaaattggcgttcctgtaactttcttgatggctttattttttcctactagaggtgtaatttatcatacttatatcctggcttaggataccactcgagggtgtgtatgtatatgccaaataatctcctcactactctcactagtatgtctaattgatggcttgtgttggggttggaatgaggtgggggtatgggcatggaaggtgagctgctagcaggtcttttaagcccctaagttaacccgggagagaggaatagttggagccagacctgggatagctctcaatgtgagtgattttgcttgttcttgcataattttaggcaagaggttaccccatcttggagtcatctctagccactcctacccaaccaaccatcacctggccaggatcatctcaggcttttgattcttttgaatggagtctaagtttcatgtagctttcttcttgggagtgcttagtcacttcctcaaggtgttctgaccacctggctgagataattttgtttttttcacttctgtttcactgaccctgacaattgttagcttaagaccttcccttgtaatattgggtcaccagtattagctagaaggggatcatccttggatatctccctgaagaccctgcatgtctttgtggggtttctaaatgtgtggctcttgattttggctcactgattaggagtgagtggggctgttccttcgccctcacttccaccctgttctccttcctctcttcgcctaaagccatcctgccttttctttttcacttactatcagctatctgtgccaggcccttttggacacccagtgcttgggcccgaagtgtggttggtaatatggagtctgcttgtcatcctcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggtgagagctaattctgagcttaaggattattgactgtagggaataaaccttggaacatctttatctcattttctttttcttttttttttttttaaatcttttatgcttttcccctgtatttatttattcattttttaagagatggggtcagctgggcaccgtggctcacacctataatcccagcaatttgggaggctgaggcgggtggatcacttgaggccaggagtttgagaccagcctggccaacatggcgaaaccccatcgtgggcacctgtaatcccagctacctgggaggctgaggcatgagaattgcttgaacccaagaggtggaggttgcagtgagccaagattgggccacagtactgcagcctgggtgacagagcaagactctgtctcaaaaaaaaaaaaaagagacagggtctcactatgatgcccaggctggtctcaaactgctgggctcaagtgatccatctgccatggcctcccaaagtgctgggattacaggcatgagccatcaagcctagtctcattttcttttcttttttttttgagacagagtgtcgcgctgtcccccaggctggagcgcagtggtgcaatctcggctcactgcaacctccgcctcctgggttcaagcaattctcctgcctcagcctcccaagtagctgggattacaggcgtctgccaccacgcccggctaatttttgtgtttttagtagagacggggtttcaccatgttggtcaggctcgtctcgaactcttgacctcaggtgagccactgtgcccggccgctagactcattttcatatatttgtatacacacacatgcaaaccctgcacacatattcatatgtcttaccctctttttttcctccatccttcctttgctccatctctccccttctctgttccaggagagtaagctatctttatggatctctgaaggagaaagtggtccattttggctgggtcagggtccagagtgcacagttctaccattggtggttgtagtgaaaacttgggctacctatatggcagaagtcagaacttgatgggcttctgacatgtcaggttttgttcactgacctcttgtcagagggactcttcacagtttacctttctcatcttgcctgctgcttattaagacaggtggggtggagttggggagaggtagggcaatatctaatgaagggcactatctaatgagcttggcattttgaccccagggtctgatgagttctcactttgtcttgtagttgacacctctaactgtgcttgtactgtttgctctcgcaggagacatttttcttgtccgtggtgggatgcgtgctgtggagttcaaagtggtggaaacagatcctagcccttattgcattgttgctccagacacagtgatccactgcgaaggggagcctatcaaacgagaggtgagttttctccctgattccagtatccgattttatgattactcagtgtggcatcatgtggtaactgtcaggactgggtgctcggccggctgcggtggctgacacctgtaatcccagtactttgggagactgagatgggcagatcacttgaggtcaggtgttcaagaccagcctgggcaacatggtgaaatcccatctctactaaaaatacaaaaattagccaggcatggtggtacacatctgtaatcccagctactcaggaggctgaggcaggagaatcggttgaacccaggagtcggaggttgcagtgagctgagattgtgccactgcactccagcctgggtgacagagtgagactctgtctcaaaaaagaaaaagactgggtgttctttggagaactaaccatctttcagggatgagaaacctgccagctattcatttctgggcctaattgtttctcggatttacctaatgccaggaatttcaaaaaactagactgaacccaaaatatataagtgattgaaatcatttttgaagtaaagctgatggtggcttcaggcctctgcccattcccagggtttccagcttcagattttagagaccccttctcagtaagactacgagtaatgtgagaggcaaggactgtgctagaaatctttgccttgggatttttgtagttgttctttgaggccggatccctttagaggagaatcttttttaaatttaatttaatttttaatgagatggagtcttgctgtattgcccaggaactcctggactcaagcattcctcccacctctgcctcccaaagtgctgggattacagatgtgagccaccatgccgggttgagaatcttcttatacggtaggtttttgcacactaggtagtggaatgatttagagaaactcagcttttgctgatataatattcttgccttctcctttctttatctcctccatattcaggatgaggaagagtccttgaatgaagtagggtatgatgacattggtggctgcaggaagcagctagctcagataaaggagatggtggaactgcccctgagacatcctgccctctttaaggcaattggtgtgaaggtgagcatcctgggctctggaatcaagtctaaagtggtgccaatgtctaatcctgtcccaatgtctaatcctgggactgttttcatgcatggctttcattattgccttggattagaggggcaataacgtatcctttagtttacctaaggctctaaattcattagagctgatggtctaaaaccagagtaggctaatcaaattgtctgttgtgtgcgtgtgcgcacaaaacacacacacatatatatatgggtttttctttacaactcttagaatataaaagccattcttgtatcaatggaccctgtaaaaacaaatctcaccatagtttgccagcctgtctagagcaatgtcacccagtagaagtaaggaagttaaggaaattttcagagtgttaaagggttctgagtctaaaacatttgagaactactggtctagagtgtagcttctcaatcttttcctagtgggaaagtgtttccatggaacacactgaagatgaagttactcattttcctagtgggtggcacacaaataatttcattttctatgtggacagtttacatgttctgcttgtggatgaggccatagaaagggtagtgttgaagaagaaaaatgatgattgtaaggaacagcattccagtgtgataaattctggagggcatgattactggagtgagtgatcctctggcaatgaagaaaatagaccctgctctcttaaatggcttagctagtctttggcccttggtctgtctaaaattgagcccttagtgtaatggcctcttgcctttccctagtcatgtatcttcaaacgcatttggactacagtttctctgcccttagtctcctatgcaagttgcaatcataaatgttgcccactttctagcagtattttccctgctagtaatagaaatgagtgtggcctaaagtaattgtcttcttagcatttactgcggagggcttattcttaatattgtcagggttgaagcctgattctcaccctctctggagcgctagtcaagccattttagggtttgggagaaggtgggaacctaatcacactctgcattggtccacagcctcctagaggaatcctgctttacggacctcctggaacaggaaagaccctgattgctcgagctgtagcaaatgagactggagccttcttcttcttgatcaatggtaagatatttggttcatcttatgtctagctagacccaattttgaactgggcttatgagctggagcacttatgaacacatcctttttgcacccatgccctccttcatgtttatagcatatttcttatgctggggtatgttacagacagaagagcaataaagggaagatattttacattggtgctccctgtcctgccccctttgagaaagattgtggacagactgcagagcgggagcaagctagaatgagaaatcaaagggtgaatggttagtgatttgagagggtttggggcaaatgaactttgatcactggctcttggagaatgctgtttagtggtgtgccatctggtgtgccatctctcctgctctagccagaggtcctagagcatttgctgtcacctttacagttcaactgtgagaagagtatagtgagtccctgggcttctctccagccttgcctggtggctgtcctgggataatggctggtagaggatgtgagaagtaggcagaggttaccaccttctcacccaggacctgtctctgggccaaacaagcaagataactgatttttgggaggaattgggaaagactatcattttgttattgtctccattctgtatcctttcaggtcctgagatcatgagcaaattggctggtgagtctgagagcaaccttcgtaaagcctttgaggaggctgagaagaatgctcctgccatcatcttcattgatgagctagatgccatcgctcccaaaagagagaaagtaggagcttacctgaggggatagaggggggttgaaaggccctgacttcacttctgaccagacatcctgttctggcagactcatggcgaggtggagcggcgcattgtatcacagttgttgaccctcatggatggcctaaagcagagggcacatgtgattgttatggcagcaaccaacagacccaacagcattgacccagctctacggcgatttggtaaggactccagatacttttgaccccgtccttgcttaggtcctacttctctccttcatctaagtcacctaatcctcttgaagcccttcacagtgattgggtccaggggtctttttcctttaccctacgtcctgtctagagtgaccaaccaccctggttttcctgagactgaaaggtttcccagagcttgagacttttttagtgctggcattaggacaatcctgtgctggctgagatggttggtcaccctaggcctgtctcttacctctggactagagatgagccctgtttactgtttgtgtactgtcccacaggtcgctttgacagggaggtagatattggaattcctgatgctacaggacgcttagagattcttcagatccataccaagaacatgaagctggcagatgatgtggacctggaacaggtgaagtgatgatgatggctgaccaggcgttacagtgtctctaggcagttgctgggaactggctagagacataaggttaagatgtgaggagatgggttttgatttctggacaggggaaaggaagtaatctgagattgaatccaggaaatgggagttggcatttttcatagttgacgctgcatttagagtaaatcagaattgttggagcagccttatttctaggtcccaagtccagaattaagtacttaaaacccagcccataaaggtattgatagtatatattcaaggaaatgagaggacccagggatagcagtcaggggaaggattctattgtctctgagcctcctgcagcagctgggtctttgaggcagcatagtaagtagatctttctctgcaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccgggtaaggaccacacccgtgcctcaggtacacacatacgtgctttgacccctcccttggtaagtctcatccccagttttccctccttttctagtgggccttgagccagagtaacccatcagcactgcgggaaaccgtggtagaggtgccacaggtaacctgggaagacatcgggggcctagaggatgtcaaacgtgagctacaggagctggtccaggtagggcaacttggtccagggtgagtcactgtctcagtacattgtaattgatctgggtgatctcagggtgtcaacacatttgctgcaagagttgtgagagcacgacttaggaacctactgttcttaggtttgaggcactaaggagtcttcttctagagaacctggatctgataccattgggtacaccatgaaataatggaggggatgcttctgtttagttaggtttctttcaaaatgtggaggtagccttgaaccctctttccttttcctcctagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggtgagctgcaataggctgaactatgtattgatttgcctgagggcaaggaatagaggctgtttttctttaagagggttgaaatattcttagtgctggctgctcaactgcacagtaagtcacttgattttctttctgaggtctgagagacctagtgttattttttttttctctctctctctcttgagacagggtctggctctgttgcccaggttggagggcagtggtacagtcatggctcactgtaaccttgaaacctgggcttaagcaattctcctacttcagcctcctgagtagctgggactataggcatgcgtcaccacatctggctaattttttattttttgtagagacaaagtctcagtatgttgcccatgctggtttcggatttctggcctcaagtgatcctcccaccttggcctcccaaagtgctgggaatacaggtgtgagccaccacgtttgcctagagacatctagttttgttagtgcttgaatcaatccattcctcctacaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggcaggtgcaagatcatgggctgtgggagacttgcatgagtcctcaggctggtacggagtgctctttagtttctggacaagattccactggggttagggttggtctaaagggaaggtagaatttttgaggatatcaagataatctagaatcaggaataaaatggggtggccaaagaaggggcaaactgtagttgggagtgctcgggtagcccaaagatctgcgtatctcgagaggagaggctaaatgctaaggtacctctgctgctgcttttaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggtgagtctgcatcctttccccagatgtgccaatcatggagagccaggcagcagccaccaccatgccctggagttgagagtagaagctgttggaaagatcatctaactgagaagaattttaatagggcatcaaagataaagaatgctgaggtgaatccattcaatttggaataaggccgagaagagatggtcaggctccattctcagtctgaaccaagctccatgagggaaatcaaagtatgagagtgcagcaaacacagcaaggttttttttgttttttgttttttgttttttttttgagacgaagtctcactctgttgcccagactggagtgcagtggcacgatcttggctcactgcaacttctgcctcccaggttcaagcgattctcctgcctcagcctcccgagtagctgggactacaggcacatgccaccatgtccggctagttttttgtattttttttttagtagaaacgtggtttcaccacgttagccaggatggtctcgatctcctgaccttgtgatgtgcccacctcggcctcccaaagtgctgggattacaggcgtgaaccacagagcaaggttttgagctgagatgagactcatatacttatccctgatggttggggaagggatagggtccacagacctcccaaaatgaaaaggcaaattcatgtgtttgtaagttccataaaggtaagatctctgtcatctcacttgttttccactatgtcttgtgttacccttaattaattcattaagttccaaacatgggacttaatgagcaaataaatggctttctttcccttttgaagggtctgtgacatcccttctctctcccataaaagcttaacaactactgatgaactaatcctaggaggtagtcacataagtcacagaaattggcctctcaatggaagagataggttttgagctgggctgtgaagagagtagaatttgaataaagggaataagcagcccaaataatgtgctctagtagtaggattgcaatcattgggaaaccctgggtagatttaagagtatatatgtcactggaagtgagaccgctaggtaggatgtaatccaaatgtggtaagcactgaaagccattggcatttccttttaaagtattaaggtttattaaggtatgatataaatacaataaaattcactctttctatataccatttccatgctttatgacaagtgtgtgtaagttctataactactaccacagttgagacttaaaatttctactatctcaaaaagtttccttagccacttcagtcaacatctcccctccttaagccccatcactgatgtgatttctgtccctacagttttcccttttccagagtgcattgacaagtttttaagcagagcagtgactcaattttaggaagcatggcctagcatcttacctcaggttggattggaagggcaaggagaccaataaactgcagtaatgggaggcctgggatgaaatccaggctgggctttaactagccctagtgatctgtgtttaccaactataggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcaggtaagttggttgggagcattagacagtgcttaagttactttggggacctacaccaaaagggatgggagtcctaaggaagctagaggggtagttgtggaaatcttacacaggccctgtcctaaccctcttttttggctttgctcttgtacacagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaattttagtattgaatttttttttttttccaaacagaaaatagactatcctcttcaacagtaatcacttagtgcttctagggtcagtacagtgatgccttacccagagagagagtagtgcagagaaaataaattactaaattaaatatatgttgattggctttgggacataatctcaaaagacagtcctgaacaccgtaattttgaataaaatactgtaatctccaaagatcaaaatccctaaagtctaaaattctgaaaatcacaatcccaaaaggtcaaaatcccaaaatacaattctggaagaaatactaaacattcttcgaaaatttacttacatttttaaaagcgtatttatttgagaaacaacacaacagaacgtttcataggccactgcacgataaaatagggaatagtaacatttttgcaagataaacactcaggtataccaatgacagttgcacggatataacggtgatgagcagatgaaacattcataaagaaataggtcaaaaagtgaaatgtataaatgctttgtcactatgcttggtaattgtgggcacctagctttatataactggtcatctgtaatactgtgacagaaaacctaagtcttgatgagatggttcaaaaactgttgcgttaccactgcattgtctcccaaagagacgaggtcttgagaaattttatccttcacaaatgcacgtgtacaaaaaacagatgtctcttcgtttattgaggaactttcaacatttttatgcacacatataatgcttacacacagagtcaacattgcggtcatggagtcaaatttttaatgtccaaggcaccagaagaaaaatctgtcctaggctgggcatggtggctcatgcctgtaatcccagcactttgggatgctgaggcgggcagatcacctgaggtcgggagctcaagaccagcctgaccaaaatggagaaaccccatctctactacaaatacaaaattagccaggcgtggtggcgcttgcctgtactcccagctacttgggaggctgaggcagagaatagcttgaacccgggaggcggaggttgtcgtgagctgagatggagccattgcactccagcctgggcaacaagagcaaaactcaatcttaaaaaagaagaaaaatctatcctacctcttagagaccaatttgccttctgtatttgttctctctgggcccccgcctgttggatggtacccaccaacattgaaggcagatcttccccactcagtccactcagacttacaaactaatccccggaaacaacctcacagacacacccag

SEQ ID NO: 13115 - DNA, 27057 bp, Human
gccagacctctcagaaagggtccaggaaggctggagtgagatggggtgggagcggcactcactctcaggaaagttcagttcagaggcaagccctgtgttgcggggtgcggggagccacgtgccctaccctcccttggctgctcgtgggaaaaggcctagaggttcgggccgagaagaggagcgaaagcacagagccgacttcccctcacccatctgggaaatgggctcgggccaactgctgacttcgcgctcgctggcgcagctccctgcggagacctcggcggggagggaggctgaacatctggatgacatttctgcgagagcggctccggagcggcggtcggggagggagaggtgcgctcgtgcgcacgtcgggccgggagggaggcgattcctcggggcctgggtcttgtttttctcgctctctaccgcagccccttctcccgcccctcagcccccaccccgcagcccccagcccccgagcctccccggctcccgaccagccgagctccttcactggcggcctcgcctcgccagagggcaccctcgatcttccggaaaacgccaccatttttcactgcccctggagcgtctccaggcttctgcccgcctcccgactccgatcttgtcaatgaagaatcgggccaggatcgccgcggagcggacgccgaccctccgacccggctcgcaggctgggagtcccctctgcgaggctggcatggccgcccctaccgggtcccgcgccctctgcggaccctgccccgggttgggcctggcccgcgggcggccccgggaccgggggaccaggagggagagtagacgcgggccgcggacggcgcggactgacagctggcgagagggcgccggggctgggggaaagggagggagggggctcatcggagtaactttccagaaaaacagccaacgtgtggcaggagtgattccaagaggggaaaaaaagttcagctaccacgtcgaacgagaggactcgcaaagtatttttcaaaagggctcggcttttcctgtgcctgtttaaaacattaacatcgtgcagcaaaagaggctgcgtgcgctggtccctccctcccccaccccaggccagagacgtcatgggagggaggtataaaatttcagcagagagaaatagagaaagcagtgtgtgtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacagtaagtccaaattctcgctggggtgtctgctctggagggtctgaactggagctgggagctctgcagaggggggcctagtgctggccacacagcagggtgccccaggattcaccagcaccaaggctcaggatgtgcgatgctcctccgttggggctggggaggtgggtggggaaggagatagagccattctgttaagagccggcgcttctgggaggccaggagccctggagctgagtggcttgctgaattcacatcacatccttgactgattttaatttggaattacattgtgctgtccagggaaacatatgtattcttgcacatgcgatcgtatcagtaactgtaagcatctgggtgccataaaggggaaggccggctctgtcaggagcccttacggttctcagtgtggagacctcatcttctccctgcttttcacaactcattgtgacacgtctccgtttcagtttttccagttcttgggaagaagaatacctgccccaaattaatgtctgtcaagctttttgaagcccaggcaggagacagcttcttgctgcctgggccctttggtctaccccacccacgtgacccacgagacccacgtgagctgtgtgtgtggaaggaagagggtatgcacgaatgttcccagggccgtgtactttagggtgacatgcagtcttgtgcagtagacagattcatgtgctcaaaatgggcgccctccaggccggtgggcacggggagagcgggttttggctgtggatgcgtagaggaggctggcgccctttgtgtctgcgtgtcacgggagagcgggtggaggggtggcagtgggtgcatggtgggggggggggatatgtctgggagcctgccgtcccaggaggctctgtctgcatggaggagccgggcggcttctgggcgagatgtctgtgtgtgttggtacacgtgtggaagtcatatgtgtttactgaaggggattttaaaaacctcaatacaagagagagaaatttggcagatgttgagaaactgacagcccaggaaagaggaatgtgagccactcgtgggccgtagactccgggagcagctctgtttgcttttcctaccagcaggtgtcctcgccgccctgactacctcagcccaggcccacctgggaggtgggcagctcctggagtggggtggagggcatgggatggagctggcaggcaggggagggtggtcagcagagcacacagcaaggggtgaaaggaacctggctggagagaaggaacaggagtgggtaccgatgggtggaccagctctggctggaggtgcaaaggccccgttcacggctccacgccaggcagaggagcctgtggttactggcgaggggttcccgctccagcttcctgtggctgcctggagcgcctttcttcaggatgtggctgccatgtggggcggaggctggaggccgatgcagagctactactccctgcccagggtctctgggtggggctggctcagagacccacagttcccagaggcacctagcagctcgatggccaaggctccaactccctgggaacccaccaacgcgggagatagtgaccacaagcatcagaggaaggtcgaaatctgaggccggcaggagaggtgtgaggagagtccagggcaagagggcaggactcagaccttcatggtctgggtcagcaggaggagtccaagggaggaagcattctgagtcaccaggacccccccatcccggaatcctgagctgagaatgaatgagccacgtggaggcaaggccatgcaggtgcaagtggacactgattttgtgcagactcaaagcacaaatagcagatgtccttgggaaaagcccgggcagggccccatagatgctgggcagcttccaggctgcagtaccaagaccttacaactgcaacagatgggtggatgtggggttatggagcaatggtctggcctggggcaacccagcacagtgagcaggatgctgttcaggatgctggggaggagccaacgtgcgatgctatgaggctcacaggtacaaaccggaagcaggcagactctgcagctgttggaggtgacttggaggctgagcagacggacctgggcccgccctgcagctggtcaggtgctgagcccaccccagagaggcagacacacaaggcacactaactataaagaaggcagtgggcaggtgctgagcaggagcagagagccatcatcaggggcttgcaaggcggcggggcggggtgggggaaggaagcctgtctttaactcatgagggcagacaggggtgacaccaggtctgtggtggggcacagcagggtctcaatgccagagcctctgctgggaggtcatgagatcacgttctgttccatatttcctcacttctggccacttccctgacccagtgaacatgcattcgaaggaaagtgacagtaggagccagggcaaggagatagaggtccctggagaggaaaatgaaagaggaaatactttttagtagtgcaggagaaagggcaccaaggtgagagcagagaggaaggccttttcctaaataaccttttctccctgttttacagataaggaaactgagacctggattgcttaagtaatttgtccaaaaagagcagggaccctaacctagacattctgtgtgcaggacgcatgtagttaagcactcatttatatgtaaaatacacgttgtaagtgttacctttaacctcctttaacctttagggttcagtagaactttgatttataacataaatgaatcatgtgttggaccaagcaggagaggtcagagttattatcttagtaacccaggtggcagattgcacaatgataactggatttgttcttccttagctctgcatttttttttttttttttttgcccgggagattcatactgccacaaatgttctccctaatttaatgaaggagttttctttatttaatgaagagtctcaagcaggttaagcaaccgcagctacgtaaaagtgacctctctgagcctcagtttccccagctgtaaagttagagatgatttccaaactccttttcagctgaaagaattttataattccatctgggatgaatcagcagagcctctattggggagtatgggcaagactctgtaatcctttttctaattctccaggattttactgtcgggagggagtagagagtttctctgaccccatgtgatgggaaaggacacagcttttttacttccgttgtcatccctcttacaaaggtatcaccaatgtaggtgtcattttatcttctggcttgtaattatctgtctctgtttggagacttgttgttttcagccaagggcagcgctaagacaaccagcaaacccagagtttctcagcaaagagaaaactctatattttagtctttgttctctagctgctaagtgtagattttgtttattctgagaattattctgaaaatcatttgctccaagggccaatgccctctgcacagtagaggtcagcacttctccaagtgtggtccagaggaagctggaggtaaatgtagattccctggtcccacccacccttatagaatcagaatcttgagggggtggagtcttggggaacctgtattttcgacaagctccttatggattcttaagcacattgaagcttaagagtcagtgaactagggcgaaacttttcttagagggatggcaaacacaagtgcctacagagacccggcaggaaatgcaaatgatctggaagaaaagccacggcgtcatgataaactgcaccaggacacttggtcttggggtcaagaagaaagtagggtgtgtgagacagggagagggaggggacctggagcccacgtgcccagccaaagcagcagccagcctcagttcttgctgggttttgcattgaggactgtgggtccagcttgattagttcttcccgtgtcccagaaaagcagaaaatctggatctttctgtgaagtgttccaatttttaacatgggcttaaaatgtttatgggcttctaactcaaaatttttaaaggtgttccatcagcgaaacaacatgtctaattcatttaacggttaatcaatagaaagctcacaccattaaagcagtggtttctcaaacttccagaacatctagaagccatggtgccctttgcaacacattataatctgtggttctcaaccctggctgcacgttagaatcatctggagatcttgaaaaaaatatgccgtggaccccactcactccagtgtagtcagaactgctggggaatgggtccaggaatcatttgtttttaaagctttccaggtgattctaatgtgcagccagggtagagaagtacagccacactgataaatatagtcccttcactagaaccagcagaaatgatatatacaagcaaaggcacacctagccacccaggtgtctgaacacattttaaaaggcagttaactaaacatggtcagctatttcctggtttttccatgcatactgtacatgaatattctttgcttatgttttgccccgttaaacaaaatagagaaaatggcattcaccaatatatattttttctgtgcaatggaaaaagttgctcaagatttaatttgtaaaggtgggaccccctagtccagctctcaataatactagtgttctgtgaggcatggcttaagaaccacaaactcgtttgcagtgggtcattgtctgaggcataggttgacactctaggcccatttagtggaatcttgccatattttgttgatgaaaccatcttcaccagatgatctcccagatccctcccagcttgaagagtctctgcttcaataaatgaggtatgttcagaagacctgggttcaaaccccacctccaccaccttctagttatgtgaccttgggaaagacatttaactttttgaggctcagttttctcatttgtcaagtgataaattttacatgttttcattcttctcaggggttgttagaaggtcacatgaagtaataaaaactcgacaaaacaaggtggtgctattacattttgcttatttatgtatacgatgattcattccacagattacttaaaacatcattattcagtgaatttgattgtcaagaagattgtatgtacattttctttgatctcccaggcaattcttttttttaattaattttaattttaattttaatttttttgacagagtctcactctgtcacccagcctggagtgcactggtgcaatctcggctcactgtagcttctgccttctgggttcaagtgattctcatgcctcagcctcccgagtagctggggttacaggtgcccaccaccacacccagcaaatttttgtatttggagtagagatggggttttgccatgttggccaggctggtctcgaactcctgacctccagtgatccacctgcctcggcctcccgaagtgctgggattacaggcatgagccactgttctcggcctttaaaatttttaattttaaataatagggataggtcctccctatgttgtccaggctgatcttgaactcctgggctcaagcaatcctcccgcctcagcctcccgagtagctgaaataacagacatgtgctaccatgcccagctaattttcgtattttttatagagatggggtttcaccatgttggccaggctggtctcaaacacctgagctcaagcaatccacccacctcagcctcccaaggtgctggctgggattacaggcgtgagccaccatgcctggctgccaattcttcttcttcttcttcttttttttttttttttttgagatggagtctcactctgttgcccaggctggagtgcagtgacacaatctcagctcactgcaacctcgacctcccaggttcaagtgactctcctgcctcagcctcctgaatagctaggattacaagcatgcaccatcatgcctggctaatttttgtatttttagtagagacggggtttcaccttgttgcccaggtgccaattcttttttaatcactagcaattgtgtcctaagctttgcttgctagtgtcaagttgcttgtgtcagctaacttctgagtgactctggccaagaccctctagacagccatttcttcctctgaagagggttgcgccacatgactcctgatgtcccttctaatcatgggaaatctatatatcccagtaatagaaaaatgacctttcccacctctttcttgaaaccttaaaattctccccaggacgtgttcatcctggggagcagattatgattgataggctggaagaaaccaaagaggacggccactagggtgtcctgagaactctcttagctcataactttccccatctcctggcttcccactgccttgacccactctgactgtctcaccagcaagtgccattttccatctcccttcttttttttctgagatggagtctcactctgttgcccaggttggagtgcaatggcaccacctcagctcattgcaacctctgcctcctgggttcaagcgattctcctgcctcaacctcctcagtagctgggattacaggcacgcaccaccaggcctggctaattttcatatttttagtagagacagggtttcaccatgttggtcaggctggtctcaaactcctgatgtcgtgatctgcccacctcggcttcccgaagtgctgggattacaggcgtgagccaccgtgcccggccccatctcccttctttttacagcaaggtgcatgttgcactgacttaccctttattcctcttgtagtcactggagctgtgttatttatttactttattaatttatttatttacttgaaacagagtctccctctgttgcccaggctggagtgcagtggcacaatcctggctcactgcaatctggacctcccgagctcaagtgatcctcccaggaggtgctattgtaactgaagccatatcaataacagctccttcaaaacccagctctgttgtccttgatagggttgccaatgcaagtagcttatccacattcagagtattacaaacttgtaaacttacacattacttaactatcactgatttctctccttggttctatctgaaatggtttagggaatcgttggcagtatctgttctttcaaagccaattattaatcagggcttcattagacagcattcacacatttgttttcctaacatctgttccattaattttctaagaaccagcgtcaggcccaccagatggcaatttccagaaacactcactcatcctttcctgaagatcagtagcacatttgcttgtttccaggcctctgatccttcctgccttgtctgtgacttcctcaacaacccctcggggtgattataagctcattccagccatgtccattatgtgtggaatctgggtctatgagcttgaatttcaacttcgggctattgttaccatttgtgcagaaagtttttctctgggtgttaatactgctcagaccttgaggctgtcaagtgtacaggagcagagaaaagacaggctctttctctttctctggctcagaggggtgggaaagagcattcgctgcccagatcttgtggacagggatgaagaggccagcaggtgacagcgtctggcatagcacgtgctgtcaaggaaagagaaaggagccaatggtgacacaccagcttggtcagaggaagcatctgtgtttctgccaggctcatgatgtgggctctttgctatataagccctgctttattgggtctaaaacacaaggttgagatgtcactgcactgctcaaacactttcagtgactccctactgttaatgggttaaaatttaaccttttagtctgacaggtggaccccaatctatcatcttgccctttctcacctggctcccacctgctgtttcgggccgctcttactcatttgcatttcctcccctccctgcctttgcttccagcagtcactccatgtaacatttctttcctccccatcctcaaatcctctcaattttcaccccttccgtgaagtgctccttgccatttccctcctttgatttcctgcagcaactcctggacttctctgaaaaccactggtttcctgtcgctcccctcacctgtgctcctgcattgtgacatcttccggggcactctgtcctattatttctctctagtcctgttatttgggcccatgtattaatacccccccttagatattaacccataagcctgaggctgcacttttttgaattttgaaatcagaccttggccttgaccttgagcagcaggatataaataactcttacatgcttagcgttccaataatggaacaccaggcataaatgggttttaatccccttgaaggcaggggttgtgtctactcatgttttgcttcccaaggttagcactatgcttggcatatagtagctgctcaatacatctttgataaatgaatgaatgcccagatgaacaaacacacgaataaatcaactagctgtaagatatgtaaactactaggtgctgatatctttctagaatcagtattttctcaaaaagtaggaaaaacgggttggaaaacttaccagaactgagatgtcaaggcagtgggaggagggggcaattagatttgactggccagtctagtgccatgttgtggagctctgaggccacactgctccttgctcaggactgtgtgtgattctagggccaccaagaatcttcctcgtatctccaccttgcggtctgaggcctcaagcctctagggaggtggcaggcgggacggtggccacttggtgcctgtccgttggcagcacactgttcctgcatgtctcgctcatgctgtgccctctgctctgctttatctcctagacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccaggtaactcctctctcagagcagaaaccacaccgacgggaaagctggttcctttgccatatcagggcaccactgggtgcagcgtttggcagacctgggtttgaatcctggcttctctgagccttcgtttccgtatctgtgtctgtcattaaaacacttaagagttagctaaggtgctcgagggccatggcattcaggaaccactggtttcctatcgctccctcacctgtgctctgcattgtgacatcttctggggcactctgtcctggtctcgggtactcactcctttctctgccctgtagatccttcggccagatgagcacattgccaaacagcgctatatcggtggcaagaatctgcccacacggggcactgccgagtggctgtcctttgatgtcactgacactgtgcgtgagtggctgttgagaagaggtaggtggacccttcagataagcatttcagaatgaacctcaggtcccttagtcctccatgaaatggagggaagaggacagaattaagggagtcagagatctgggttcaaaccctagctttgccactgagtatcctccattcattcactcaactaatgtttattaaatgctcactgtaagacaggccctggggatgcagccacagggataggaactatgagaaatagaaagagggcaatgtgacaatgagtgggtggagtccaacagggaaggtctctatgatgaagaaattcatgcattgacatctgaatgataaggatttagcccatgaagatcagaatgagggatgtgctaagcaaaggcaacagggaggcccaggccctcaagtggaaataagcttgatttgttctagcagcagcagcaaacagatcggtgtggctggagcatggtgagctggggaggggaagaggaggggaagaggtcagggaggttgctggggccatataatttattattactattattactattattattattattattattattattattattatttcttgagactgagtctcgctctgttgcctaagctggagtgcagtggtgcgatctctgctcactgcacctccaccatctgggttcaagcgattctcacgtctcagtctcctgaatagctgggactacaggtgcacgctgccacacctggctaatttttttgtatttttagtaaagatggggtttcaccatgttggccaggctggtctcgaactcctgacctcaagtgatccgcccactttggcttccaaaagtgctgggattatagatgtgagccaccatgcccagccaatttaatttagaacatcatcaggtcatggcgaggtttcaggacttattccaggtgtgatgagaagtgtgggagtgctataaccagagctggggatactcaagatacccaggaattccttcctgtccctctactgggtgtgaagtcaagagcctaggagaacccacgtggatctgccaacagcagctctgttgggaattctgactcagacagctacagggaggaggggctgggtgaggtgatttgattgacatctttaaaagatccctctagtttccaggaggtcaagggaagaggcaggaaaatgagttaggagccacggcggcagcccagatgagagcaatatctaggccgagactagggcggtagcagtggatatgacgatcagatggatttgttctgtattttgaaggtagccagtagcacaggctgattaggtatgggatgtgaggacacaagagcattccagataacttctaaattttttcgacatccaggtggtatcacttattgaaatagggggcctaggagaagaacaggttctgttctgcccagttaagtttaaaaggccgggtcgtcatgcaagtagagctatcctggaggcatatcaaacttcacatgtcccaaatatcttacccacacactgccttcacctggaaaatcaggcaatggttcctcctctatgtatgcctcacagagctgttttaaggatcaaatgtatttgagagaacttcatggtttttaccatgttttacaagagtaagcttttcttattttagataaggaaacaggccgagagaagttaagtgacttgaccgaggtcgtccagtctggattagaactttggtgtctcatgacaccatcctctgtgtttctttcccttttcttggctggtactgcctggtctgatgctcagtgggttggggtcacagatggcagtcccatctgttccttctcttcctcttgggcaaggttttctcctgtcatcagctgctataaagccacagaccatccacatattgatgcccagagtccctgaggcaggtggatccttctaagtccttggtgttttaggcaactaagagttaaagctcaaaggcagagcttacaaactatttggcctgcacattgttttcgatttgactagtcatcaacagttttgggtgttttaagtcaggagatttcacataaaacctggacttcttgctgtttttgaaaaatcgaaagatttcctgataaccatccgtcagagatgagtaccggccaccccttgagatggggtatgcatcctcagtccccgcagcccccaccattccctattgttccccaagagtgaggctggcagttcctgtttagcatcatgtgctggctcgattttctcacttacgtgacctgcctgggctcggtagccatcgagtttgcattgcttgatgccacggagcccaggcaagtcacataaatgagaaaattccccatccaaggggaattatccagtggctgagttggcagatggtgggctgaagatcctgccccagtcccaagggtacccaggaatttcatcctgtccctcctactgagcatgaaggcaagagcctaggagaacccacgtggatctgccgacagcagctctgttgggaattctgactcagacggctacagaaaggaggggctggggaaattaatctcttaacttccctgtctgattttgatcagctccacctggatttctttgaagccctgggcacttgaaggagttcttattttcacagctgcagaactcaatgagaagtttgcattgagaatgatttccatcctcctgagacatcaaaaagataatttcgtaataaaacctatgggtcccccacccaccacccccacagctgccaattctgaggttagttcttcattggaaccttcagttcacacttaggcagatactgcccacctttcccacaggggaatcatcacacaggtttgtacttacagagagcccatgagtctcttcagagttcatggcttcaaaccaggcaacaaaggactccaaattggagcagttggcggtgtagattgatgagaaaactgagtcacacatgtggtcttggattcattcagcaaacatctgagagcccttgtgcaccaggtacccaggctgcattctgggtcgcagagtgggttggagtccacaagggccgctggggacccaggtctcatacccttgtgctattgctcatatagtctgcagcacctagctaggcagggccaggcctcccctagtaggctggggagggagcctctcagcatcatggctcaggaaaggtgggacactgggaaacaaccatcttgcatgttggtgaatgtgtgggcatcttccttggtggtctctgttgccccctctttacccctccttgtctctaacaagagtttgggatctggcatcaagctgtcagtgcttgaatcctggcactactatccactggttggatatcttgggcaagctgtttaatctccctaagcctcagtgttcttatctgtacaatgggggataatagttcttgctctatgggattattatagagatagaataagttagtgattgttgtcatcatctctaagtcctctatctggatacagcctgttggccaagccaggccaccctcttgtgcttacatcctggaccctcactctccccaacacagctgtctgcaccttgactttctaactcacagaatcatggaactcactcactccaggtctcttccagcctgccttgaaccagcttgaccaggaggtacactgtgttgttaggtagcccatttcagctactttggctcctccttccagctgccttaacccagggagagggcaatcctcatacctccctctccattcacttctcctccagctgggtctcagctgccttgttttattggtctgccttccctcactgagcgaacctgctggaacagagatcttcaagctcagcaggcgcagtgtgcctcagaggttgccctgacttagggtagagcagatctggttaggctctggagtttatggaagaaaggagctgggttttaaccagtaggactgggatgtccaagccaacctaatgttgatgggaatctccagtcttgtaggcttgtatccttctgtctatgagaaggttgctgggccaggttggactttttggggtttgccctgatggcacaatttcaggaagactccaggttgtctccaaggccagatgctcacacacatggtgtgtggcctcagggagcagcaaatcaatcaactcatcgagaggctgaccctgaatccagagaggtccatcccccatgacctctcctacacctggccacaactggctgctatcccaggatcaacagagcttcccaaattaagtcttacccaccagaattgacatgataccagatcctacctggttttctgtgtaaaactacttgtctcagtgcagacttttcattttctttctttttccttcacttcactcaacctcatttactgagttcctgcttccttgattttggttgccaaaacatgtgatcccacaactactaggcgaatgggctggagttgcccttcacgcaccagaatgtcaggcaccaaaccctggcacctccaggcttcatcatgctcactgtctccgtgctcaagtcatctggaccctcagccatagttctctatcatctcctctgtgctgttttctaagttcacaactgtcttcccaagctgttcatcttggtgagcaatccacattccaacttcccatcatggtgaacaaggattcccaaagaagaaatgtccaagtaatttttacctcgttgtgtccttgttccttaggaaaaatatggcccagtgtaaccgtgatcttcatcttatctcttctagaatctgccactttgtctaggcccacagtcatggccctggtagaaatgcttgcatcttccactgagacggattctgcttcctgtttgcaagtgaccttgcctctagcattggttcctgacttgaatctttttgccagcattacatcctgtggctttttgaatttgtggccttttgaatcacagtctctgtgctcggagactctttagttactccctgtccgtagtctcttccagtccctctgcctcttgccctgatccttctgcagtagattggctcaacgatcccctctcccaaaaaccatgtagatggcatgagtttttgctttccttactgtatctgtgtacttttgcctccaagtaggtaggtgacaattttctcttaataccatcctttcaaagggaatgattattccacttctgtttcatgatggccactagtgtatgcccccatttggtgattcataatacaacaggaatacctggaatgtggcaacgtgcgcttgaaggtccactctgagctctggaggcactttctgtctcctgtgaccctcaatagaactcagttcctatgagtccctgtaggagcagaggccctggctcacccttgcatgggtggtgggcacacttccccatcacacagaggtgcttttctcactaattctgtcttattttgcagagtccaacttaggtctagaaatcagcattcactgtccatgtcacacctttcagcccaatggagatatcctggaaaacattcacgaggtgatggaaatcaaattcaaaggtaacaaaatgaatgtgtatggtaggatgggtgagtgggggggaagttaatgggacaggatagtgcaggagacccttaccagacctcaagaaaagaaaccaagctccttcagagagatagccgactattttgtacttgagtaattctgctttgccccaaaagcaatgagtgtaactttcagtttatagcttagagaatgcattagcctctggaagacaacacgtactggtaagtggtgaaactgtgtaggcaagccgtctagcctctggtcctagtgaaatgggatgagagttcctctttcacagtgttgtcaggcaattaaatgagataatgaataaggaacacagtgccagaaatgctcaacagataggacttgtcttcctcctccctaaaagaaattaagtttggctgtcctgaacatgagtgcccagacaactgagctttccagatgtgcagggcctacctgaccttgcccaggggtcctctgggtttggatgattgcttcgagcctcagggtgtttgtccccggggtgtttgggtagagatggcgaagtcgttgagagtcatttctggttttccattatgtttgcaaggaactcagccttgatgatctctggagttcagggaagttctcttttcctttcatattcccattttgggtaactgcggaacgcctgaggtcagaggcttgtctgggaaaaggtgcaggcctcttttggctcagcgctggacagtgatcttaccccacatgggctctattttacagccttttcttaaagccaaagatttgacactgtaaccacagaaccttagagcccagaggacctttggagtccttacctacaggccagcttaggatgaaaccttcccatttcagtgaatacttatcttgttcataaagattttcagaaaaagggatttgtgatccaggtctctcatttatcttacagatctggtgccccttcctgagacccgagccactcctgtagctatgtaaattaattcctcatgttcctgtcctcagtgaggatggacaacagttggcagctgtccttcgcaaaatcgatctccatttagttgagactctttctaagtcagtctccagtcttttccttttttttcagatgaaacgggttgatgaatttagattttctttccagagcttatttgctatttatcatatgcttcattatctcatctgaattttatagtgaaaacacttcaaagactctaagtgcaatgtgaatgttaacaattatacagtcttgtttctttggctcccattcaggctatcttaagttgtgacaccttaaatttttggtaggacttctgcgttatcttggtccattcacattttaagaggaaactcacaccccaagattctaagtctagaatctaaagtgacaatccagggctgggtgcagtggctcacacctgtaatcttagcactctgggaggccgaggtgggcggatcacttgaggtcaggagttcgagaccagcctggccaacatggtgaaaccctgtctctactaaaaatacaaaaatagctgggcatggtggcatgcacctgtaatcccagctacttgggaggctgaggcaggagaatctcttgaaccccggaggcagaggttgcagtgagccaagatggggccactgcactccagcctggccaacagagcgagactctgtctcaaaacaaacaaacaaacaaataaacaagccgacaacccggagatatgtgttaggtacccacttagtaacagggatgcttcataggtccatgaagattcctaggaatctcagcaagggctttctgccccttggaagatttctatacaagggtatggggatctgaacacggggcatctttcagtgggcatccttacaataataatgagttcttttgatactggcttctccatctgctcttcccctttctgcacctggacatcagaattaagctgcacttgtcccccacacctccctcgcagactgcactgcccctcctcctgggcagtgatggggcgtgtggaggaggcagcctccaagggctctgctctcttcagacaggagattgtcactttccttcccttcttcaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatactattcacaaacatctccaggaagaagactgaaaatctctcacagagattttctctgtgaaatctctttctgttttcctgggagtcccactgtttttccataggctaactctggaaggagctggctgaagtaaatgaggaaaactctgtgaggaggagtgttgctaaaatagtttggattggagatgcttggtcaaagcctctccatgatttccatgttttaagcacttgtagagtgtatgtgtgagattaatgtaggagtttccattaaagaagtgctcagttagttccctatgaagggtccaaggatgctactggatggaggcaaatagaatggtctccatttgaacggaaagttggagctagagaaattaacaaatgaattcagaaattactgggtagccacaatagagagatagaaaagacccagcttctcttactcaggagcagtttcactgctcatttataaagggaggataaagtatgcatgccaactactaaaagggagaagatgatcacccccatgagagggtccgaaggattaagtgctttaactgggagcaatgagttcacctatggacacaggaaaggcttcagaagggtgtggaatttgagcagaggcttcaaggatgaggtttggggatgaagggatccaggaggggaagcactgcaggtaaaggaaggagcatgagtgagtgagtccatctggcctcagaggatgccgaaatgaagctggggagaacgaattgggaaatatttagatctggaaaccatgtcttatgaggatggttgggcttgggaaactagggatgttcagttgggggaacagctcaacagcaaggtataggagaggcaaggtagttgccacaaaggctggcatgtagatttatttattccatcagttaggaacaaatcagttaggaacgaatcagttatcagttaggaacgaatcagttaggaacgaatgatcttggccagtgactttaatcatagtgatttcttgttcacaagaggcctgtagcagcagggttagggtgggctggctgcttaatgatgccaccgaagactcaggctttctctctttccagtctgccatgcttagtatgttggcttttcatccttttccttatggtcacaagtgattgctagggcttcaggcaccttgtccacatttaagacaagaaggaatgagggaaggggaagagccagaagctttcttcttccatctgtcacttttataaataatcgaatatctttgccagaacttgcccttaccccctgcatacttctccttgtctgatgggtcattactgggtcacatgaccaccgctactctcaagggaggacaggaaaaggagcatctggtgttttcgactctgtaatgggatgtcacaagggagaagggagttaggaatggttattgaatagataaccaatggtgtctgccatggttcacccttggaacccacaagaagccagattttggctaatagctgcctttggaagtagcaagttctaagtctcagcagatattaaagcagaggctagctgtccacttggcaagcggtattattgccaaatgatctctgtaggcaacagaattgaaggggcctgataatcacatttgggtgatctgttgaaccacggttctaatagaaggatatgccttatttggctaaatggcctttggattgagtctcagcagtcacctactatagtagtcaagctgcataaacttagaattgatttctgtctgggtgcacattaggagggtaaaaataaaaccaacctcaacaaagctgagttggctaataacattcagtgcttggttttatgtggagcgcttcatagcactgctttgtattgtgatagaaaagggtgcagggccacctttgcctctttactcttcctcatgcagcatttatctctgtttcttacatccttgggatcctggtctttaacacatgaatgtgcctttctggtttcttctgccccatgcccttgaacctgggattccattgatcagagccacctatgatggcatgaaaggactccaagggagaatatgagagcattcatgaagtttcttttattggtggttttaagttgattttctataaatgttttttgttgtagcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtatggagcaggctcatgccatctgaggcactggggctgaccgaccagaccacttgttaaaaagaatgagtgaaggattgaatgttgagtgagcaaatgatggtctggggtgagtaaaattcctctggtgaaggttctgatcttggcaccctgactcagttctactcagtcacattctgcccttttaaattcctaccatagtttcaaccagctttttaatttgctttgtccaaagctctctgtaccgtagaaattaattaactgccacgtgttaccctatgtcagagatatgtgcatgtggctggcaaggaacactgaagtagaaaggcttctatcagaactctgatcattccagcctctcgaatgtagaaaacttactctgaaagacaacaacaaggatggacaagaagctaatttgaaatgctaggaacagaaagtgagatagccgagagtccacaacccctgaaactagtctgtctttcccttgaggggaatcaaaaatagggcagtaatttgtgaagcatgtttccttctagctcattatttctgcatcctgtctggggccctgcacgctgcacttactaaatggctcaaggcaatgttttgtgagaacatttctcaccgaagtgatcagttccagctaggaagagcaatgtaagtgttttcttaaaagccaagataggccgggcacggtggctcacgcctgtaatcccagcactctgggaggccaaggcgggtggatcacaaggtcaggagttcgagaccagcctggccaacatggtgaaaccctgtctctaccaaaaatgtaaaaaattagccgggtgtggtggcacgcgcttgtaatcccagctacttgggaggctgaggcaggagaatcgcttgaacccaggaggcggaagttgcagtgagccaagattgcaccactgcacttcagcctgggtgaaagagtgagactctgactcaaaaaaaaaaaaaaaaaaaaaaaaaaaaaagccaagataattcgttatcagtgtagtaactgtcatatgcttcaactcatcaccccaaacaagtgcagttgttctgcttctgtcattgtggatgaacagcaactacacaactactcactcacccaaaccaggttccaacagtttttttttttttcttttttttgagacagactcactctgtggctcaggctggagtgcggtggcactatttctgcttactgcaacctctgcttcctggattcaggtgatcctcccacctcagcctcccaagtagctgggattacaggcgcctgccaccacagccagctaatttttttgtatttttagtagagatggggtttcaccatgctggccaggctggtctcaaactcctgacctgaagtgatctgcctgcctctgcctcccaagtcctgggactacagctgtgagccactgcacccggcccccaacagttcctcttaaagagcacccgtggccattctagcacttgctcagcttctgggactgcccctggaactgggcgacttcctgggttccaggcctgagacttggccttccaacctctcactgacatgtcccttcccaggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgtatgtctgactcgataaatatccttcaattacccttaattccatgtccgcatctactaatcagaggtaaccagaatctggggcagagaatctgtcaatcaccaaacacattgcttagcgcaactccccttacacagggggcacaccgtgctgacttccgcctgctaagaagactgcactattgcttgtgcgtctttccttcttgcagagtatattattctcagagacacagaggcagtggctcagattggcagaaagcacatacgaatttgacctccagatacctgtgggcaggatcccctggtgtgaatccttgcatatggaaacatggtttatttactaactataaattaccaacatcactgttttcgaaaatctccccccacccgtatcagttgagaatgagagaaaatgtgtatggcaaatggcctaaaaatatgaggctaattctgttctcaggctaagcctaaaagagctaaccaggaaccccttttcagattgtggccctcttgtcagggatctgggaaccatagctctcttttgagtgaggccgtggatcccactgtggtatggacatccacgtggggcagccgtccacagtgagcgggcacagagcgacaggccatctagcagctcctgagaaacacattcttctagtgagatcactttgcctctagtaaaagaaaagtctatctgaagctaaagtatgcaggctgaaggatgtgtctgatgtgttcatgcctgtgtgtgtgtgtacgtatgtgtgtcccttgttccttgagttctccaagactgaagtgagtttggtcagtacttttttccccgctttgtccacgcccagccaattctaagggtttccctctcagtcttcatcccatgtggcacccactgacttccaccatcgttcggagggctatgtccctgtcctaaaatcctggctggcgggattatactccatcttgctccagggagcccgggggcacagagaggggatgcagtaagctcagcacatcagccacgggctgctgctgtcccagcatcagtctattcacctgagggccattctcaaattcactgggcatgataacccccaagggtttatttaaaatgtacagtttcaggctgcagctctagaggtacctttaggactgcagtagggtccaggttgcctcaaaactattaacacattttgagaagtggtgcattacacccgacatcactcgtccttacttgaggcttcaatatagaaaagggaaataatttttttggccccagatgaaacccccttttatccaacttcacagcacattgctaaaacattggcctgtggttcatcctaatgaaccaaggcagctagatacatttcctggattattccaaagaaaacagaacgtggtgcaattccaaatggtctttttcttcagagctctacttgtaggttaggcagcagacacaaatacggacaggggtctgaagtcagcccccctattctacacatcactgacaggtgctacagaaacttgaatcactgtcttcaaaaatcgacgcttgttttgggggagggtaaagagtgacattggaaatatcacctctgttggaggagggctcatagcatctgtctggtttattgccaagtgaagtccagtcccaataaaaatgacttgaaagcacttggacacatgaagggagagatctggtgtcttagcacctgatcagcatatggtaagtgcagtaagaaattagctggaagacttcattctgattggttacctagggcaatttcaagcattatagtctaaaacttcttttactgggctcatacttttttcccttgtcacaagattcacgtggtgagtcctcccaaaccccttatttcccaattctacacctcatcaggggactatggaggaattctaatttgtcccctaatcaactcacaaccaattgagcaaatagttaaggtggtcctgaaactactctccagtcccggggacatttggaa

SEQ ID NO: 13116 - DNA, 5309 bp, Human
agttaacattcgtctgtttctttagattgttaatgagtagagttttcttttgttgatttgcctttgaaccaattcataaaaattaatatttaaaaaaaaatttttttgagatggactgttgctctgtcatccaggctggagtacagtggcatgatctcagcccactgcagcctctgccttccaggttcaagcaattctcctgccctcagcctcccaagtagctgggactacaggcaccctccaccatgcctggctaacttatgtattattagtagagatgaggtttcaccatgtgggccaggctattcttgaactcctgacctcaagtgatccttccgccttagcctcccaaagtgctgggattacaggcgtgagccaccgcgcccagcctgaaatattttaaaattgaaaatgacaagtgttttctttggttccactggagactgtgtcctcacagctgagactgctttcctcactgcaaagcatggagctgtttttctgttcccattcccagcatccagcctgttggggcagcagcgacacgggatgccatctcatcttcatcccgtgtctgtgggcactgctgctttcttagcaggctggcagtctcacctccctccatccctgtgtatgaccgtggtccctgttgtacacaggctgagagaggaagctgcctgcctggggatgtttacctaacacttgctgaattgggcctgggggtgggcctgcagctggtaccaccccctccttgggctgccttcttcggagtcacacttctggggcaggtagggctggtgagccctgcccaacacccatgggcactctgacccagaggatccatgctatctcccacactggttgggctccactcacttgcaccctgactgagtctgggcgtgctgtttctaccctcagacatctgggtacccacgagtgctgttgagtgacggccactgaaggcccggctctgctgagctggcccctggtcctcacaggatcctcaagctcggttcaccccaagtgcttcctctgcccccatccagcaccccttcagctctgcctagaatccagtgtgggcatccggtcaggtgaggtgatttcaggtggtcgtcagtggatgctgaatcatgtgtgagaagatcattcctttatcaattctgtttctatcctaatagtggccttggagaggggcttggtttgatactagtttgtttaacacctctccaatactcctcatcttcctctttgtaacaagagagcttacatccagagcttttggcaagcaatatcccatagactgtatcaacttcattgtcatcaaggaatttattcttttttaaaaaaggggagtaagtctttatttccttacttccaaaataaagctggctgagttggaatatatttactcttaaagctaccatccattgaaggtattagtgccgattttccattgacagtagtaatgtaaactttcctagttgagataaatttaagcataaagagttgatgtgaagacagaaaaagcaaatagtagaagaggtatcagattaacatggcagaagttctgaaggtggcatgggcatggggatggcagcaatttgggaagaggttgctctaatcccacctgaacagaaaggtcatgattcagaagtggcctaaggggccgcagagccccagagctcctgtagggtcagcctcagggagagggcttgagcagtctggaggccagaggagggcattttctcttctggctctggcttcctcctctctgaaatgaagagtttaacctgtggttcctcatggacgcttgcacttgtgtagtgcctgctcgtccaggtcctggggagctgcgatgcctgtcctgtggagaagctgcccatcagccccatcccagtaccatccaggccgctgccgccgcccatgggtgcggacccggcactcagccgttgcagcccggtgttcatgagcattttcctcttacaggttaggaatctgaagcaatgggcgactggagctttctgggaagactcttagaaaatgcacaggagcactccacggtcatcggcaaggtttggctgaccgtgctgttcatcttccgcatcttggtgctgggggccgcggcggaggacgtgtggggcgatgagcagtcagacttcacctgcaacacccagcagccgggctgcgagaacgtctgctacgacagggccttccccatctcccacatccgcttctgggcgctgcagatcatcttcgtgtccacgcccaccctcatctacctgggccacgtgctgcacatcgtgcgcatggaagagaagaagaaagagagggaggaggaggagcagctgaagagagagagccccagccccaaggagccaccgcaggacaatccctcgtcgcgggacgaccgcggcagggtgcgcatggccggggcgctgctgcggacctacgtcttcaacatcatcttcaagacgctgttcgaggtgggcttcatcgccggccagtactttctgtacggcttcgagctgaagccgctctaccgctgcgaccgctggccctgccccaacacggtggactgcttcatctccaggcccacggagaagaccatcttcatcatcttcatgctggcggtggcctgcgcgtccctgctgctcaacatgctggagatctaccacctgggctggaagaagctcaagcagggcgtgaccagccgcctcggcccggacgcctccgaggccccgctggggacagccgatcccccgcccctgccccccagctcccggccgcccgccgttgccatcgggttcccaccctactatgcgcacaccgctgcgcccctgggacaggcccgcgccgtgggctaccccggggccccgccaccagccgcggacttcaaaatgctagccctgaccgaggcgcgcggaaagggccagtccgccaagctctacaacggccaccaccacctgctgatgactgagcagaactgggccaaccaggcggccgagcggcagcccccggcgctcaaggcttacccggcagcgtccacgcctgcagcccccagccccgtcggcagcagctccccgccactcgcgcacgaggctgaggcgggcgcggcgcccctgctgctggatgggagcggcagcagtctggaggggagcgccctggcagggacccccgaggaggaggagcaggccgtgaccaccgcggcccagatgcaccagccgcccttgcccctcggagacccaggtcgggccagcaaggccagcagggccagcagcgggcgggccagaccggaggacttggccatctagtgcccgggtgcctgcctccagacagctgtgtagtgatctttttcttagaaaccaaaaccaaagtgcacttcccaccagcagatagaacctgaaagtcccaggaggtgggagcgactggagtcccaggaggtggacgatggaggagagatcaggtttccgtgttcaatgcttgctgttcttagcactgtgagttacagtggggataactcccactttctgagtttgggggtggcggggacaagggttgtgggcctttaagatcttcacagcagcccagaaatctggtcgctgagggctgtctctgggggtaactgttctgtagtggtaaagcaacaggtatcctgcagtccctttagctcctgggcaattgggtttgctattcctaagctctccagagcctctgggcggcccagagggtcttagctctgggccagagcacttagctctatctctttgatacttttaacttagagttgaatttcatttgggatatttgccaaactgcactaaaaaaagatttacagcaagtctatgtagtgtcatttgagtttccgaaattgcatgtgaagcccaggatatcaagcttcaggcctcatgacaagtgacaaagagcagttaccctccagaggcaggctcagtgggcaagggccccagaggttgctggcagaaggcaggtggaaacgcagccacgcctgaggccatttttaaacagttgaggaaattgacataaaagtgtgtcgggtatgccgtaggtatttattttctaaatgattattttgtgctttgaatggtgcagctatgcctattttctcccactttctttcaggaaaaatgaaagaaaaatagtgtttttctttctttaaatactgttagaatgattgctgaccaagacagtgctaatttgccctaatgcatgctactagcatctttactaaagattttgaactttcttgtaaaagaaattctttaatttcatgagtcacctaattataatgagaatgtattatataaaacaaaagcaggggaaagttttaagtgcattcaaatagaagttctgaagattttgaatgggaagtgaaaagtgaactactgttgccaggaaaattatttatacagatgaatctatgacaatctacacttttaaaaagtacagaataaaacacttcaagcttcctaatcattctttgtgggcagcctgtttgctttctccagtgtaaataatataagtgtctggggatccctgcctgggggagggcgcgtgctcatgcaggctgtatgccccattctgcctccacaccagagctgtcctgacagggaaggctatttatgtgtgtgggcatggctggaagacggcagaattttctgtcctgcacacacagctgtagtatcttggtcaccatttgtttataaaatgaacgatggtcatgttgagcctgtttctactcacacttttcacctccaacttctactgagtatcattagcccttgttcagcgagaccaatgtaatacatttctttttataaattaacttctcgatgatgcatttgggaccacactccaaacatactttctgttttctatcataaagggtgctccactaacaatctgatgaaaggaatgcaatttccaagtctcagattcttgcatgcaactagtttttcatgtcagtcaaacacaaagaatttgttagtacattctgcttgctgtaggatgcactggacaggctcctaggcttgaaaaatgctaacttttccatacgtctcctcagagactttctcaaccagattgacaagagagaaattagccctttggaaaactgtgagtgactttctcactcctctccaggctggtgcataactacagccattctagatgcataacttctctccgaagttcactcattacatgcagtgtatgccataggcctagggcagcaggacttagttcttgtgagtgataagggctgctagaagatcctagtgtgagaagcattccgataa

SEQ ID NO: 13117 - DNA, 131978 bp, Human
tgtaaattcaatgagctgaagctacttcaataggacctggcagcagaaaaggaatgatgtaagttttcaccaaattattacaatttggtagtagaggatgtttgttttgatgatagtggctgtttttgttgtgatgtttctgttgtgatgatagtttttcagtctaaaccagtactgtgtaatatgaaatcttaagaggctattttagtgtatttaaaactaaaaaattttagttacaaagtttcctaaaaattagtgatactttttgaaaagctggttcaagtacattttattaatttttttcaataaaagagaacagtgtattcaaggtatttagtacaaggtggaaagcctacttgatttattttttttaatgagtgaatgaattcaacttctactagattatcctctgtaagttgcgtctattagtttacacatcagtctttcacgggtgattaacctcactaaaaacttcatgttcatcaatattgtgttgaacttgaaactgtattatcatatatgtttattaataggcaatggtgtcagataatcgtgaaattgagaagtcgcccatccatttgggtgggaaaataaccaacatcctcagttgtaatcccactaagaaccgccagggcgagacgaaagcgacatcgcttccatctttacgtgagtcttggaaatggttcagcaccatgacgtccgccgaagacgtaggtgtagacgaggaacaaaagagaagacccctcgtggaggtggcctgtggggcccgccctcctcgggcgcctgtcgtcgtctgtccctgactccgctccccccggcggccgcagcgagtgcgccccgcgatgcagcgggctgtggagggagcctccatggagtctccatcaaccattgaggaccaggagacggtggcaggcggtagagaggcctgggcagggccagcgccccgggctgcggagcacaggacggcggcgcccaaggacgccccagggcaggcctcagcccctccaaccggtgggagcccagctccaggggagcccgcagctccctccatcttggttgatggaggcggggagctgcgtctgggtctctccaccgtcgtgcccgtcccctgtggccccgcggacgcagacgccagcagccggggttgttcccttggccgaatggcagagtccagttggggcttcccgaggacaagtttcccggccccacggggtttggtttttagggggtcccaagttcccacagtcgttccgacaaaatggaggacgtcgtctcctcctgctgcagccatggcgggaggtgggggactattccccacggggcgcggcgagggtggaagggcctccactgcccccagcgcggtcgggattccagttcacccgcggtcccgaaagcccactcggacccgctccagcgcctccccggcctcgcccctcgcaggggccttcaagcaactggacagggagggcgttggggcatcgaggccgcggctctcctcgggcagaggcgttgggagccgctgccgcggcctgggcgcccgggctcgggcgagggcaggcggccccgccggagtctcccgggctgtgtaggtcccggagagccccgggccccgaggagccgaagcgggttcggtacggcgggcagcgaatctcgggctcctgaccctggcagacccggtgggtgggggcgggggaccggcggggaggggacccggccaggagtcgagggccggcggaggcgggagtggaacggcagggccgggggagtggcccgcacctgacggacagcccttcggaccaccctaccgagggggggccctgaaggacggccgtcggagccaatgggcgtgcccgaagcgctccggccagccttccccgtcagccaatgagcgcgcggagggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggtgaggcttatccccgctgtctttccagtccagggccgccgagagtgggggtggctgggagcagcgcagcctccggaggaggaggcggaggcggaggcgactagggaggcggagatgggtgagggcagcctccggagcctcccaccgacccgggattaataccccgcggcgcggccgccgtcgccgctgccgcgtcggggcctcgggggcagctcggggctgcgctcatgtcacaggcgcctttgcgtgcggcccgaggggctgggagagtgcgggcgaggccgggagggctgggtgaggcggccgccagcggcgggggtcgcggggccggcggggcggcgggacggcgggacggcggggcgggggtgccggccgcccggggaggtcgcggggcattttcctttctctccggcggggggcgggggaggggcgccccggctgggtctccgctctcggggcagcgctcccaccctgtccaccggagccgaggtccccaagtttttcggggtgagggctgctgcctctgctccgccgggtcccctccttcgctcttcttttcctcggcgctgcgctgcgcggctcttgctccgcacgtattgtttggctgggtctctaatggcggacggggaggcagcgctgccggtcgccgactgcaggggggggcaaacctcaggcccagggcaactgcttggggcaaatgtgggcgatatcggcccagcggtgacgtgagccgccccttacctctgaattggtacttggagtgacggggatgacgctgggtgggcaaatttaggagggaatacaaatcccttgctggcgtcgaggcaacgttttcccttcccccctcccttcccgggagcaggctcggtgtccttaggccccctcccttccagattttgcctttcacatgggttttggccccagatatgtattttgcgctgttttgccccacttacgcaggagggggctgttgtgcgcatggtgggggtaataatagaaggaccgaacctccttgacctcttattcccttctctgcctccttctggcagaaagggttgggttctcccaccaggttgtgtgtttttgatacatttttcttttttcctcctatcccaggaccaagaatcgccttcagccctgtctggtgcatccttggcagaaagtgaggaggaaaacacccccattgtgagtcctttgcccctaatttgttgctaatagaggacattgtcaggttgtaggggttaagctatgggacctggccctccccgttgttttgagggggaggagctttcccttgggtggcagctgcccccagggcgaagcctgggtaatggctggtgaggcagctgggagtgggcgctgctgtttccaccgctgcagacatcgctcctgctgctgcaataccaacctcagcaaccagacgacgggcttctgcagctgctcacgttacccgggaggaggggtggtgcgaaggagggcatatttctggtgccctctagagttccaaaatgggaattaaagttatttcttgttgaatgctgtgcatgcaacctgaacattttttcttccttaaacaatggctaattgattgaaggaattggaaacatagaaataatcatttatatttttgtttatgtctgctggaaacacatattttgacacttatggctcatgagttgctagatctttttcatgtatttgcttaggaaagggagtcaactcctctagtactatcttgttcaccaagtagtatgctgatcagtccagtgtactgatctagttaatttcttcgttccccatcttccatgttgatcatctttaacttaacgatcatttttgaatgtgttaccagagaattatttaatttgttggttttaaggcaactatgtaatgtgctagagaggaagatgaagatagccagtcatattttccttcaggcaattgaaactaaaagtatctgaagtcagcactctggacacattatgtctctggagcccattgacagttgatgtggtaacttgtagatctctgtcagagtcagagatgagttatttacgcttaagtattcagtccacatggttcaaaaaatagtgaattgataagcatttgctgaatatacattgtgaaggatgatgtgagaatagtaacttacattaaatatacaccgttctaggcacagtccaggacactttcctttaatcttagcaagtagcccacagggtaatacctatggcgtgtattgagcccttattgtatgctagcccaattctaaggttttttttttttttttaagtttattatggaaactttaaattttactagtaagaatagtgtactgaacctccatgtacccatcattcacattctaaaattatcaatacgtgcccacactagtttttaacatgtgttaagtaatttaattatcacgaaaacccagtgatgttgataaccacagttatcaattagatttttatactgccttgtttcaaaactaacgggctgtttggatcagaattaacatagtctctttttcaatatgtctgtacaatttacagtctgtaattgttttctaaatattgctaacttgaatgaatataacatctctaatgagtttgaagttcatctcaggcatcagatcattcaataatgaatcaagggttagatctttcaaatagatggatgatgcttatcgccacatattttcacaaaagatttatctttctaggattttttttctttgttcttagttatgttgataggggaagcttgataattggttgtgtttagtagatatttggagatgaggaacataaaaaatgcaaaatcagtacttttctgtaatgtcaacatatgtatactaacggaaagcagtgctgcttttacgtaataccagaatggttcttgttttgcttaacgatttagcttagagttgaacatttctttacttaaaaacagcaactagtgatgctgctatgtgctagacagtaagatgaagataacctgatgatttttaattggccttgactaaataagtacttttattatacagtaggaacatatgtaaatgcttttagatccatttacaaagtattttgacagttaaaaatactttgcatatttatggcatatttctttagtgcatcctttctaatatctgttccctcccacctatccttttaaattgttgggaggaagatataaagtggtccctacttttccatgggctgggcttttgtatctcatgtggtgagacaatcctgaatcactcaagtatgacatatatgctgacatatgaacatttttaacttctgtgtggatatagagcttatattatctttgaacaacagtttttattttttcagttttattgtattttgcccttgtttgaggtacagaagtgtacaaatttaatattaatgcatttgagacaaagtgaatctttaccttcagtcagatgctctggtattaatgtgatgggaagaatgggtatgaaatgctgaaaccctggtgtcaaaaggcatggtataattagaattgttatatttcctgtctctctagcattaatatgtctctataccatttgacaatattattaatatatatcataataaatgtcgttgattatgagaagactgggctattcaaattgcatgggatatatatatatatatatttttttttttttttttttttttttttgagatggagtttcactcttgttgcccaggctggagtgcagtgatgtgatcttggctcactgcaacctctgcctcctgggttcaagtgattctcctgcctcagcctcccaagtagttgggattacaggcatgcgccactgtgcctgaccaattttgtatttttagtagaaacaggatttcaccatgttggtcaggctgatctcgaactcctggcctcaagttattcgcctgcctcagcctcccaaagtgctgagattacaggcgtaagccaccttgcccagccattttttttttttttttttttgagacagagtctctgtcatccaggctggagtgcagtggcgtgatgtctgctcactgcagcctccgcctccagggttcaagcattctcctgcctcagcttcccaagtagctgggactacaggcacgtgccactacacctggctagttttgtatttttagtagagatggggatttttagtagagacaaggtttcaccatgttggccagactggtctcgaactcctgagctccggtgatctgcccgcctcaaccttccagagtgctgagattacaggcgtgagccaccgtgccggcctgcatgtgatttttttagcgaatgcaaggagagcccaaactcaagtgttttctctcattggattcacaaatagtattttatgtagggcatttcaatttagggaagaaataaattgctttgactccctgcgttttgctcctttaaaaacacttcagttggttaattttcttatattcctgtcaaagcatagaagtgaacaggacttttgaagtattcagatcaaaaagttctaatgcaggtctccaatatataacacttacagagttgtcaatgagaaaaattgctgttggataaatccatgaatttgagtgcagcaatctgagtaacagttgcagcttattttcatattttattttggttgtataccagcaagaatttttttttttatgtagttggagttgcacatttttatatttacaacctggttttttaaacaaatcacttcgtagtctttgatgtctcttactaaaatagacatatgaaaagggtctttatggtcatcaccaaatgcttggcaacaagatgagttggtcattttaaaatgtgttaaaatttggattataacacatttgaacatatctgttgtttttgtgcatatttaagatatattaattttttttggatcaagctttacacaatacttgaagcacttctgtggagctgcagaatgaattttcgtaaacattttttaaactctttttaagagtttaaaaagatgtgcagagaggttagcaaaatcacttgattagtatgactttgggatttgttcttagtcctgttttatttttaactttataacagtccattgaaaattagaagtaataaattttaagaaaaatcaatgctctttaatttgaaagaagggtatagctgttgggttttagttttactgatttgattaatgttctgtaaatattcatgtttgctatttcaagaaatgacataagagtaaactggttggccgggctcagtggctcacgcctgtaatcttagctttgggagactgaggcgggtggatcacctgaggtcaagagttcgagaccagcctggccaatgtggtgaaaccctgtctctactaaaatacaaagattagtcaggcatggtggtaggcacccgtcatgccagctactcaggaggctgaggtaggagaatcacctgaaactgggaggtggaggttgcagttagccaagattgcaccactgcactccagcctgggcaatagagtgagagaccgtctcaaaaataaaaaaaaaaataaagtgattattcacagaaatagataatgcatgtttaataggtcggttttttgtagagacagggacccactttgttgtccacactgctctcaaactgctggactcaagcgatcttcccaccttggcctcccaaagtgttgggatttcaggcgtgagccaccatgcccagccagtaggttgggtttttaaaaacttttgcacgtttatgttttattagtataagttatcatcttgtttttgtttattcttaatttagaccgttctctttaatgtcagtaggctgccaaggattaggtttttctctctttttcagagggttccagatttttttttttctctctaagtgttcctagtgaatttcaaggtcagattagtttttgtgaatttataagttagtctaaagagtttttaaaaatttatccataaaaatgtttttttatattacaagttaatgttaaattgtaatcaggataaatttgctaggaatataactaattgttgcaacttcatatgcaaatgttgggaaagatctgttaaaactcttgcattaaacttatttgtctctaaccatgcatttaggttggataagaaaaatacttaagttagtgggtgcagcgcaccagcatggcacatgtatacatatgtaactaacctgcacaatgtgcacatgtaccctaaaacttaaagtataataaaaaaaaaaaagaaaaatacttacatagctattctaagtaacattgggatgcacagttagaagttgcagacagaataatgtttgtaaaatgtgactataatacagtgagacaaattctttttactttatagccatacatgtgtatattactctctgccgtagtcacctggataccatctctggacttactagtgtaagaattgacaactaaatttttgggttttgttacttaacattaaaaaatgacttctcttctaatactggaacagttttataatcattcatttcaaagaggtatgtctttttcctaggaagaatagtgtttcttggaatatcaagttggactagacagagtgttcagggtaataatcaggggactgatttaacaaattggatattacaacacctgttatatattagatagtcataaaatatgtgttctgttaattatgggctagcagtttctttggctctgcttggaagagcatttcatctagacttagtgaattgtgtttctagttctatagaactaaggaaaggtttgggtggaagtgaaaatataagttaaatgaaaattttattttatcctcctgtttagatttgtactttttttcgttccaggcttgtcatatcttattttaatcattttaattatttctggccctgatatggtatctgaattcttttttttttttttttttttgagacggagtcttgctgtgttgcctagaccagagtgcaatggcatgatctcagctcactgcaacctccgcctcctgggttcaacttgaagcaattctcctgcctcagcctcctgtgtagctgggattacaagtgtgcaccaccacacctggctaatttttgtatttttaatagagacagggtttcaccgtgttggccagctggttttgaactcctgaactcaggtgatccacctgcctgggcctcccaaagtgctgggattacaggtgtgagccaccgcaccaggcctgaattcttatatatttataattctatatttgcttgtttttttttttgtttttgttttgttttgttttgttttgagacagagtttctctcttgttgcccaggctggagtgcaatggtgcaatctcggctcaacgcaacctccgcctcccgggttcaagtgattctcctgcctcagcctcctgagtagcttggattgcaggcatgagccgccacgcctggctaattttgtatttttagtagagatggggtttctacatgttggtgaggctggtcttgaactcccgacctcaggttatctacctgcctaagcctcccaaagtgctgggattacagatgtgaaccactgcaccaggcctgaattcttatatgtctataattctttttttttttttggatacagagttttgctcttgttgcctaggttggagtgcaatggtgtgatcagggctcaccgcagcccctacctcctggtttcaagcgtttctcctgcgtagctgggattacaggcatgtgccaccacgccgggctgattttgtatttttagtatagacggggtttctgcatgttggtcagcctggtcttgaactcctgacctcaggtgatctgcctgccttggcctcccaaagtgctgggattatggtcgtgagccaccgcgcccagcctgcttgtttttttacctaaagaaaaatttgcacttgttttaattagttataggaaaatcatgattataaaatttaacaagttttagctttataactttactatgaatattgtctcactttattttgatttttgtctgtcttattattgtatagtcctgtttcttagccaaataagtgttaactcctgcctaggaagtcattccatcctatgtctctgtacggttttacattgcttatggaagagaagcttctgttccagttagtctctcttccatgacacagactcctgacttctgttatttcatgttttctttatttgtatatcacattttcctttttcaaggaccttactcttctgttttcattcagtcttcctcctggacttacctgttcatttgtctttccttttcctaactccttttgctttttttaaaaaaagagcacagtatctgtaatagcatcctatataaaagtctgattatactgtccttttagggggtatgtttccaaattacagtaaactcgtgaatttggtgagatcatgatatgtgagtatggttctagagatatatgagggcctcacatggaaagggaactagtgagtactaagagaagattggaagggtaacgacttaattttgcagattttctgccaaaaaaagccatttttctcattgtagcatgacatgagttggagtcatacagattcaggcttaaatctgccctgctcatgaagggagttttggggtgatagagtgttatataaaactggattgtggtgattgttgcagaagtatatacatttaatacatttatcaaatctttcacttaaaataagtaaattttactacacgtacattatgctttaatataactattaaaaacaattttgctccagtatttaccagtttgcgatatcaggcaagtcatgtaacatctgagctgtagttcagtcagttaacaaatgagtatggtaatgcctggtttcctgagattgttgaggtgaggactaaaaataatacagggtatgcagctggccaatagtaggtgctcagttaatagcagctgcaattcttaaactgtctgtttatatggaccaaacataatgaatttgctgccaccacctggtatggtaaacttagtgtgtgcttatctggtaatgactagaagaatttctatgtttctcttcaccgacttccctcttctggctttttcattagtctgcagtgctttatcctccatcgagataaaaatgctttatcctccagaatctctgcatctttttctaacgatttcttcttttccctatacttttagaaagaaatccactgtctgatctgcactgtcaacactataacaaatctcttctgaggtcgctagtgacctaattgccaaatcttttaactgcttctttttgtcttaattctgtaacatttaaaatttttgcttctggggcttaatgtggtctcatagttatgaccacctccttcacttcccctcgctagactttcctttttttgagccagagttttgctcttcttgctcaagctggagcgcaatggtgtgatctcggtccactgcaacctccgcctcccgggttcaagcgattctcctgcctcaacctcccgagtagctgggactacaggtgcactgggattacaggtgcgcgccactgtccctggctaatttttttgtatttttagtagaaatggggtttaaccatgttagctaggctggtctcgaactcctgacctcaggtgatctgcccaccttggcctcccaaagtgctgggattacaggcgtgagccaccgcaccagacctcccctcactagactaatgttgagacctttaagtgtcctttactgtcatctttagctcttactatgcttttaactttcaccttagtctgttagaaaacggaattatttacaaggcagtttcttcctattcttgactccattgtagccagattaatttttcctaaagctcagtctgatgacattgctcattttgcaaaaacttgagaaatttctgttggcatgtgaaacaaaataaaaattaagcctggacttaaaaacccttttaaaaagaaaaaatcaagtaggaagtgtgttatgtgtgtttttcatgtaagttctcactgttcagttcagagaggtagtcatataaatgagtaaatataaacaaagtgtaataggtaataaacagaaatgaataattatatgcatatcacaaaggacacttcttaaagaatattttggttataaaaacaaaacattcccttaatatctttatgcagtaagaaatatatgtgacatagaaaatgagagttcctgcataattccattccccttgagacccagtgtttaaactttaaaatgtattcttatgatttttccacctggtcatcacactaataatttgcatatatactgttactatcaacaatggacgtattcatcgcagtctgacatccttattttccgttccctatccttatgttgcagaagtctttagctgattgtttgaattctagtgatcagtttattaggccagttcactagtcttagttctagctgatgggaagataatgtggtataatgaaaggtatgtggactttttaggtacaaactttgcatgtgccacctacagctgtgtgccgtaggagatttacttgattgtacagagtaatttactcaactgcaaagtggggtcgtaatatagtataaggtcttttcaaggaacttgtgatgagagtgctgtcaagcatgtttttcataattggtagttattgtgttagatgtatgatgaaattcagaggcaaaagtataactcaagatatgaaggaagggattgaataaaagagatcagcaaaataagacttactgaggactgctttctttagttaagatttattgagggttgccttctttgcttcaggctcactttatttactagataatttaaaaaataaaaagctattgaattgtaagtgataagattttttattttctgaaatttgtctaataaggaaattctgatactctatgctctgtattcctttgactttttttttttcttttttaaagcaatctgaaacatttgaacatctcaagaaaaaaatgctggttaaaaaagagttttgagtcttatgaaacagaggcaagagatttttacttagtaatagtctgtattagagaaatagattcttagtacctgaagtctaccttattggatctgtggtctcatttgcttattgatgcaagtattgttgtttctttaggttagatgaggtcttaatcatggaacatttgaagtcacgtaaagaaggtaatgtttttttaaaagccctctactccatctgtttaaacattatggaaaatttgttatcaaaaacagtcattacactagatcatagatttggaacaccaacaagtggtcataagaataaatgaatgtttgatgatttgtttccaaattaacgtgtgtagttgaagtttatttatgctgttgtagtttttaaactatgtttggagaaggaagtatgggtttatttaccttctttggtaaaggggatcacagggatagggtatgataacctttcattagggactaaaatcaggtcatgttactaactgtaattacgcagatgaatatagaagtaaaaaaaattaggaccaaagacaaaggatagagataaattatattttagcttgtttcatcttttgaggaagttattctaattttccatttttaacagggaaatgggcttgggggtgaagtgattgtcctatgcacacaagaagagagagagccagaattcagtgtgggtcagggaggagtgaaaaaaccccaaaccaaaaaaaaaaaaaaaaaaaaagggcatcctctcagaaaggttatttgttaaagaaaaatattcattcagtaaatatttattggccaggcttttattaagttcaaggttatagtaaggcaataagagcataggtcttttccctcatggaccttgcagtcttctgggggttacagattacaaatcaacaaacataactacaaattggataaatgcagctgaggaaatgagtatgatctgagattgtagcaggagacacctagttgagaccagcgatggattagtggagtgtttgatgcaggaggatcttttctttgaaagagagacatttaagcagagaatagacggaagcgtgaaaaggagtcttttcaggcagaggaagatcctgagatgaggagcttgaactcttccacagcctgaaagaaggcttagtttagtttagctgaagcttaatgagcaaggtggggaagagtagggctgaaagtgaacctagattgtaggtagggatcaaagcagacggaaatattacatacaggtaaggggaagaattgtaggctttctcctaagtatactgaaaagccacgtaagaagtgaatgttgtagtctgatttcatttttagtttatatatatgtgtgtgtgtgtgtgtgtatatatatatattttttttttttttttttccttgagatggagtttcactcttgttgcccaggctggagtacagtggtgtgatctcggctcaccaccacctctgcctccggggttgaagctaatctcctatctcagcctcccaagtagctgggattacagacatgtgccaccacaccaggttaattttgtagttttagtagagacggggtttctccatgttggtcaggctggtctcgaactcctgatctcaggtgatccacccgcctcagcctcacaaggtgttgggattacaggcatgagtcaccatgcccagccgattcatttttaagaagttctttagatattctggggaatatagtaagtaatatcagtattccagcagaaaaatggtggacttctcaggcaagaaggatagtagtagagatgggtaaaagtggacaatttcgagatttattttggaagtaggaaaagcatttgatgattgcaggctgtaggggaagaaaggagaaaaaattaagaatgatctccagatttctattattgagtcactagacataaaacatcgtgaaatggcaaaaactggaagaggtacagataaaaggggatagagcaagttaaaaaaaaaactagatgtagagagtaggcagtttggcgttttgaaacatcttgattgagataaattaaggagtttaggggtattagggtattattttaaatcatgggaatggatgagatccccaaagaaagttaaaattacttgaaagtaccttgtagttaaattttggtcctataggagagaagaaattatttcttacctctagaaattctacaccctagagatccctgaatgaaataattgatttattcatgtatttattagatcaaagggatttttgtttagactctgtcataacccttgaatggatttttagtagctgagtacatgaattaaatggttcctatcattttctaaagccagactacctttgttttaggtatctaatagagatatgttcaacagatttgtggctaaattgtaagcaatgtgaatacataatttatgttatctgtctttggttttctggtccctgtctccattctgcaaaggttaagaatatcactttagtatgtattacatttacccttaagaattatctagtaatcttgtgtatgccttttaaaaacatgtatagtataaatatctttttgcaattttttttttcacttagtggtatgtcttagctgtctttaagagttaatacagaaagatctccattttaactgtcgtgaagtatttaatggcatggatataatacagcttagacattcttttgatggacagtctgtttccaattttttgctattgtagataatgctgcaaggaatatacttgcattttcttcagatttatgagtgttttctatagggaagattctgagaataggaattcctgagtcagagtatatgcatattatatattttaatagataactgccaaattgccctccgttattcttctataccaactgcatttccaccacttcttccacattcttcccaacactgtatattatcaaatagctaaatttaatgtgttccctctgaagtacaagtatcgattttttgttatagctgttacaaattatatatatacatatatagatatatatatgtatatatgtttttttgttttttttttgagatggagtctcgctcttatcacccaggctggagtgcagtggtgcgatctcggctcactgcaacctctacctccagggttcaagcgattctcctgcctcagcctcccgagtagctgggattacaggtgcccgccaccaggcttggctaagttttgtatttttagtagagatggggtttcactgtgttggccaggctagtctcaaactcctgacctcaggtgatccgcccacctcagcctcccaaagtgctgagattacaggcattagccactgcgcccagctacaagtatatatatttatggtatctttgtttgctatataaattttttcatgtaatggagaaatccattttattcttgtaagaaataggaataactataacaggaagtatgcaagactttaatgaaggaaactataaaacagtaccatagaggggccgggcgtggtggtttctgcctgtaatcccagcactttgggaggccaaggcaggtggatctcctgaggtcaagagttcaagaccagcctggccaacatggtgaaaccccgtttctactgaaagtacaaaaattagcagggcgtggtggtgtgcgcctgtagtcccagctacttgagaggctgaggcagaagaattgcctgaacccgggaggcagaggttgcagtgatccaagatcatgccactgcactccaggctgggtgacagagcgaaactccatctcaaaaaaaaaaaaaaaaaaacaccaaaaaacaaaacaaaaaacagaaaaaaaacccaacacaataccatagggcaagcttgtccaatccgcggcccgcaggtcccgtgctgcctaggaggtcttttgagtgtggctcaacacaaatttgtaaaccttcttaaaacattgtgagattttttttttggattttagttgttgttagctcatcagttatcattagtgttagtgtattttatgtgtggcccaagacagttctttcaatatggcccagggaagccaaaaggttgggtacccttaccatagggcatataagaaaactttaaatggaaagatgtgccagtgtctgaatgggaagacttccataatgtaaaaatgtttagtttgtctccagattaatctcttaaattcagtgaaaccctaatcaaatcccagtatatttgcatatgataccaactttaaaaggtagaagagggtaaacagtgagaaggaaaactcactcttcttcctctgattcatctacacaattctcttccctagaggcaaaccactgttgtcattttcttgggcgtttatcgagagatactgtgtgtggtgcgtttatgcattgttttataccttgctgtttacacttaatttatatttgtggttgatccttattagcatgtaagtccatttagagttgcttcattgttttgaagtgctgcatggtgttttgttgtatgtctttgtcatcattaattttatccattgtgtgttgagacatttggattgtttaaatcttttgattttaccatgaatatccttctactttttttttttttttgagacagactcttgctctgttgcccaggctggagtgcagtggtgtgatctcggctctctgcagtctcttccgggttcaagcaattctcctgcctcagcctcctgagtagctaggattacaggcacccgccaccacacccggctgatttttgtatttttagtagagatggggtttcaccatgtgggccaggctgatctctaactcctgacctcgtgatccacccacctcagcctcccgaagtgctgggattacaggcgtgagccactgtgcctggcctgttctttaaaatatgagataatatatctgttggatggatgcctaaaagtggaattgcttggtcaaagaaatgtttttttagttgccctctatagagactgtaccaattaacagaataggagtcttgctgcatgggatattgttaagacttggtgggcctttgttaatataagagaaaattggtggcctttcagaatttaagtagtatttttgtagatacatatttaagagtgatttttgtgtgtgaactgtttattttttgtcatttattctatttgattgtggtttatctcattgattgtaggagctctttgccttcattttattacgatatgacaaaaattttcttttcataggatatcattgtttttggtatttttttcccccatatggtgtcttcttttcttaaaaaaaaaaaaaaagtatagtaacataagaccattttttaccatttttaagggtacacaattttgtgacattaagtacattcacagtttcttgtaaaaatcaacattatccattgccagaatgttttcatcatcccaaatagaaaccatactcattagcattccttgtctccccttcctcaagcccctggtaacttctgttctaccttctgtatcgaactacctcatgaatggaatcacaatatttgtccttttgtgtctggcctacttcacttagcataatgttttcaaagttcatctatgttgtagtatgtatcagagttttattcattgttaaagctgtataatattcccctgtgtatgtttaccaacattttatttagccgttcactctgttggacacttaggttgttttcaccttttggccgttgtgaaaatgcttctgtgatcattgttgtacaggtatctatttgagtcattgctttcagttattttgggtttatatctcacaatgaaattgatgggtcatagattaatatccacatgtgactttggggaaccattaaactgttttccacagtgtggtaccattttacatttttaccagcaatacagaagagttccaatttctgaaagtctttatcagcacttttctttttttaaaatttttcctccatttttaaaatgtatgtatgtatgtatgtatgtatgtatgtatgtatgtatgtatgtagagctggagtcttgctatgttgcccagcctggtcttgaactcctggcctcaattgattctttcaccttggccttccaaagcattgggattacaggtgtgagcaccaccacgcctgacctccttttttagaaaaacagcaatcctaggccgggcacggtagctcatgcctgtaatcccagcactttgggaggccgaagcgggcagatcacgaggtcaagaaatcgagaccatcctgcccaacgtggtaaacattttttgtaaaaatacaaaaattaactgggtgtgctggagcgcgcctgtagtcccagctacttgggaggctgaggcaggagaatcacttgaacctgggaggcagaggttgcagtgagccaggatcatgccactgcactccagcctggcgacagagtgagactgcacctcaaaaaaaaaaaaagaaagaaagaaagaaagaaaaatagcaatcctagtgcgtgtgaaatggtactttttttttcttttttattttaaattgtaaaaaaacaacataaaatttactatttttacgacttttaagtgttcagctcaatattagtcggtatattcacattgtcacacaggagatctccagaccttttttattttataaaaccagaactctacgtattaaacaacagttccccaattatctcttcctccggcccctggtaaccaccattttactttctgtttatgaatttgactactttagatacttcacataagtggaatcctgcagtatttgtctttttgtgactggctgttttcaggtagcatgatgtcctcatggttctacgttatagcgtgtgtcagaattttcttccttttagaagtctattgtatgtatatgtcttttaggtctgagtagtttatagtgttgtttaagccccttccatttccttactgattttccgtttggtcgttctatccatttttggaagggtataatgaagtcttcagctattatcatagagttttgtgtctatctctccttttaattctggtaatttttgctttaatatattttgatgcttagttgttaagtatctgtatgtttagaactgctgtatcttcttgctagaacgaacctttcatcaatatataatgtcctttgtctcttataaccttttttgatttaaagttaatttctgattagtatagccactccaattctcatttggttaatatttgcatatattaggttttctatcctaacagaaaatagtactcagctattctgtatctttgtatctgaagtgaatctttttctttttctttaaattgagatgggatctcactttgttgcctaggttggtctcaaactcctgggctcaggtgatcctgctgctttcggctcccaaagtgttgggattacaggcatgaaccatggtgcccggccctaaagtgaatcttttgtagacagcatatagatggatcgtgttttaaaaaattcagtctgccagtgtatcttttattataatttaatctatttatgtctaaggtaagtcttcataaggatttacctctgccattttgctgttttctgcatgtcttatgttttttcctttccatttctttttttttttttttgagacggagtctttctttgtcacccgggctggagtgcagtggcgcgatctcggctcactgcaagccctgcctcccgggttcacgccattctcctgcctcagcctcctcagtagctgggactacaggcgtccgccaccacgcctggctaatttttttgtattcttagtagagacggggtttcactgtgttagccaggatggtctcgatctcctgaccttgtggtccacccacctcagcctcccaaagtgctgggattacagtcatgagccaccgcgcccagccaaccctttccatttcttctattattgctttttatgttaaatttttctctagtgtaccatttgattcccttcttttctatatattttaaaagttttttttttttttgagacggggtcttgctgtgtcgcccaggctggagtgcagtggcacaatctcggctcactgcaagccccgcctcccgggttcatgccattatcctgcctcagcctcctgagcagctgtgactacaggtgcccaccaccacgcctggctaatgtttttgtatttttagtagagacggggtttcatcgagtcaggcaggatggtcttgaactcctgacctagtgatcctcccaccttggcctcccaaagttctgggattacaggtgtgagccactgcacccagcctaaaagtattttttaaatggttaccttggggattaaaatagccatatacccttccaaaaatggatagaaccaccaaacagaagattaaatttataataacatattgcaaataacttggtttcagaagtatacaaacactctactgctgtacttctctgtcctcttcctttgtaatattattgtcatagattacatctgtatatattgtgtgctcattaatataaatttaaaattactgttttttgggttttttttttgagacgaagttttgctcttgttgcccaggctggagggcaatggtgcaatcttggctcaccacaacgtccgcctcctgggttcaagtgattctcctgcctcagcctgccgagtagctgggattacaggcatgtgccaccacgccagctaattttgtatttttagtagagacggggtttcttcatgttggtcaggctggtctgaaactcccgacctcaggtgatctgccttccttggcctcccaaagtgctgggattacaggtgtgagccaccgttcccagcctaaaattactgttttgtgcctttatcttttatatcatataaaaaaattaattataaacctaaagtacattaccgctgacttttctgttttatctctttagttaccttcactcatatgctttatttcttcttaccatgttgagttactcttcagtgttttatcatttttgctggaagaactctcttcagcatttcatgtcgggcaggtctgcaggaaatgaacttctttctgcttttgcttatttggaaatatcttagtttcaccttatttttggagggatgttttgctgcgtatagaattcttggctgacagatttttttcccccctctttctgttagcactttaaatatgtcatcccactgacttctggcttctatagtttctgatgaaaaaatgctgataatgataatctaaataatctaatgaggattccttgaaccagatgagtctcttcttttttgctgctttcaaaatttctgctctctttgaggtccacaatgtgtcttgacatggatatctttgagtttatcctgcttttggagtttgttgagcttcttggatatgtatatttatcatcatcatattagggcagttttcagccattgtttcttcaaatgttttgttaactttggaaatctgattcccccagtctttatagatcgcagattttttacttgttgagggatagagctgttcacgtgactttttctgcacttttttttttttttttttgcccagtttatgtttcttgtttgtaggcactggagtttctcttccattatctgtgtggtgaggtactgacctgacaaaaatttccttaaatgtctgcagagaaaagagaaaatggtcatgtctcagtaaatctgtgatagatgctacagggaaagctgctcctgcccagaaggctgaaaccaaggaagtgtctgctccagaccagcccaaacacacaatcccaaattttggtaaaagttcctatcagccctgtgtacagccagctgtgccaagaacatagtatgctattcccaaagctgagttgggatgaggaatgagggatagtggctggtttgtactattcacttatgaatgatcaccagcgtctccctggattgctcctgtatttgttttaggtgtacagtcaggttctagagatccaaagtagttggtttcaatcattttttcccactcaatggttgcttgggtggaagtacttatacctagaacttcttgccacaccatttcgcctaaagtctctgtcttcatctgtattttttcttttttaaaaatttgttatttcatctgttttttttatgtcagatttacaaggatcttgtaactttaaaattataaaaataaatgttcggtattcttgtaatttatttttacattaaattttttattaaataatttttaaatttaagactttatcttgtattaacgtttatgtatgatgaggggtaggtggctccccaaatttttatttttatgttggaatttctttcggtgtgagacaagaattcaaagtaatatttctcagttgcttcccagttgttttatactacttttctgaaaaatttatataccctattgaaatttcattgtatactaaattccttgatatattgggtctgtttcagactttttttgtctgtttggtccgtcttttcttattccctacctcactgttttatttattgtagcttcataatatgctagtttcttctgttactcatctctttttagaattttcctgttcttggctgggcgtcatggctcacgcttacaatcccagcactttgggacgccaaggcaggcagatcacttgaggtcaggagttggagaccagcctggccaacatggtgaaaccctgtctctactaaaaatacaaaaagttagctgggcatggtggcaggcgcctgtaatcctagctacttgggaggctgagggacaagaatcacttgaacccaggaggtgaagtttgcagtgagccaagattgtgtcactgcactccagcctgggtgacagagcgagactccatctcaaaaaaaaaaaaaaaaaaaaaaaagaattttcctgttcttgcttattttttcatataaatttgagattcagtttatctaattaaaaattctgttagtatttttattgagatcaaagtaagtttgcagataatttagggaaaattgatatctttatgttattgaatcttgctttggaattaggtttgtttttgttggtattagtaccgtgatgaattcacggatttaagcatatttgaggccgggcatggtggctcatgcctgtaatcccagtgctttgagaggctgaggtgggaagatcacttagggccaggagttcaagactagcctgagcaacatagggagacctcatctctacaagaaataaaacaattagctaggcatggcggcacattcctgtagctctagcttctcaggaggctgaggtgggagaatcacttgagtccagatgttcaaggctgcagtgagctatgatgatgccattgcattccagcctaggttgccagtgagaccctgcctctaaaaaacagaaaaaacaaaaaacaaacaaacaaaaaaaaaaacaaaaaacaaaccccaaaccacatatttgatgtgttttaattaattgcagtgatttttattcatgttcaaattgtcctatctttggccagttggagcctattcatgttggctctggagtccttttaactccattagtcttcagtagctttcttgctatctactataagcaagtgttttgggctaatcttacacatttcctgcctctgacctgcaatataccatttctccaaggagccctggtttcagtaggtgggaaatggtattttcatctattggattttaagtttctgcactcatatttttaacatggagaagtacctttttcctcctgtaaatacgaattttttcctagcattccgttcatttttgtggatatcttttcttttctctctgaatatattattttcttaaaatgttttctccccttagatagttactgtttctaccaacttgagtttttcatcccatttgttttcatcatgaagatatctttcatatctttactcagctgtcaggtagtccttggttgtctgttcgtggtgcatgtctaaaagctgtgtggacactctaagccgttgagggtcacagtacactgtcgatgtcacatttcattaagggatgatctgggtggatgtttgttgggaaatctccattcttgggtatctttttatgaaatcatgtttccagaaagagccttccaatttcctgaatggggagatgtgtgacttgcagttttaggtggaggttaggtctcagcaccagtcctgagtatgtatcagtttattttatacctcagattcaactgaaataaagagcttgcacctgaactgtgccttaaatcttcctgtccaaagtcaatcttttactttctccaaagattaaacttgtggatttatttggatgggaaaggaaatgtaggtttctaattgcttttcagtagttttcactgagttgtctattagctgtcttttttttttttttttttttttttggagacagagtctcgctctgtcacttagactggagtgcagtggcctgatcttggctcactgctacctccgcctcccaggttcaggtgattcttatgcctcagcctcctgagtagccgagattacaggtgtgcgccaccatgcctggctaattcttgtatttttagtagagatggggtttcaccatcttggccaggctggtctcgaactcctgacctgaagtgatctacctgcctcggcctcccaaacattagctgccctaagtacgtcatcccctttggagaagagatgctgctattaggttggtgcaaaagtaattgcagtttttgccattactttcagtggttcctgaacctgttgagtattctattttgaactgttgcctcattcctctgcaaattgttatgttgatgaagatagttcctaccttgacaagtgaatgttaactgcagtttcatttgtaatttgttcatttcaaaactttgcttcctgtggattcagtgtttacctttttcaggcctgctaagtcagatacaactaatccatgcttatctgccttccctcttccaaaattttagtgcacttgaattctctcctatcttcccttccttgtaggtttgtcgttttttttaaaaaaacccttactgtaggtttagttgacctttggatggaagcaaaattttatggccgttcagttgactgatttctacatattaatttgttatgtagatacaattattttactatataaactcactgtctataatagtttttcaggtaaatcttccgggtctttgggggtaaagaattgtataatttgtatataatattttccccactttcactttttttttttttttgagacggagtctcattctgttgcccaggttggagtacagtggcacaatcttggctcactgcaacctttgcctcccacattcaagcagttctcctgcctcagcctccggagtagctggaattacaggtgtgtgccatcatggcacggctaatttttgtatttttagtagagatggggttttgccgtgttggccaggctggtctcaaactcctgacctcagatgatccgcctccctcggcctcccaaagtgctgggattacaggcatgagccaccgtgcccggcctcacatttttatatttcttcatttcttttttgtgtaatcacattggctgttacttctataacagtgctatatggtaatagtagaagaatgttcttgtcttattcttgactttaatgataatgcttttaataattctttcttcctataattccttcttcctattttattaggaatttttattttattatttttttcttttttaagatagagtctcgctctcttgcccaggctagtttgcagtggtgcaatcttagctcactgcagcctcgacctcctgggctcaagtgatcctcccgcctcagtcccataagtagctgggaccacaggcgtgcatcactatgcccatctaattttcctattttttgtagagttggggtttctccatgttgcccaggctggtctccaactgcgggctcaagagatctgcccgccatggcctcctaaagtgctgggattacaggtgtgagccactgtgcctggccaggaatttttattcttaacattttaaatctatcatattaactcagaactattataagtgccatgaatacatactgacttataacactctttgctgtaaaaaagagttcaccttagctttctttgtaattctttaacgatacttagaaagcgtttagataggcttataagggagaagatgatgaatacttttgttgaagcactttgaagtgctttctttgtgattttgttttttgaaggttcagcctttttcagcaagcactaatattttcttgatacaaatatatgaatatttatattttaactattaccttttcattgttttttcatgacaacatcaactgttgtgttaattaattctcactgaatcaaaataaagaccaaatagaactgaaagcatttatgatttataatgtggagtatcacaaggcagcttaaaaattaattggaaacttactgaaattctgaggtacaagcaccagttgtctggtaattgtttaggagttaggtaagtatttaggagtgtgctaagtggttttcacatccagttatacctttgaattagaagaaaagccatgtgaactatttttataccatttactgtagtaaaatggaaactcagataagttatttgtttagtcttaaatagttagaattgactggaggtagaagagtggcggctacatggagtagattttactttgataatggagaagtggtcaacttctaattggattgtctttctttaaaggactaagtagatgttttctggttgaaacattatttctatgatatgtagaagtgaccaatattatttacagtctatgattttaagatagctgtcatagttgaatggttattctgtttcgagaagtagattgctgcagggatctaactgtggtaaagaaagacctattttaggctacactattttcttctaaggagatcgaattgacacatagcagccaccagagggaactgtgatatcagttctagcttttctgccccagaagtggttttcttctgttttaagtatgccaaaacaaaggagccaaataacttatatattaaaagcctacacattttataacatctgtagatttgggctgagctgttacctcatttctgtgaaaatcattatgttgatcaggtactttccttatgacaagtgaatgttaaccgcaaattcagcttcattgtgttttttgttgttgttgagacggggtttcactctgttgcccaggctggagtgtagtggcatgatctctgcttacagcaacctctgcttccctggctcaagcgatcctcccacctcagcccccgaagtagctgggactacagatgtgcaccaccatgcccagctaatttttgtattttttgtagagtcaggatttcactgagtcaccagggctggtctctaactcctagacacaagtgatctgcctgcctctgtctcctaaagtactgggatcacaggtgtgagctaccatgcctggccccattcattgttttttaaatcccattgtaggttggtactttgggcttgctgtttcttttgaagcttgtgtattttgaatattgatttggttattttattgaatggttgtgttttttttaaaaacaataagagctgtggccaggcacagtggcgcctgtaatcccagctactcaggaggctgaggcagagaattgcttgaatccaggagacagaggttgcagtgagccgagatcatgccacggcactccagcctgggcaacagggcgagacttggtctcaaaaaggaaaaaaaaaaagaaaaatttggccgggcgtggtggcacgtgcctgtagtcccagctactcgggaggctgaggcacaagaattacttgaaccctggaggtggaggttgcagtgaactgagattgcaccactatactacagcctgggcaacagagtgagactctgtctcaaaaataaataaataaataagtaaaaaagccgggtgtgataacgtgcgcctataaatcccagctactcaggaggttgaggcaggcaggttgcttgagcttgggagttcgagaccaggtcagggcaacatggcgaaaccctgtctctgcaaaaaaatacaaaaaaatcagcctggcgtgtggcgtgtgcctgtggtccccgttactcaggagtctgagacaggaggatccgttgagtccaggagttggaggttgcagtgttgcagtgagcctagatcgcaccactgctctccagcctaggcaatagagccagactctctcaaaaaaacaaacaaacaaacaaaacaaacaaacaaaaagaagggataattctgtttaaaagcttaacctagcacacacctatagtcctagctacacaggcaggaggagcacttgagcccaggagtccagcatgggcaacatagaaagatcgccatctcagaaaaaacaaacaaaaacaaaaaaaaaaagaggggtgattatttactttacccaaagacctataaattactacttcatatcctaagacatttcagaaattaaaatataaacatcattactctaaggcagttccttaataaggaaagcttgtttatagcaaaaataagatatactaaggagaaagtttcagataagtcctttagttacttttaaataaatttgaaaaaaaaatttttaacatttctattacagaaagttttaaaaattgaaatatactgaataacattttcattcaaaattgtcataactaattcaattaaaattttttaaatacaagtactgtcatcagtaataactaacattcttttaatggttattatggaccaaatattcatgtcaaacactatagcagccccttaaagtagaatcattattatatcaattgcacagattaaaaaaaaatcctcagcggggcacggtggctcacacctgtaatcacagcactttggaaggccgaggcaggtggatcacttgaagtcaggagttcgagaccagtctggccaacatggtgaaaccccgtctctactaaaaatacaaaaaaattagccggtcatggtggctcatgcctgtaatcccagctactcaggaggctgaggcaggaaaattgcttgaacctgggaggtggaggttgcagtgagctgtgatcgtgccactgcactccagcctgcagcctgggcaagagagcaaggctccgtctcaaaaaaaaaaaaaaaaaaaaaaaaaaaaatttcagcagttaagtaagctgcttaaaaccacagcaagaaaatggtagaggtcaggatttaaatattcacagctattaagcaaaatgaaattaaatattaataatgtaaataaacaatgcagctcttattttttttttcttgagacagagtctctcaccgtcgcccaggctggagtgcagtggcgcaatctcggctcacggcagaatccacctccttggttcaagcgattctcctgcctcagcctcccgagtagctgggattaaaggcgcctgtcaccacgcctggctaattttttgtatttttggtagagatggggtttcactgttttggccaggctggtctcaaactcatgacctcgtgatctgcccacctgggcctcccaaagtgctgggattacaggcgtgaggcaccgcacccgggcgccccgctacgtgtgtgtgtgtgtgtgtgtgtgtgtataggaaagatggggttttgtcgtgtgtgtgtgtgtgtgtgtgtgtgtgtgtgtgtgtgtgtgtataggaaagatggggttttgtcatgttggccaggctggtctcgaactcctgagctcagacaatctgcccgcctcagcctctcaaagtgctagggttacaggcgtgagccaccgtgcccagcctaatttttgtattttagtagagacagggtttcaccatgttgtccaggctgggcttgaactccagagctcaatcttcttgcctcagcctcccaaagtgttgggattacaggcgtgagccactgccctcagcccattttctttaaagcagtaataaatgtatcttttgcgattttccagtctcagcatgtctttcatctgacagcagatagacacacagctctttctctgagaggaatagagactggttttgaaaccgagctctgtgtatagtgtttgaatcctttactgtcttgggaccttgggcagttttaattaatgtgtgagctgctgttttattatagaaaaaaattctgttttcttttaactcaaaggggttgtcacagttatgtgagaataaaataagaccttggtattctgtaaaatactgtatgtttttgaaaatatttcattttcttactttgttgagtggtagaacagtgctcttctgacactagaacttggtttatggtcagagaataatacagtatatataaactaaagggctagagtgtatacttggataattaaataatgctgttacttaaaaataactttgatagttaaagtgaacataattggctttggtttctgatctttcctcaaatatttgggacaattgtctactctgtgctcaagcattgtgttaggtcttagagattcagtgaaaagacgagttacggccgggcatggtggctcactcacgcctgtaattccagcactttgggaggctgaggcgggtggatcacgaggtcaagagatcaagaccatcctggccaacgtggtgaaaccccgtctctactgaaaacacaaaaaattagctgggcgtggtggcgcatgcctatggtctcagctactcaggaggctgaggcaggagaagtgcttgaacccaggaggtggaggttgcggtgagcaagatcgattgcgccactgcattccagcctgggtgacagagactccatctcaaaaaaaaagaaaagacaaattaatgattcattaaaaagttagtatacccatatttgatgtctgtgaaaagtgcttattctgcatctctttttgtatctggagattgcatctttgactagaattttgtcaactgtatatcatcttccgctaagatgactccttttccttcctttattcagtcagatgcttagctgcatgaaactctagattaaagcagaatccaaagtgcatctggttgaccactcaccctcccctgcgtaaacttctgcccttcctagcaaactacttctgtcagtatgatgtgatcctctcaagagtttttttccccccatgaatttatgtacaaatatatatacttcagggaaaatatcgtatatataggtttttgggatatgcataacatcacagtagtaattttctttgtgttctctaactttttaatttttaatttttgtgggtactttgtaggtgtttttgtgggtacactgtaggtgtatttatgagttacatgagattgtttttgtttttgttttctttttgagacagagtctcaccccatcacccaggctggagtgcagtggtgcagtctctgctccctgcaacctccatgtcccaggttcaagcgattttcgtgcctcagcctcctgagtagctggaattacaggtgcatgctaccatgcccagctaatttttgtatttttagtagagatggggtttcaccatgtaggccagactggtctctaactccggacctcaagtgatctgcctgcctcagcctctgcccgtctacatgagatgttctgatacaggcatgcattgtgtgataatcacatcatggagaatggaatatcccttcaactatttatcctttgtgttgcaaataatccagttatactcttattttaaaatgtacaattagattattattgactatagtcaccctgttgtgctatcaaataataggtcttattctgtttttctgtgcccattaacccccacctcgccactacccttctcagcctttgctaagcatccttctactctatctccatgagtgttctgtaacttttaaaagtcatcagtataccttgtagattttttttcatgtcagtaagagatcttgcttttaaaataccctaatctgttcactttttctcatctcccatcaccaccctttttcagccactgtcatctctcacttggaccatttcaatggccatctagtttgtttctttgcttccagtttttccctcttgttcccacatagcagccacagtgatctatttaaaacctgagattgtatcacctctttgctggaaacatggcagtgtttcctgttccagtaaaatccaaactttcacctttagttagaattaatgctttctaagcttaggcagggctgtttacctgttttgattactgatttttgccatgtgcctagaaagtatcttgtgcatactaggtgctctgtaaatctgttaaatgtaattaatgaattagctagttggccttgatgtgttattctctgcctgtttatctcattttatcctcctctttgcttcttactttgatctgccacattggctttattctgctgcttggattggccaacttcattccctctaggctttgcagaagctgttttctttgcctggaatatcctgtccccagttttctcacagctgaatcttatcatttcgtatttcagtgtaaatgtcacttgcttaaagagatgttctctgatcaccaaactagttatctcttcaccttctgttattctgtttaaaagtttttaaatttagtttaaaaaaaagtgataaatcacgtggcccaaaattaagaaaatgctacaagacgtacagtgaaaaatgcctctaccactgtcatctgtaaatcaaagcaatacatattagtctcttttttatcctttcagaggctctttaaatgaagtgtttttaaaccagtctttaagaactatatagccagtatctcctcatcttttcagataatacactatgaaaattaggccaaaccactgtatataagccacttcaacttcctattcatcctatctacaatttaatctatagtctatacttgcccttcagttttacctcttctagttggttccccttgcattttgccccccaagtttgatctgtgagatcaaaatggttcttgttcagagttagtgatattaccacctgagcccatgatctgtctcatctccatttgctcagtaactttgtcctagaaattttctctctgtgtgtgtgtgtgtgtgtgtgtgtgtgtgtgtgtgtgtacgtatgtgttttcttttgagacagggtttgctctgttgcccaggctggaatatagtggcacaatcgtagctcactgcaacctcgaactcctgggctcaagtgatcttcctgcctcagcctcctaagtagccaggactacagatgtgcgccaccatgactggctgacttttaaattttagtatttagtagatttgaggtcttgttatgttgctcaggctggtctcgaactcctgggctcaagcagtcctcccacctcagcctcccaaaatgctaggattacaggtatgagccattgtgtctggcctgaggttatcttcttaactctgctattttctttgacttcagcacaacctggcatataggaggtgcttagaaaatattagttgaatatagcagaatgatgagttttgaactcttgagttttagagacctgggtattcaacctagctgtgtgacttgggcaagagagttagcatctgtaagccagaatttcttttcttttctttttctttttttttttttttttcccattttgagacaggttctcactctgtagctcaggctggagtgcaagggcacaatcatggctgacgtcagcctcaaactcccggcctcagatgattctcctcttcagtctcctgagtagttgggactacaggcatgtgctaacatgcccggctaatttttgtattttttgtagagatggggttttgtcatgttgcccaggctggtctcaaactcctgggctcaagtgatctgcccacctcagcctcccaatggtcacactgccttctcttttacttgtagtctccctctgcatgtcttttataagggtacttgtgagtacatttgtgacccactcaggtaatcccatataatctcacttgaaaatccttaacattaatcatatctgcaaagtccctttttccatgtaaggttaacatttgtaggttccaggaatggggacctgatatctttggtgacctttattcagcctgctactgggatataaagcacacagcatagtgcctggcaaaaaaaagaatttatgctttctggatagggtcaaaaaagatttaaaattttcagagagatttaattgtacaattaatgggagccagagaatatgagaaaagtgggttaaaaaaagatgagatggccaggcacaatggcccatgcctgtaatcccagcactttgggaggctgaggccgagttcaggggatctcttgagcctaggaattttgagaccagccagggcaacatagtgagacctcgtctctacctaaataaataaataaataaattagccaggtgtggtggcgatggcctgtagtcccagctacttggaggtgggaggatcgccttaacctgggaggtcaaggctgtagtgagccatggtcacaacgctgcactccagcctgggtgacagaacgagaccctgtccttccccaccccccaaaaaagatgaggtaagggaaaggattatagcatgtgactttatatgatacagtgaataaatgggataagtgtataatgaagtaattattttttgtcagattttgattttttttttttcctgttcagatgtgtgggaggatttatccatatttttagtgataaattttatggagtaaatagtgtacccctgaaaggaggtggtggtggtggtaggaatatattgcatatgattaccatgaatatattgcatatgattaattatccaataaaaattggataattgccttccttgttatcctgcaaaagttaacatgtaaactatatgaaatgattaatgaatggatatcacatattttcctgaatgttagacaagaatcacttcatttagaataaaaataaaataaaagtaccctttaaatcaatggtttcagttagagtaacataaaaagtcatactgacattttaattcttttttctatcttcctaacaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctggtaagcagtaagagatactctacttcatgtaaatgaatttaaacttttggctgctgcttttttcattgtagtaactggtattaccttgtttagtttcatcatgtgaaatatgtgaattatattgaattttatcttaagtttggaattttaataagaattgtaaaaccatgtatagtatttttctgtggattactaaaaagttaatcataaagtagttttatatttaaaggatttaagaaaaaaatactctttacattcatcaccaaagtctgataatttggccgggcacggcggctcacacctgtaatcccagcactttgggaggccaaggtgggtggattgcttgagcccaggagttcgagaccagtctaggccacatagcgagacgccatctctaaatttaaaaagcaaaacaaacaaaagaatgaagtgtgataatttaatatcttgtttgtcatgcattactttttgctaatagaatttttactagtgttttagtatataaattagagaaccaaaagattaatataatagcacacttaaagaacagtgtaatattgtacagtagttgcatttagatttttttttgagatggagtcttgctctgtcacccaggctggagtgcagtggcgcaatcttggctcactgcaatctccgcctcctgtgttcaagcgattctcctccctcagcctttcaagcagctgggattataggcgtccaccaccacgcatggctaatttttgtattttgtatggggttttatcatgttggccaggccaggctggtctcaaactcctgacctcaggtgatctgcccacctcagcctcccaaaatgctgggattacaggcgtgagtcactgcacctggccgcatttagatttatttctactttccctgtgcttatttaatttaattaattagttaattttttgggacagggtctctctctgtcgcccagagtggagtagagtggcacaatctcagctcactgcaacctcgacttcttgagctcaggtgatccttccatcgcagcctccagagtagctgggaccacaggtgtgagccaccatgcctggctaaattaaaaaaaaaaaaaaaaaattatttgtagagacggagtcttactgtgttgcccaggctggtcttatactcctgggctcaaacattccttctgccttggcctcctaaagtactgggattctaggtatgagccaccatgcccagccattttattttttattaagagttggctaaggttttatttttctcacatttgaagaaagccaaacatatcatcctttttttcttttctaaaactactttaaagttatgattgacatgcaaaaggctgtatatatttaatgtctacaactcgataatgccgtgtttatttttgaccacgtatctttagcttttagttagcattttactactaaaaaatttttaaaaattatttttatttttcaagggcataaataagcaatacttttttttcttatttatttgtttattgacagagtcttgctgtatcgcccaggctggagtgcagtggtgcaatctcggctgactgcagcctctgcctccctagtagctggaattataaatgtgtgccaccatacccagctaatttttgtatttttagtagagacggggtttcaccatgttggccagattggtcttgaactcgtggcctcaagtgatccatctgccttggcctctcaaagttctgggattacaggtgtgagccactgtacccagccccccacctttttttttgaaggttgatagttttcttgactatttgaaattgttttctgtgtgcagccttgttctgtgaaaactttaaaatatggaagtgataagaactctgtgccagcctggacaacgtggtgaaaaaatacaaaatactgaaaatatgaaaagttagctaggcatagtggtgcacacctgtggtcccagctacttggggggctgaggtgggaggattccttgagccccataggcagaggttgcagtgagccaggattgcaccactgtattccagcctgggtgacaaagtgagaccctgtctcaaaaacaaaacaaactctgtgactttttcatgacatgtctgtggatgtctctctctctctttaacctctcccccaattcctctatgtgtgtgtgtgtgtctatcggcgtttctctctcacatgcctctctctgacccattctgtcatcattttaggctcattatcctagggattgtggagaataatgtgaagtaactaaaatctaggcaatgtagaatgctatatgaattgctagttatttttcttatttgtcgagtaatgtctgattattgaagactgcttagaaaatctataatttaaaacaagagctggtgccaagcatggtggctcatgcctgtcatcccagcactttgggagaccaaggcaggaggatcacttgagctcaggagtttcagaccagcctctgggcaacagagcaagaccttgtctctactaaagataaaaaaaaaactagccagggctggttgcggtggctcaagcctgtaatctcagcattttgggaggtcaaggtggacggatcatctgaggtcaggagtttgagaccagcctggccaacatggtgaaaccccatctcaactaaaatacaaaaattagtggggcatggtggtgcatgccagctgctcgggaggctgaggcacgataatttgttgaacctgggaggcggaggttgcagtgagcagagattgcaccactgcactccagcctgggcgacagactgagactctgtctcaaaaaacaaaacaaaaaaaactagccaggcatggtggtgcacacctgtagcctcagctacttgggaggctgaagctggaaggttgttttaagtctgggagatcaaggctgcagtgagctatgattgtgccactacactctagcccaggcagcagagtgagacattgtctaaaacaaataaagaaagctgagcatgaaggtgtggggtgtggagctgttgagatatgaggatcccttgaagctgggagttggagactgtagtgctctgtgctggtgcgtgttaatagccagcacacagcagcctgcgcaacacagtgagacccaatcatagtcctcctgagtaaagatgaccactatcaatgctttgggtggttgtcttttagtctttttttgtattttgttaacctagtggaaatgcagatctgtgtagttttgttgtctgttttttcctccactgcattttctcataccattaactatttatataagttttaatggctacacaatgggtattgatgtaacattcccatatttggcttttgcattgtttcccatattttgctgttgtaggtctatgatgaaatatttgttcacgttcctgattatttccttagagtatattcctacaagtgaagttactgggctaaatattatgattactcccatgcccctaacgatttttggtttaaaaatacatacctggtatatagtagtgttaaaataaatatgctcttttttactcagttttgaaatttcttgttacttctaaaactccttgtaggtaggtagaagtgtgtgtatgtgtgtatgggtgtatgtgtgtgtttgtatgagcatttttaacttacagaaatacattgtaataatgctttttagaaagctcttagcaatttatactgtcatgaactgtatgttagtctttcattgtaaccttgccgcttaaatgtgctcaaattagttttaaaatagctattttttctttcttatatgtaaaaatataaagaaaataatgttgtcttaccgctgagaatcaattaattaatagtacatgtaattctaacctgagatcatagcataggtacagttttgcaaccattcctgccattccttttaatacctagcagtagatcttgaaattttgttcatgtcaagatatgcgtgtgaaatttgtctattttgtatttagcttggttccagtttttcctacttagataattatttttaagaatattcttgtgtatacatcttgggatacttacttctttaggaatattgctggatcaaagagaccgtaacataagaattgtgttcctgtttactcaaactctgtaaactcgtcatcagaaaaactgtacacaaagagacatatgaattgggtcttgcatttatatgctgattttatttgtaatagagaataatggatgaagagctataaaatcttggctatttatattggttcttggactaattgttaattgggaaaatttaccagctatcctttcatgaaatcccttgtatgaaattgaaggtttagacaaaatgattaggccttttctattcctaaaaaatttttttgatgttggaggaaataaaaatgtaaaactagggcaaatgtaaattgaaaatagagaagcaccatttttttcagtgtcaaggcaatagatgcccttaagttttgataggctcttttaactatgtattcaagtgacaagcctacaaaatagaacaccccgaggagccactatttgtgtgggcaagagctgtttcttttagatatgttcaagcataatttttgattggaggccttttttcctttcttaagatggaattaccagttcttctagtgactttctttctcgttgattagatttttacccatttattgaaactggtcagttactgtgatgatagttaaataacagaattccagaatgcactctttattctaataagtttggtgtgttcttgtttttgtttctccaactaaggggtatgaatacagtcaggtaagatctgaatagcccctcgaaaccattaggttgatggaatgggtcagaaccaaaaaatcatcctttttaaagttttggtagtaaagaagttttcccaagctctggttgtattttgtaccgcaaggaaaataatttttttcctgtggaagggcagcttttatgtatggaagttcaaaatacggagaaactagaaaggaaaaagaaatttatgagagaccagagtagtagaaattagaagtggtaacctgaaaagtttcaaaatgaagataggttatggtattggtagtgccatgggaggcctgcagaacagcaactagtgcagcaaactggagacttctactaaacactaaagaagcttagcacaaaagagaaaatatgtcctctagcattaatagttaccacacctcagtactgtgctgtgctgaacctttgcagtggtagaggaatttgacattggattggtcagtacaggcatacctcattttatagtactttgtttattgcacttcacagataattgcattttacacaaattgaaggtttgtggcaacattgagccgagtaagtcttttggcgccacacttccaacatcatgtggtcacttcgtgtctctgtttcacattttggtaattctcacaatatttcaggccttttcattgttattatatctgttacggtgatctgtgatcagtgatctttgatgttactattgtaattgttttggatgccacaaaccatacccatatgagagtgaacctaattgataaatgttgtgtgtgttctaactctccctctccttggacctccctgttccttgagacacagcaatatttaaattaggtcagttaataaccctataatggttgctaagtgttcaagtgaaagaaaaccttacatttcttgctttaaatcaaaagttagacctgtttaggcttagtgaggaatgcatgttgaaaagcctagaaaggctgagagctaggcctcttgaaccaaacagccaaattgtaaatgcaaaggaaaagttcttgaaggaaattaaaactgctactccagtgaacacaggaatgataacaaagtgaaatagcctttttttgagacagagtctcactcttacccagtctggagtgcagtggtttgaacttggctcactgcagcctctgcctcacaggctcaagagatcctcccatctcagcctcccgagtatctaggaccataagaatgtgccaccatgcctggttaatttttaaaaaatattttttgtggagacagggtttcgctatgttgcccaggctgctctcaaactgctcaagcaatccacctgcttcagacccccaaagtgctgggattacaagtgtgagccaccgtgcccagccacaaaacagccttattgctgatgtggagaaagtttaagtggtctggatagaagatcaaaccaactatgacatttccttaagccaaagcttaatccagagttaggcgctaactctttttcagttttatgagaactgagagagataaggaaacaaaagaaaagtttgaagctagtaaaggttggttcatgaggtttaaggaaataagtcatctccataacataaacgtgcaaggtgaagctgcaagtgctgacgtagaagttgtagcaagttctccagaagatctaagataattgatgtaggtggcaacatgaaacaacggattttcagtgtagacaaaacaactgatggctctcttgttagaggttaatatacttagtgactgtaagttgaagccagtgctcatttaccattctgaaaattgtagggtccttaagaatgatgataaatgtactctgcctgtgctttatcagtggaacaacaaagccccgatgacagcatgtgtgtttacagcatggtttactgaatagtttaaactagtgttgagaccttttgttcagcagaaatgattccttttaaactattactgcccagtacacctggtcatccaagagctctgatggagatgtacaaggagatgagtgttgttttcatacctgctaccacaatattcattctgtagcctgtggatcaaggagtaattttgacttttaagtcttactatttaagaaatacattttgtaaggctataactgccatagatagtgattcctctgatggatctaggcaaagtaaattaaaagccttctggaaaggattcgccattctcagtgcccttatgaacatttgtaattcatgggagaaggtcaaaacagcattattaaccagagtttggaagaagttgatttcaaccctcatgaatgatggtgaagggttcaagactttagtggaggaagtaattgtagatgtggtggaaatagcatgagaactagaattagtagtggaacctgaatgaggctgggcatggaggctcatgcctataatcccagcactttgggtgactgaggcaaatggatcggttgaggccaggagttcaagaccagcctggccaacatggtgaaaccctgtctttactaaaaatataaaaatcagctaggtgtggtggcacacacctgtaatcccagctgcttgggagactgaggcatgagaattgcttgatcccaggaggtagaggttgcagtgggctaagactgctccactgctctccagcctgggctacagagagagactgtctcaaaagaaaaaaaaaaaaaaaaagtagagcccgaagatgagattgaattgctgcaatctcgtgataaaacttgcacagatgaggagttgctttttatggttgagcaaatagagtggtttcttgagatgaatctattcctggtgaagatactgtgaatgttgttgaaatgacaacaaaggatttagagtattacgtaaacttagttgataaaggagttgcagggtttgagaagattgactctgattttgaaagaagctctagtgtgggtaaactgctgtcatacagcagaagagttcattgatggggtaaagatcattgttatcttattttaagaaattgccacagccaattggcagccaccatcgtgatcagtcagcagctatcagcattgaggcagggccctccaccagcagaaagattacagcttgatgaaagctcacatgattagtgttttttagcaataaagtatttttaaattaagatgtagattttaaaaagatataatactattgtacacttaatagactacattatagtgtaaacataacattttttgtgaaaccaaaaaaattcccatgtcttgctttattgcagtattagcttttttgcagtgatctggagctgaaccagaaatatttctgagatatgcctgtatacattggtttaattccatcatttctgtgtaacactctttctatgagattatgtgttacatttaaaggccatgaaactaaacatatatggaaaagctgttcttaaaatatgtcttggaaataattataaactttattagacttgcattacatttgtcaaaggttctagttaggattttattattatttaatgttgatatatgtgttccttgcctaaagtgatattttataaatacgtgaatacttcctgcttaataactagtgacattttttaatacttcctatatgccagttattatgctttattatatgtcttacctcatttaatgtttaccattagcatgaggttgataccatttcaggcgctctgaagagtaaggcacagtttaagtagcttcccaatcttgtaagcgatggagctagaatgtgaaccattcttttttcttttaattaattttttaaaaaattgacaaaacttgtatatttatttattgtgtacaacatgttgctttgaagtagatatacattgtgggaatggctagattgagctctgagttacccgacataccctttttttgtgctgagaacacttaaaatctaatgttaactattttaaagaatgtagtgcattgttaccgtgacattcttactccaaaacttgtgctatatacctctctgctatgttgctgttccattaacatcttaaaattgtacaaaatgggaagttaatatttctctgatataaattttaatatgtataaacaaacacttgtttcattattctttcttgtgcattttgtttttaagattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaagtaaggtttacctttcaacataattacatatagttgaattttggagttgtaaaattttaagaaaagtgaaacagatttgtaatacctttggaaacttccctatcaagtccaggtggcatatggataaaaggcttcctgtttggatggcattggagttgatttagataggtccttataattaattttgtctgtaatctccattggactctttgattttgtaacaatacatacttatttacatgattaatgagaagaaattagttcttatagccaaataaaaatgctaagcagtttatgcgtgattctgtgttaaaattggttaaattttaccctgtcttcagatcaagattataaaattggcaagtctttggattttatatgtgtttgttttgaacattaagtcattagaaatagtatttcaagactcaggtaccaatttttagccagccttagaaaggcaggatcctctcttctactgtttttttctttttctttttcttttctttttttttttttaggcagagtctcattctgtagcccaggctggagtgcaatggtgcgatctcagctcactgcagcctccacctcctgggtcctccacctcctgggttcaagcagttatcctgcctcagcctcccgagtagttaggattacaggctttcgccaccatgcccagctaatttttgtatttttagtacagatgaggtttcagcatattgtccagactggtcttcagctcctgacctcaggtgatctgcccacctcagcctcccaaagtgctgggattataggcgtgagccaccatgcccagccctcttctgctgttttttgatctagcttcactggttaaaaatagctggaatatggtatgttatatgcaaggtaaagcctggtggcctttctgtaccatatcttggagcagctcaattctccgaagctatatttagatcttgaattttacaaagagcttagtgttctctacatgtttaataaattcaaatactgaaacaattgttacacagattgctttgcagtagtaaacttaaatactacagtgtaggatcttgaaaatcagaataaaaggaaaacttcaaaggtcatcagtattgtcagttttgttttgttttgtttttttttgagacggattctcgctctgtcgccctggctggagtgcagtggcgctgatctccgctcactgcaagctccgtctcctgggttcatgccgttctcctgcctcagcctcctgagtagctgggactacaggtgcctgccaccatgcctggctaattttttgtgtttttagtagagacggggtttcaccatgttagccaggatggtctcgatctcctgacctcgtgatccacccgcctcagcctcccaaagtgctgggattacaggcgtgagccactgcgctcagcagtattgtcattttctaatatttctatttactgttggagagccatgttaatagtgggtgaggttatttggggatggggtgtgtgggtatatttaagttcagttatccctctagaacgtataccatattccccataacccagatacctcttactttctacttatccaggggagggaattgaacaggttatacctcagtaaattaatccttaacattaattccatataactaataacagcttttctttttttagttttcccaatatttgaaatcctttttagtgaatttaaagataaattgagtagcggcaaagatttaatagtataaaatatttttgcttctcaaaagtctttatttccaaacatattttattaggaatgtctaataaaaatgatttattagatccaagaatgatgtttgatttgcaggacttagtctatagaaatgaaaaatgtcacttatgactcttatatttgatttcttttaaaatggaattttaatatgtaccacttatttttcagagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgaggtttgtattttttttctttatcatttaattctaacaaataggaatattttaaacttcatttaagaactattagataatcttttatcagttccttaaaaatgaatatatataaagactatcttataaatatcctattatgtaatctgattctcccataggatcttatcttataaatatccttttatataatctgattctcccagaggatgatttcggaaaaatcattgtgttaattgccttgtttttccctgaggttgggaacactcacagacaaaaccatagtgttgaggttgatttttgtctagtaatatatttatttaaacaagcaggcagactacacaagaaatactacaaataattttgctgagaagtagaacgattggaatattttttgataacctcacattattaatattgtgttaaataaaaagtaatctgtttatatataagtcatttgaatgatttataatggttctcccctcctcatttttctagagaaatgtactttatttatagtttttaaaaattggtctaaagatttttactctatgaagtttaatatcaccactacccaaacttggttttctgtcatcttctgatacctctagagaagtttgtagtgatgtcactgatgggtttttttcttttttcagtgccatacatgtgttcctgtgtgtataaaaacaatttaaataattatgaaaatggggccaggctcagtagctcacacctatataatcctagcactttgggaagccaaggtgggaggatcacttgaggccaggagtttgaaatcagcctgggaagcatagtgggaccctatccctacctaaaagaaaaaacattagttaggcgtggttgtgtgtgtctatagtctcagctactcgggaggctgaggtaggaggattgcttgagcccaggggattgaggctgcagtcagctttgatggtgccactgtactttagcctgggtaatgagtgagaccctgtctttaaaaaaaaaaaaaaaatttttttccttttctccaaacaagccttattaggacatctttatttctgttcagaatgctttattatttagctacttgtcagattgatctgttttgtaagattttgtttatttttcttttagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaattcatgttctaatcaaaattgggcattctttagaatgttcttgaaagtgttgtaatacttttactctaacagtgtttattaactggctttatcttagaatttcatttaattccattattgttgtcatatcatggagcatactgaatgcatagtgctttgtaccattaaagctgaaccatcgtaagtcagggaccatctgtatttattcatttgaggtaggtcatttccgtgatataatgatggagttaagtctgggtaaacccgttgtaagttggaaatgtcttagaatgcacctttgacctaggtattttcaacttagaatgggtttatcaggatgtaactccattcttagggaacatctgtgtatgtagattattggcagtaaatttaagattttacatgtaatggtaaatgctatcagaatgattcctcttttgaatttatttcctctttgggagttggagaggggctgcaaatatttcaaacttttaaacctcggcttgaagtggtcgtattgtttatatttaaattttaaggttaatgttgttatcattttttttttgagacggagttttgctcttgtttcccaagctggagtgcgttggcgtgatctcagctcactgcaacctccgcctcccaggttcaagcgattctcctgcctcagcctcccaagtagctgggattacaggcatgcgccaccacacccggctaattttttgtatttttagtagaaacggggtttcaccgtgttagccaggctggtctcgaactcctgaccccaggtgatccacctgcctcggcctcccaaagtggtgggattacaggcgtgaaccactgcacccgtccaggttaatgttattttaaggactttttgatttctagttttattccattgctcattggaaaggtagtctgtgtgatttcaatcttcataaatttatttattaaatgttttatcagaaattattattgctttaaagatctttttgttgtctgtggagaaggttatatgaactttctccctctttagttttttttttttttttttaaagacaagtttcgctctgttgcccaggctggagtgcattggcgtaattttggctcactgcaacttccacctcctgggttcaagtgattctcctgcctcagcctcctgagtagctgggattacaggcgtgcaccaccacgctgagctaatttttgtgtttttactagagatggggattcaccatgttggccaggctggtctcacactcctgagctcaagtggtctccgtgcctcggcctcccaaagtgctgggattacaggcatgagctaccacacctggccttagatttattaaggtgtgagttatatagtagtcctttctcacgcaaagttttgttttttgtggtttcaattactcacagtcagctgcagtttccaaataggtgagcagactacaataagataatttcagaaagtaattaattataggtgagtagactacaattaagataatttgagagagattaattataactaactataattgttgttgttttttgttttgttttgagacagggtcttgctctgttgcccaagctggagtgcagtggtgcaatctcagctcactgcagtctacttttcctgggttcaaatgattctccttgcttcagcctcctgagtggctgggattacaggcacatgccaccatgcccgactaatttttgtatttttggtagcgattgggtttcaccatgttgtccatgctggtctcaaactcctgacctcaagtgatttgcccacctcggccttccaaagtgctgggattacaggcgtgagccatcattcccgcccaattgttgttaatctcttgctgtggctaattagaaattaaactttatcataggtatgtgtctatgggaaacgacatagtatcaaaggtttcaggcatccactgggagcctcagaatgtatctctcaaggataagaggtggcactgccatattagtagatttcctaatctattgagccatccttgtattcctagaataaactatgccagataattattttttcaaaaatgtgcatacattctgatggctaatactttatttggtacttttgcattgatatttataagtaagattggtctgtaatgtcctttttttttgtgcattctttaaggtatcagtgttacatttgctttataaaaatgtccagaggaaaattcatttcctcatatacttaaagcagtaaaaatgaaaataaatgaattaaatagtcaactgaaaaacctggaaaaagaaaaataaactgaaacagaagaaaggaaataaagataaaaggataaactaattaggaattttaaaatagtattaacattgttcagaatgttgcctctttgaaaaatcaggtcttcaaaaaccagggaaaaaatacccaattgttaatcaggaaaagaggtttaaaaacagaaatacgtaaaataagaaatgacaaggtagatatgaagatcaaaacaaaagaacttgacaaaaatcagtcataagaaccagtttatttagccctatataaaaatgttgaacctagattaatttcctgtgaaaatataatttccccaactggacttcagcgcagacaaaattaagtggacaaatttctatagatgaaatagagataattattaaagtactaccccacaacaaggactaggctctgatgttttcataggggaattccatcaaatttaaacaagaaaatctcagtgctatttaaacaattccagagcataaaaaggaaggaaagtaactcataaggtttttaaacattgtggtagactatatgtaacataaaatttgcagttttaagtatttttaagtatataagtgagtggcattagttacatttacagtgttgtgctaccgttgactctatttctgaaactttttcatcatgccatacaaaaactgacattagccaataactcccatttttttctatcccagtccttggtaacttagtactttctgtctctatgaattcgtatattctagatattcatgtaagtgaaattatataatatttgtctttttgcatctgggttattttacctgaaagctgaaacataatgctttcagtttcatccatagtatagccatgatcagaacatcattactttttatggctgaatagtattcattatatgtatatgccacattctgtttatcgatttgttgtccctatgatagatgttgctttgttgccacctttgactattgtgaataatgctgcagtgaatattggtgtataaatttgatataagtatcctggttttccattcttttggatgagtgtggatttgctcagtcatagggtaattctgtgttttaccttttgaagaattgtcaaactattttacacaaccgtaccattttatgttctcagcagcaatgtacaaggcttctgttttctctatatctttgccaacacttgttattttccatgttttaagcttttgatttttcttgtagatatcttagtgcatgtgcggtggtatctcatggttttgatttgcatttccctaatgactaatgacaatgaacaatttttctttgttgttgttgttttttttatttttgagacagagtctcgctctgttacccaggttggagtgcaggtgcacaatcttggctcactgcaacctctgcttcctgggctcaagggattcttctgtctcagcctcccgagtagctgggaccacaggcacgggccactacgcctgtctaattttttgtatttttttggagacatagggtttcattcgccatgttgttcaggcctggtctcgaactcctaagctcaagccatctgcctgccttggccttccaaagtgctaggattacagtgtgagccaccgtacctggccagtgagcaatttttcatttgcttgttggccatttgtgtatcatctttggagaagtatctattcaagtcctgtctctgtttttgaattgggttttgtagttcagttcttttttctctttttgttttttgtttgtctgtttgtttgtttgtttgtttttgagatggagtctccctctgttgcccaggctggagtgcagcagcgagatcttggctcactgtagcctctgcctcctgggttcaagtgattctcctgcctcagcctcctgagtagctaggagtacaggtgcgtgccaccacacctggctaatttttgtatttttaatagagacggggtttcaccatgttggtgaggctggtctcaaactcctgacatcgtaatctgcccgcctcggcctccccaagtgctgggattataggcatgagccactgcgcctggccctcttttatttttagttgatatgtaatacttgtatatacgtaggggatacagagtgatgtttttatacatgtataaaatgtggaatgttcaaatcagggtaattaggatagccatcaccccaaaattatttttttatgttgggaacattcgaaattctctcttttagccttttgaatctatccaataataattgttaactgtattcattctatagtgctatggaacaatagaacttactcctcctatatagctataattttgtatccctttgtacttttgttccggagttgaagaagttctttatatcttgtacagtttgagtatcccttatctgaaatgcttgggacccaaagtgtttcagattttaggtttttcaaactttagaatatttacattatacttacattcaaacaatccacatctgaaaaatccaaaatgcaaaatgcttcaatgagcatttcctttgagcatcatgttggtaattgaaaagttttgggttttagagcatttcagattttttgcatttgcgttgctcattctgtatatgttttgcaaatactgtcttccattatgtaggtttttgttttactttctcaataatgtcctttgatgtgcagaagtttttatttttttgttttattttttttttttttgaggggtgaaggagtcttgctctgtcacccaggctggagtgcaatggcacgatcttggctcagtgcaacctctgcctccttggttcaagcgattctcttgcctcagcctcccaagtagctgggattacaggtgtgtgccaccatgcctaatttttgttttttttttttcttttttgagatggagtcttgctctgttgctcaggctggagtgcggtggcacagtctctgctcatgcaacctccacctcccgcgttcaagcaattatcctgcctcagcctcccgagtagctgggattacaggcgcacaccaccatgcccagctatttttttgtatttttagtagagacggggtttcaccttgatggccaagctggtttcaaactcctgatgtcaagtgagccacctgcctcgacctcccaaagtgctaggattacaggcgtgagccacagcgcctgggctaatacttgtatttttagtagagatggggttccaccatgttggccaggctggtctcgaactcctgaccttcagtgatcctcctgccttggcctcccaaagtgtgaaattacaggcgtgagcctccgcccctggtcttttttttttgagatgggtctcggtctgtagcccaggctggagtgcggtagtgcgatctcagctcactgcagcctccgcctcctgggtccaagcgattcttctgcgtcagcctcccaagtagctaggactataggcataggccaccatgtcccactaatttttgtatttttttttagtagagttggggtttcaccaggttggcaaggctgacctgaaactcctgacttcaagtgatctgtccttctcagcctctcaaagtgctgggattacaggtgtgagctaccacgcccagctggaagtcttaaattttgatttacccattgttttcttttggtcgtgctttcggtgtcatttaagaatctgttgccaaatgccaggtcatggttttcctctacagtttcctctaagagttgtatgagtttagctcttaattaggtatttgatccattttaatttactttttgtttattatgtgaggcaggggtccaacttcattgttttgtactggaattccagttttcccaccaccaccacctgttgatgaagggattattctttctctgtggaatggacttatcacacttgtcaaatattaattggccagagatcatttctatgttccactgatctacatgtgtgatctgatgtatgtgctgcactattttgattactgtatctttgtagtaagttttgaaatcaggaaatgtgagttctccaactttgttttttgtcaagattgtttgaatattctggacccattctaattttatatgaatttgaagattggcttttctatttctgcagaagagtttgttggaatttttatataaattgcattgaatctgtagattgctttgggtagtattgacatcttagcaatagtaagttattctgtctgtgaaaatggcatttatttatgaagacataccatttatttatgtctttaatttctttcagcagtcttttgtggtttttagtgtacaagtcttcacctcctttgctgcatttattcctgtttattcttttaatgctatttctagtggatttgctttattaatttccttttcagattgtacattactagtatatagaaacatctgatttttgtacattgatcatgtactgtgcaagtttactgaatgttagctctactagctttatgagtttcttggtatttttctctttatgagtttcatgtcatctgtgaatagagatagttctacttttttccaattcggatgcattttatttcttaactaatggttgtggctataattttcaatactgtgtcaaatagatgtggtgaaagtgggcgtccttgttgctgatcttagaggaaaataatttttttaccattgagtctgatgttagaatgggttgttcatatgcatggcttttagtatgttgaagtagtttctttgtattactttttttattcagtttttttaatcataaaaaggtgttgaatttttcaaatgctttttctacatcctttgagatgatcatgtggtctttatctttgctcttatttatgtggtacgttacatggattgatttctttatgttgaaccacacttttattgggataaatccctacttgattatggtgtataatccttttaatatattgaattcagtttagtagtactttgttgaggatctttgcatctatattcttgtgggatactggtctctgattttctttcttttgatgtctttatctgtctttcaaatgagggtaatgctggccttatagaatggggtgggtgagacatcttgtatcttctgatttttggaagcgtgggaattggtgttaattctttaaatgtttggtagaatttacctgtgaagtcatctgatcttggccttctcttttttgggactttttgtttgtttgtttgtttgtgagacagagtctcactgtgtcacccaggctggagtgcagtggcgtgatcttggctcactgcaacccctgcctcccgggttcaagcaattctcctgcctcagcttcctgagtagctgggactacaggcgcctgccaccacgcccagctaatttttgaatttttagtagagatggggtttcaccatgttggccagaatggtctcgatctccagacctcatgatccacccgcctcagcctcccaaaatgttgggattataggcatgatccactgcacccggccaggacatttttgatgactgagtctattgttacaggtctgttcacgttttctatgtcttcttgtgtcagttttggtggtttgtgtgtttttaggaatttgtgcatttcatctaggctgtgtaattagttaatgtactattgttcatagcattttcttgtactactttttacttcaggaatgctggtagtaatgtctcctatattttattctttgtgtctattctcttggtattttaaaatgaccaacttttgggtttgtttctctcactttttctgttctgttttatttttcctgctctaatctttattatttcctttcttctgctggctttgggtttagtgatctcgtctttttcctcaaggtggtgagaagttaggttatttactttaggtttttttttttttttttttttggggacaaagtctcactctattgcccaggctggaacgcagtggcatgatcttagctcactgcaccctcacctcccaggttcaagcgattatcctgcatccgcctcctgagtagccgggattacaggcatgtgccaccacacctggctaatttttgtatttttagtagagatggggtttcaccgtgttagactggtcttgaactcctgacctcaggtgatctgctcgcctcagccttccaaagtgctgggattataggtgtgagccaccgtgcctggacttactttctttctttttaacataagcatttaaaattttaaataaatttttctctgattagtatttaagttgcatctcataacttttggtattcttttagttttgttttcactcatctctaagtatttaaaaatttcctgtgatttcttctttgagccatgtttaagagtgtgtagtttaatatccccatatttgtgaattttctaagtgttccttctattactgatttctagttctattccattgctcattggaaagatactctgtgtgatttcagtcttcaaaaatttattgagacttttttgtggcctaacatagttcattctggaaattgctccatgtgcatttgagaagaatgtttattctactgttgttggcaagaatactcaatatatgtttgttattaataactctagtttatattgttgttcaagatttgtctttacttagttgaaattctgtctagatggtttgtccactattgtaaatggtgtattgatgtctccagctattattgtacaattatctgcttctacctcagttattgtctatttctccttttacgtctgttaatttatttaagtgtattttgggggttttgatacttggtatgtatatgtttatatttgttatatcttcttggtaagtagaccctttgttcagtatgtatttttctgtctcttgtgtcagtttttcacatataggctctttttgccttatattaatatggcaaccccaactctcttagttactgtttatttgtgtggagtatctttttccatccttttacttttgacctgtttgtatctttggataaataaatccttccttatcagtaattacattaaatgtacatggatcaaattatccgatcaaaaagcagaaattgacagaataggaaaaaaatgatgccttttgattggataatttgatccatgtacatttaacataattaccaataaggaaggatttatttctgccatttttctattttttttcggtatattctataccttttttttggtatctcatttcctgcattatggcttttatgtttagttgattgtagtgcactgttttgatttccttctcattgtctttgtattgtttttaaatatattatttgtggttactgtgggggaggctttacatataacatcctataattcaatctaatgtgaatttataacaagttaatcagcttttaaaaatgctgctcctatatatctgttccctctttttgttatagattacatttttaagcattgtattcccagtaatatagatttacaattttgtgtgcatatttgtctttaaaatcatgtaggaaataaaaagtggatttataaagcaaaaatacaattatacttgttttgtattctcccatatatttactaaagattgggtcaagtgtattccttccatttcaataaaaagctttgactccttttagcatttgttttgtagggtagatttagtggcaacaaactccctccaccttttatctgtgtgtctttatttttccttcagttttggatgatagttttgctggacatagtattcttgtttgaaagcttttttttctctattattttaaatgttattccactgccttttggcctccatggttgtttcttttgtgaaattgatggttaatcttattgagaatttcttgtgctgaaccatttctgttttgcttctttccgtattttctttgtcttttaacggtttgattataaagtgtcttattgtgtgtctctgagtttatcctacatgtaatttgttgtgtttattagatttgtagatttgtgtctgttatcaaatatggcaagtttttagccattaatttttcagataatcttttgcccctttctcttcttctgaaactctcagaaagttcatgttggtctatttgatcttattccatgggccccttaggcttttgcttactttacttcattctttcctttactgctcctcaggttctgttacatcagtcttggcctctttactgcaaattgttggtaaaagctctggctttctgctgggtcagaccacctcagttagggtagaggtggttaaggtgtctaattaccacccagtggggtggaagttcaagtttcctacttggccttctctgactttaccatggctagggtgctggggtgaggcatcacattgtagcccggccagggtggaagtctaggctaattggccttttcttgtgtgaatgggattagggtctgtggagtagaggagctgttgtcttactgtttctctaggctgctatttcaactgtatttcacctacaggtgtgtcatttctcttgccagattcaagattttttctttgtctttggttttcagaaatttgaatttggtgtatcttggtgtttctttgggttttatccttcctagtgtttgctaaccttctatctgtagatttatgtcttttgccaaatttgagacatttcaaacagtagtgtttttggaggacttttctaactctgtcctctttttcctttccttttgggactccagtgacatgaatgttacttttttttttttgttacaagcctacagatccctaaggctctgttttacttttccccccacccagtctgtttttcgggttgggtactttttattattctgtcttccagttcactgattctttccattttattcttctgtatatcttctatttcttttctagaagtttctgtgttttcatttgttttttaagtgcatgtgtattggttattggagcacttttatgatgactgctttaaaatctttgtcaggtatttccaatatctctgtaattttggtgttggcatctgttgattgtccttttctatttaaattctagttttcctggtgtttggcatgataaatgatttttttatttgaaacttgaacattttgagtactatggtattgccaagtggagttaaaaggtcggcctctctacttggcctctctacatctgtgagggagaagcagcttcttgttattgctgagtggatatgggagttctggctcctttctggacattagctgataccaccctgactagaggagtaggagttccttatactgttccccacataatctctactgacaccaaatgattcttcttcagtggatagagaaaatgttcttagtactattattacataaataaaaattatttaaaatagtgtttcttttattctttaaaattacttgcatgttttgtaattacatactatatgttcataattcattagttaaataaataggtgggagtccatgccttactattttactgataaagagacccaattggatgtgtttggagacaactacatgagatgctatagtgaatgtcttctttctctgcaacctgggagctaaaattgtatcataatccttccttactttcctctcaccccctttgtcctttgtctgttatatttaacttagctgccttttgttgtttatctgtgctctcattgctcacttagtttctgaagtgtattgatacacttagttaataatctagatcctggcagtggagactgtataatgcttgtcctgtgcctttcagtagttttccttttctagcatagtattttgactttcatggaaagcaggaagcatatcttttaaaacttttgtgcaaggagtaaggatatgtattcgtattatatgctggaaactgtcatatgtgctttcaaaagaatttctcaaacatgccagacacggtggctcacgactgtaatcgcagcactttgggaggcccaggtgggccgatcacttgaggtcaggagttggagaccagcctggccaacatggtgaaaccctgtctctactaaaaatacaaaaactagccaggcgtagtggcaggcgcctgtaatcccagctactcaggaggttgaggtgggagaatcgcttgaacccaggaggtggaggttgcagtgagccaaaatcatgccactgcaattcagcgtgggtgacaaagcaaaaactccatctcaaaaaaaaaaaaaaaacaacaacaacaaaaaaaacaatttctcaatccattttgcatatggtggaaattgtagctgtataatctccaaatgacttaatttagaaagcttcgagtttcattataagtgttaacagtttttaaagagatcttagaacactccaaattagaagtgattttactcagaaattagaggtgagtcagatctaagtatctatctttaattccttagcccattattactgttttatcatcataccattttttctaagataaaattatttgataattctttaagttgggcaacagtagtggggacaggacaggcagacatttttaaaagttggaatgagtttgtaagtcacaaaatataattgagaagcaacttttacataatgcttatttacctttcaatgtagcagctattctttatgtgtgtttataaagtcttttaaaatctttttttaggtaggtagccatccaagcttcctgaaggaggttcgagatcacatgcaggactctttcttaatgcagcctgaggtaagcaggaatgtaaatggagttcaaggccttaacatttttgagcactgctactactgtcattaatatgtatctgaaaaatcttgtccaatttgaaatatattaaaatttccaaacttaaattgtatcaaatgatgaatgttttatctctgagacatagatttctaatttcactaattttacatgtattttcttgtgatatgctcatttgtctttagttatttatgttcttaggaaattattttcagatttttttagtgcacaataccttgtacacagtaggcatttaataaagggatataaaaatcctctcttttgtgcctacctgaaaagttaaaaaaaaaaaaccctttctttcaaaaaaatttctaagtctgtgttcctgttaatccagataaatgaattagtaatgagtaataagtgtttaaaattaggaagacttttaactgtagtacagttatcaagataatgaaatttacatcagtaaactattattgtcaggttagtcaatagagcgtattcaaattttgtctgttaatgtcccttacagcaaatgaaaaacaattatttcttgtctagaatccagtacaggatcataggctattattattcctcttctttttttttttttttttgagacagagtttcgctcttgttgcccaggctggagtgcaacggcaccatctcggctcaccgcaacctccgccccctgggttcaagcgattctcctgcctcagcctcccaagtagctgggattacagtcatgcaccaccacacccggctaattttgtatttttttagtagagatagggtttctccatgtcggtcaggctcctgacctcaggtgatccacctgcctcggcctcccaagtgttggcgttacaggcgtgagccaccgcgcccggcccattatttctttaaatatagtttttaggccttttcccaactctcttcttctgagaccccaattccagataattcctgccactttcccacagtcactgaggcttgttttttgttttttgttttttggtattgttttgtattgtttttgtactgttttgtatttattttgcattgtggtttgtatttgtattgtttttccctagtctttttttccttctgtactccattttggaaagtttctattgctgtatctttaagtttgctgatcttttaaaatcacctgtgaataccatgcagcatattttttcagatgttatgtttttcgtctctaaaagttccatttgtctcttttgtatcttctatttcctgcctaattatgttcatgttttcctctactaatattttaatatattagcatatttataatagttcttttaacatctttgcctactgtttactttttttttttttgagatggagccttgctctgtcacccaggctggagtgcagtggcgtgatctctgctcactgcaagctccgccttccaggttaacgccattctcctgcctcagcctccctagtagctgggactgcaggtgcccgccaccatgcccggctaattttttgtatttttagtagaggcggggtttcaccgtgttagccaggatggtctcgatctcctgacctcatgatccgcctgcctcggcctcccaaagtgctggaattacaggcgtgagccactgcgcccggccttactgttttcatatctgccatttctagatctgtttctatagtttgattttttttttttttcttcttctgggtaatgagtcatgttttcctgcttttttttttttttttgacaaaatgcctgtcatttttaagtttgattcagaatattgtgaatttcacattattggttgctggattttgttgtattattttaaatgttttgttggactttgttctggcatcctgtcaaattaacctcgaattatttggatccttttgaggcttgcttttaagtttttgaaaagactttggtagagcaaactttagcctggggctatttattcatactaccgcggtgatacctggagagatctgaatcatcccccgtattacaaggtcatcctactcttgaacaggtagcaatacagagtactcctggccatgtgtgttctttgggaattgttagcctaatgctttcttgtggttctggggttctttctctggccacaggtgctttcttctcatgaatgcacagatcagttttcagccaaaatatgtctgtagatgtagttttaagatcacagatcagttttcagccaaaatacgtcggtagatgtatttttaagatcagagcttttttgtgcagctccatcatcatcagtactctgtttcccaaattctagctgccttgaaagacttgtgtttcctcaactcagtgaaactagtaagtaggctctgttaacctccccttcccccagctacttctaggcctcaagctttggcagccacaggactcacttgatttgtttcccttttgttaggtatacagttctgtgctaccttgtgtgtagagtttgaaaaccattgtttttttgtgtgtgtgtctaattttctagttgttaaaggtgggtgggaggtttaaatctaatttctgttagttgggagtggaagttacctctgctttaatctaaatagttccctagtttttgtttgtcttttatgacttgacattttgaataccactttggagagcatccctcaattcgtgtttgtttgatagttcctcaagattagattgaggtaatgcatttttggcatgaatacctcataagcggtgttgtgtccctcttcgtgcacatcaggaagcacatgatgtctatgttttccattattgtgtgttaacttgtttaaggggatgtctgtcaggtttctccagggtaaagttgctatttttccctctgtatctgtttaagttaagcaaacttttcacccactatttttagcatctgttgtcaattagaaaaaaatccttaaattacaaagttagaataagtctgctaaaagaaaaattgtaaattaaacagtaatagagaaaagtaaaacatgatggtatatacatttttaaaccgttttttctctgcacagacaaatcttgcaatatgaagagatgatttccaggttttattgaataaatgaattgtaatttttacttgaaattatcttatttagtataataaatattacaatattatgtcattgtttgagttttattgccacttcttctaatcaaggttcttcactatttcagtgctttggattcctttggtaataaggacagattcattctcagaatgttattaaatgcataaaatacctatgattacaaagacaaccaattatatcaaaatacagttaccaaaatattttttaaatttttgaaatgtgctgctttattttaatgtatttaggaataaaatccagtggttaataactataattttgaagtaaagttgaatgtaattgatatattaagggatactaagaatgatataaaaattgggaatttttatttttgacagtcataggccctattaaactaatgaagtaagtttgttgcctccaatcagagtgaaagagaatgttaaatttcagttagaggttagtaaatataaaggtaatttctttactgtgcgatgtcacagactaaagtttatattgtatttgaatgtggctaggaaagtagataatatgcagcctatatcttggggcgccatttcctaaattagatttgcagcagcaggtacatcaagccattctttcttgattaccttcccatgtggtctacttgattggtccaaatgtaccaaatgaaatatacttcctatatgtagaaggaaaatttgggagaagttgtaaaatcgtgacagttttgacattcacgtgaaattggttaaaattaaaatataaggtacatcttttaaatgagtagactgaaaatgagccagtttgtcataaacttacccatcatatctacgttttaccttatccatatcttgtttcacttggttctatctcattctttttcactgaaattatacgtaggcttatttttccccatgcccaaaaagggaatattttaattctgaatttattccacaaaactttacatcactaaatgtgtgtttataggacgcatataaatttgtatgaaatttaaatatgattattttgattgcttacatataaagctgagtaaacatggcataaaattatatttcccttttggctaatgttctttcattaattggttctttgaggcagcggtagctgtgcaagtggcagtattgaaatattctcagtgattctgtcattctgatagtactttctcattttctttttcttcttctttttttttttttggaggcagtctcactctgttgcccaggctggagtgtagtggcacgatcttggttcactgcagcctctgcctcccaggttcaagtgattcttgtgcctcagcctcttgaatagctgggactacaggcatgcaccaccacgcctggctaacttttgtatttttagtagagacggggttttgccatgttggccaggctggtctcgaactcccaacctcatgatctgcccacctcagcctcccaaagtgctgggattacaggtgtgagccactgcacccggccttcattctctttagataaaattatttgtctgtatgaaacagttgcctaactccatgtttacttgatgtcttaaaactgttactaattatttaatcattctgccaataaaatcagcgttgggatcacaaatccaaggaatagactcactcggtcagtttgaagaatgtttcaaatagaaatcaaatccatgatttgattagatggtggaacttaatttatatgagtaaaagaattctttgtaggtgctgatacatggaggccttctacagacacctagtgggagctgatttttctgtcttgcaaacttgcaacatagtggcagttgtcccgaatattttatagcattactaatttgtactgtagtttcaagttttaaacattttatattctgtttcattgatttgctttgtttttgtcccttttccagtatagaaatttaagtcatcaaatagacctcaggaaacaaacaaaaaaaaaagcagagcattctcttctattatatttacacatcatagtgagatatagtatgtttgcagccatttttattttttccttgtcaccattcttttgcagttgacaaatatttttgaaggaggacctatcattaaagaatgagttcatttccactttgaaaagcaaagttgagggcttcctttagttgatatttcagtaaatgaggaagtaggcagcgtaagtggttttaataagatgataatgaacatgcattcctggcacataaacagctatgttttcttatactttttctattcgtttcaagctgaaagacctttttcttgatgttgattgtatttttttatttttaccttccatttattaccttcattttctgaaaccctgtggtatttgtgacatttttccatgcagtgtattcatttcagttgttatttttggcctgattgttatctataacacctattatttatgctatccatggaacatttcgaagccttcttatattttcatattgtatagatgctcgtgggtatgaagacggatttaattgcaacatgaggtggaaaatggatacaattattttgcaacgtgatttgtgatatttgatttaacttgactatgacagagttctgcaaccactcagaggatcaaaacaacttgcacttgaaggctagcctttcgtttttatttctaccttttttttctttttgtggaagatggggtcttgctgtgttgcccaggctgttcttgaactcctgggctcaagcagttctctacaaaaaaaatacacccccaccaaaaaaaatagccaggcaattgcttgaacccaggctggtctcaaactcctgggctcaagcattccacctccctaggcttcccggtgtgctgggtttacaggtgtgagccacaccctgccctcatattctttatctccttttgttgttgttgttgttgttggcacatatagtcattcattgcttaatgacaagaatacgttctgaaaaatgcatcgttagacaagtttgttttgtgaacatcacagagtgtactcaaacaaacctaaatggtatagcttattgctgctaggctataagcctgtacagcatgttactgtaatgaatactgcaggcagttgtaacacaatggtaagtatttgtgtatctacatatatctaaacatagaaaaggtacagtagaaatatggcattacaatcactgagtgaaacatcgttatttggcacattactgtattcacttttggcaggaggattaactttattattatctattgatgaattatttacttcattttatagccagaagtcattttgaatgtggtttaaatttttttaattcaaaaaaatttttttattttattgtggtttaatgagatttcaaatgtagtagataggtgataaatcatttttaagagaagttccaagagtgcttggaacaatagcagctcagtgggaaaaggatttaaaatcttcaaattcattcttcaccatactttttattattaaggcttatatttcatagctccatttaattgattttgtcaaatgacaaagaagtatgtcctcattataaacaaaaagcactgtgcctttcctaaatttttcaggttttacttaactctatgtagggattctgttaaactaaatataatagagagaaaaacattctgtttttgaaggcgacttagctgatgatcattgctttgtttggaccttagcagttgttgcatagttaatagtttgtatgtagatgaagactcatgactctaaacctgtttagagattaacaggattgttttgcagaggcaaaaagtgtaatgaaaaattggtaattcttttctagttaagttgtagtcttaaaaattatctttttatgtttcaaattttagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtaagtttcacatatttggacagttaaaaaaactttacaacgtaattaatttttgcataaatactcatttgatgtttttatgcttgtttttaacagcttttcattttatattaatctttttgaaaactgttctaattattttgattattctgtactacttttttagttctcttcatgtctatgttcttaactaaaattgttactccatctaaaaaattacccaaaactgagttttttctctatatctatgtatgttttagtggcataatatcagagtccgttatgacaatattttaaaagtgcacataatcttcagtattgaaggtgcaaataataatagtttattttttaacagaaacttctatgatctcagtagttaagataaaaaaacttttttattactttataaacaaatcagatatgtaccttttctttcctaggtttgggaattatttgccatttttgtaagcgaaactctttacctcaataccaagccacaatgcctgatggaaaactgtacaacttttgcaattccagttgtgtggctaaatttcaggtttgtcgtttattttgcataacccatgcccccaataaaatacacatagaaaataatcagtgtaatataatatgctttattttatcttaatttttacgtagcttgttgagggtcaaattggaaggtggatatcctagtcacagaatatgtggctgtaccagttttctattttagcctggatagtctaattgagattataattattactctgatacagattttgaaggaaaagaaattttaatatagttcagtgctgatgtgtagttttttcttattagatagtttgaataaaatgtgaaccgtaaggggaactgttatgtgacaaacggatagaggacctagatgtatttagcctagaagtgataagaatacttgctttcttcatatgttagaaatggaccatgtaaagagggaattagattttttacactaggccttaatttaatacaagatcagtttagggagacatttttcattttggtaaatgtaaagaaagacttgctaacatagtttttcaaatttggagtatggatagtctcagaagatagattcttggaagcgttcaaacttaacctggttgaccactaggaaggaatagtttagagggaattcaagcattagttaggtgatacgattaggtttacctgttgtgtgtgaaaatttcagggtattacccaaaggttcaaacccgtgcataaagccatgcttcatgagttaattcatccaacaattctgctttattccaggtactgtgctctatgttaatttatttaaactgcaaatatagtttcttaagtataatagttactatatcacttattagtatttaaattgaggtgtttttgaattcaaatgaatgtcagtttttgttaatagtaatattctcactgagcttaggtgataaaccacgtttaagacttaacttgttatttcagaagttgggatcatggccattgatacatccttacagtggtagatattgcttttgccttgttggcttttcttaaactagaaattaaggaataattattaattagaagagaggaagacagtgtctatagcatgctacttgtcagatcttgaactttgttttttgatattgttggataaactaaactgataattgaaaatgttgtaactacccttttcatttaattgaaacttgtatcacccatgatttgataagatcctctgtatatgtacattgtatattttaagatatacagttaccccttgatatccatgggcaagtggtaccaggacctcctgcagatataaaatttcaggatgcccaaatcccttatataatatggcatagtatttgcatgtaacctacagtgcaagtcttcctgtgtactttaaatcacatctagattacccttaatatctaatgccatgtaaatgctatgtaaagagttgttatactgtattgtttaggcaataatgacaagaagaaaatgactgtacatgtccatacacatgcaatcatctttttttttttttttaatttttgatcctctgttggttgaatccatggatatgtaggaccgactgtacttaatttaggctcttactttgaggaatacatccagataggcctacaggcagcttcatctctctgcatataaataatacaaaattgacagaaaagcaacatttttccctttatcataaagcaaaccatatattttgaactttatatcttcattagatattttccttttaaaagtaagataacaggatagtattcccacttagtccattcagactgctattacagaataccttagactggtagcttataaatagaagtttgtttctcatagtccggaggttagtaagtccaagataaggcactggcaatttgttgtccgttgaaggtctattcctcatagatggtaccttcttgctgtgtcctcacatggtgaaggtagcgaatgagctccctcaggcttctgttatgagagtactgactgattagatcacgagggtggagctctaatggtctgatcaccttttcaaagcccctacctcttctaatactgtcaccttggggtttaggatttcagcctatgaatttgtgggggaacaccaacattcagactgtagcatattccatttgttttgaaagactagttaactttaatggggctcaaattttttggaaacgctaagagtaatgttggcttttattttttaaatttattcatctcatagtcttaaatctgtatattttatttttcacaaacttagtgttgtacagtgtatgcagaagttttaaaaatggtagttttttctccttccgctgtacattgaatgactaatttttattaaccgtttcatgcattaagattatatgtaatatatgagtaatatggtttaaaaaatgataattaaataccagtgtcctcaccattcagattaggaattagaaaaaatctgtcagtgtccatgtatgcttatattgtgtcttattctgtaaatttttttttttttggagacagaatctcactctgttgcccaggctggggtgcagtggcatgatctcggctcgctgcaatctctgcctcctgggttcaagtgattctgcctcagcttcccaagtagctgggattacaggcacctgccaccatgcctagctaatttttgtatttttagtagagacggactttcgccacattggccaggctggtctcgaactcctgacttccagcgatccgcctgcctctgcctcccaaagtactgggattacaggtgtgagctatgacgtccagtctgtaaattgttttaactttaaaaaaaaaggaatagtaaaattcctcttatgaataccagtgtgtaaatcttttttctcctaactttgaagaagaagtgatcaatttttaaatgtaacataggccgatttcttttcctctttttttttttttttccagatggagtctcgctctgtcacccaggctagagtgcagtggtgtgatctcggctcactgcaacctccgcctcctgggttcaagtgatttcccctgcctcagcctcccaagtagctgggattacaggcgtgcgccaccatgctcagctaatttttttttttttttttttgagacggagtctcgctctgtcgcccaggctggagtgcagtggcgtgatctcggctcactgcaagctccacctcctgggttcacgccattctcctgcctcaacctcctgagtagctggtactacaggcacctgccaccacccccagctaattttttgtatttttagtagagacggggttttaccatgttagccaggatggtctcgatctcctgacttcgtgatccgcccgccttggcctcccaaagtgccgggattacaggcatgagccaccacgcctggcctaatttttgtagttttagtagagacggggttttgccatgttgaccaggctggtctcgaactcctgaccttgggtgatctgcccgccttgacctcccaaagtgctagaattacagatgtgagccactgcgcctggccaacataggcctatttcactggtagacttggaatgaaaattatagtagggatgcagtggcacaaaacattagtaaattagatatttgatgattattggagatagcaataagaactaggtttttgttctttttgtttttttaaacttctgttagttcagaacgtgggcaacttaacctcactattatttgcttactgttacttccttacattttcttaagtgaacagatgatgattgaatgtatgattttttcttattttaggtaaataataattctgtggttaaaaattaaatttaatttcaattttataaaactaacatatactataatttttaaggacaaaatttggaaatgagttttatgtgctgaaaagatatctaagcaagatgtatattactttctggacatcgtagatatatgacagtaatcacaaatagaaattcaaacatacatgtcaggcttagtatcttttgttctttgttttaggctctaagtatgcagtcatctccaaatggccagtttgtagcgccaagtgatattcagttgaaatgcaactactgcaaaaattccttttgttcaaaaccagaaatcctggaatgggaggcaagttgtattttgtaatgtgtgttatctaatgctaaaaagaaagtctagtaaaataagtgttgtatttccatctggaaacctatttcttggtagataaaaatatgcttttcagatttttttttatgattggattatttattctcatgtgggagtggaaaaccaacaaaggatctatgtctttttaggtccaagaaaaattactgaagtcatattcctgatatattgtataagttcataatagtgtacagaatgtcactttgtttagctacgtacctagagcaattgtctttcctttttttgtcccatgtttctccctgtcctgtattatctgagaacgatattttctatcactcagtacctgtacatattagaatgtatcagtcatataccacattgtcatttataaaatgatacaattctgtaattgttttttttttttttttttctttttttctcagagtcttgctgtgttgcccaggctggagtgcagtggcacgatctcggctcactgcaatctctgtctcctcagttgaggtgattctcctgcctcagcgtcccaagtagctgggaatacgggtgggcaccaccatgcccagctaatttttgtatttttagtagagacggggtttcaccatgttggccaggctggtctcgatctccagacctcaactgatccgcccacctcagcctcccaaagtgctgggattacaggcatgagccaccatgcccggccataattgtgttttaataaaacaatagtggcctatgaatcccactacaagtttattttcttttcccttttttcattagtttactgatttgctttgacatgtctccattagcaataacgctgatgattgacttttatttcataagggggcagtaatagatggatacatggccaagactgcccaggctgcccattgctttcttgagcaatgcttgcctttggccattgtttcttttcactgctttaggggtggggcagggtgggaggtagtgcatggagtatatgataaaatggtatacaagatttagaagatgtagtattaacactgttcttgagccaaaatttattaggagctgttggtgagtcattcagtaactaagtcttaagtgaaaggtggtacccagaactggattacatgattttttttctgtctttttttttttttttttttttttttttgagatggagtctcgctctgttgcccaggctggagtacaatggcgtgatcttggctcacttcaacctccacctcccaggttcaagcgattctcctgcctcagtttcccaagtagctgggattacagatgcctgccaccacgcctggctaatttttgtatttttagtagagatggggtttcaccatgttggccaggctggtcttgatctcctggcctcaggcaatccgcccgcctcagcctcccaaagtgctgggatcacaggcgtgagccaccgcacccagcctggattacatgatttctaaagtactttggaaacctgaaatttcattttaacagtttaatgactggaacattttttagtttattatttgctttggtgctgtctccagatcatttaaaccaatccctatttgagactgttgttggcatccagtgatgatttttagtgactgataacctttaagtaacagcagtaagaatgaaggcccagtaagaggtaataaaggagtgatgagggaatgaagaaagaaatccattagcaagcatacagaataatagtgtcatatagaaaatgaagatcctgcatacactgaattttgatactagatcaaaatgaggtccttttcactgcatttatgtcaatgctactccacttctgtagttgttttggtgtattgcttttatttacatggaggttaagtgttagaagcagttaagagacactgccacactgaatgagagttgagcgtgtccccctgggagattgagaattcagtggtctctttctcctcactccatgtggcttctttgttgccttcctccttctataaattacatagtcataatggggcaactttccactaatgattgccttactacttgagttgattcccagactccctcaccttccttattctggtcttcacatgtctttgctaactgtaaagtaaatggtttagacttagtctgtagcctgctcaataatgagagaaaagctgcctccctggaagttttaacttgttcatacctgcttgggttaatatttgaaaagtagctctggctattgtgggtttgggcccaggagaaacaaattattactaatcatgttccattcaagggaaacaactcagtctcaggttcagcagcacgctgtgtgatggcaccaaattgaatacttcatccatgatacatctgttactattaaggtgtgtggtaggaatgtgatggagcctacttgtttatactcaacaaagaatttttctttttgactgaaaatattattagtgccataatttttatctttctttagtttacctatgctgtattttccatcattttcttcccatttctccaattatgttagcaacaccagtctatcatcttatttagtgatacttttacttccattaagtaattttagggtagctaatggcactgaattttgtggagctatgtttaaatttggcagtgaattggttaaactaggcatccatggcctgtaggaaatctatccccaagggtcttaacattaaataggtaaatgatttaactttgcttctgtaaaagtggcgtgtttatttcttaagctttttcttgaggtggtcgtcatatacttaccaaggttcccattgtgcatttagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggcaagttgcatatacagtgttgttcataacatttattgatatttaatgttttttgccaaaataatatatccagagtggctgcacaattttaatgtagctgaacaaaaaaaattgagtttacgtttctactgacttgtttcgttattttatatgtgtttgtagatctgggcttcaagatggttttatctctaaacatttggtaacctcttatttcattaaagttttagaataaaataaaagcattttcatgccatgttatttctaaacctacatgttgtggtctgaaagttggttttccaagtggtttaaaattgttttccattagctccattttccctgcccagcttactacctaacctgcaaaggttttcaatatgtataccagaaagaaaatcacatatggcagtactaaaatgggaagatacttttaggtattcaatttggggtgccagggagacactgggttctgttttagtatgttcaagaattccctttcctcttatctacacttttgctgctctggtgccaggcagcagattatacagatgaattcaaattctaaatctacttatccagagataggaactaggattgtagctatgggttttggggttgtgttattcctgttcccaatgtgacattcttgctctaagctggctttcactttctatctttctttggtccatggcactgaactcccagctttcctgtctgctatcttcacctataattttttaatgaggaatatttttttctggatctgctttttctatggattcctgactgctagtttggagtaagagaaaggtgggaaaatcctaaatgtcagcagtagagaatgacagcaaaataaaaagatttatcagttcgttcaactagtgcgttcatttacagtcttaacatgtaatgtaaagtcatgtccgtaagagggtgctgcttgcttataaaacaaggcattcctatttaaatttaattttgtacatttcacctggaatggaaagtaaccatgtttcgctgttatttaagagtaaagctataatgaaaaatgacaaatcttacaatgtttcattgaaaagattgattctgaattagtctttttacatttgagttgtgcaatgacattcttactgattcataaatctgaacatgctgatgttgattgctcatatatgtcattaattgtctaccatttggattatatggactttactaaaatgaatagacaattagcagcaaataggtaattgacattcaagaagataattttcagttggagggatttatacattcagatcggtaatagcatgttgaaaaagaatgtgtgggtttttttcctgttaaatgacatattttttgctttctcttactgcacctagttctctgctagaacctgtcagaaataacaaaacacataatacctagtacgaccatcaaactctagttagataaagctaataaaggtaaattttaaagaatattttaaaatatagttcaaggtaacagaagtcataggatagtacataaatgattgctaaataaattttatagaaaacaattgcagttcctgtttgcagacaggaaatgtcattttaaactaggttgatcgtgggcagcatttgtggtagggggataatttgaggtccttatgaaaggatgaataggattttagtagataacatgtaagtcattctacttacatagcacagtataagtatagagtattatgtgatcctcgtagaggtgttatagggaataaataaggatatgtaaaaatacttaatgcgtttatgtagtagaaaaaagacatacttcgttaaaggactagataacaaaagtattttctctgggcaagtcaataaatctgttttttttttctgaaggtccatgtaagagaggtaagcttgaaaaattagctaaaatgcccacttaagttgaatatctctataaatttactcagagcctctcagtagtctacattgttcctttttctaaaatgcctatttgtggtatgcttagtttgatacttaagattctatctgtctatttcccaggcccaagcaagattctgtttaaatagaacaaataaaataattctgagacattactagattttaatatcttgaaacattattttaacccacatgttagataatatgttatctaataaaatatcccatattctgttctaatttttataggttgatattgattacagtagattttatagttttgatcaggagaggaaaaatcttgaccaattaagatctgtctctgctcaataattagttttcatgtgtttttttgttttaatatataaatcttatatttttcaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggcgagtaactcctttattacagcagctactttaaccagtcttaaaaaacgttgtagctgttaccattacaaatctggcaactcatttattttaaaaatgtacacacttaaggcccagccctgataatactattcattaaaattgtcttgtcatttctgcttgtttgaagtagcatttttatctctttttttaataacttaagcattaccaaaagattaggatatacctatattttcagcattgtagtttaacaaaatggattgtttttctaaaatttgttgtgtctttatttcactaagtagaattttttttttttttttttttttttgaggtgaaatctctgtcgcccaggctagagtgcagtggcaccatctcggctcactgcagcctccacctcccaggttcaggcaattcttgtgcctcagcctcccaagtagctgggattacaggcgcgtgccaccacgcccagctaatttttattcttttagtagagacagggtttcaccgtgttggccaggttggtctcgaactcctgacctcaggtgatctgcccgcctcagccccaaagtgctgagattacaggcgtgagccaccaatgcccagctaaatagaaatactttcaactatgttatcagtgttgaatgttagcaggtaattgttttggatacttgagatatattttaaaaacatcttgctcttttttggctttttgcctttttaattgtgagttttgggggactttaaaattgaaaagaacactaagtagagaccagaaacatttaatttgaaaccataaatgtgtgtatgtgtatgtgtcatactaaacccactttaaaaatttaacttttaggttcaggggtacatgtgcaggttttttatataggtaaatttaggtcatggtaaatgatgggtaaatgaccaaacatgacccaaatttaccaaagtaaaaatttgggtcatgttgtactgattattttatcacccagatattaagcctagtacccattagttatttttcctgattctttccctcctcccaccctccactctttcataggccccagtgtctgttgttcccctgtatgtgtttgtgttctcatcatttagctcccacatataagtgaaaacatgcagtatttgcttttcttttcctgtgttagtttgctaaggataatggcctccagtcctatccatgttcctgcagggtatataatctcttttttattgctgcatagtattccatggtatatatgaaccacattttctttatccactctactattggtaggcatttaggatgactctaggtgtttgctgttgtgaatagtgctgcaatgaacatatgtgtgcatgctttttctgtgcagaagctctttaattaaaccccatttgtcagtttttgcttttgttgcagttgcttttggcatcttaatctttgctggttcctatgtccagaatggtattgcctaggttggcttcaggggtttttatagttttgggttttacatttattaatccatcctgagttaatttttgtatatggtgtaaggaaggggtccagtttcagtcttctccatatggttagccagttatcccagcaccgttgattgaatagggaatccttttctcattgcttgtttttgtcaggtttgttgaagatcagatagttgtaggtgtgcggcctcatttctgggctctctattctgttccattggtctatgtgtctgcttttgtaccggtaccatgctgttgtggttactgtatccctgtagtatagtttgaagtcaggtggcatgattcctccagctttgttctttttgcattttgcttaggatggccttggctatttgggctcttttttggttccataggattttaaaagttttttttttttttgttctgtgaagaatgtcattggtagtttaatgggaatagcattgaatctgtaaatggctttgggcagtatggctatgttaatgatattgattctttttatccatgagcatggaatgtttttccatttgtttgtgtcatctctgatttctttgagcagtattttgtagttcttgtagagatttttcacctccctgattggctgtattcccaggcattttattctttttgtggcaattttcaatgagattgtgtatctaatttggccctcagcttgattgttgttggcatacagaaaagctagtgatttttgtacattgattttgtaccctttgctgaagtggtttatcagctgagggaacttttgggctgagcctatggagttttctagatataggatcatgtcatttgtgaacagggaaagtttgacatcctctcttcctatttggatgccctttatttctttctctttcgtgattgctctggccaggacttccaatactgtgttgaacaggagtggtgagagagggcatccttgtcttacaccagttttcaaggggaatgcatgcttccagcttttgcctgtgcagtatgatgttcgctgtgtgtttgtcatagatgactctttattattttgaggtatatttcttcaatacctagtttattgagagtttttttttttttttttgacatggtgtctctctctgttgcccaggctggagtgcagtggcgccatcttggctcactgcaagctccgcctcccaggttcacgtcattctcctgcctcaccctcccgagtagctgggactgcaggcgcccgccaccatgcccagctaatttttttgtgtgtttttagtagagatgggatttcaccatgttagccaggatggtctcgattccctgatcttgtgatctgcccatctcagcctcctaaagtgctgggattacaggcgtgagccaccgtccccagcctattgagtttttaacatgaaggatgttgaattttattgaaagccttttctgcatctattgagataatcatgtggtttttgtctttagttctgtttatgtgatgaatcacatttattgatttgcgtatattgaaccaaacttgccatcccagtgatagagcctacttgatcatggtgaataagccttttcgatgtgctgctggatttggtttggcagtattttgttgaggattttggcgttgatgttcattaaggatattgacttgaagttttcttttctggttgtgtctctgccaggttttggtatcaggatgatgctggcctcatagaatgagttagggagaagtcccccctcctcaattttttggaatagtttcagtaggaatgataccagctcttctttgtacatctggtagaattgtgttgtgaatccatctggtcctggactttttttggttggtagggtatttattactgattcaatttcggagctcattgttggtttgttcagggcttcagttttttcctggctcagtcttgggagggtgtatgtgtccaggaatttgtccatttcttctagattttctagttcatgtgcacagaggtgttcattacaatctctggtggttatttgtatttctgtgagggtagtggtaataatatcccctttattgtttctaattgtgtttatttgggtcttctctcttttctttattagtctagctagcagtctgtctattaatcccgcccacccctgcacgcaaaaaaataaaaaaacactcctggatttattgatctattgaatggtttttcatgtctcagtctccttcagttcagctctaattttggttatttcttgtcttctgctagctttgggattggttttctcttggttctctagttcttttagttgtgatgttaggttgttaaattgagatctttctaactttttgatgtgggcatttagtgctataaatttccctctcaacactgccttagctgtgtaccagaaattctggtacgttgtatctttgttcttattggtttcaaagaattaactggtttctgccttaatctcattatttacccaaaagttgttcagaacaggttattcaattcccatgtaattgtaaggttttgaatggatttcttagtcttgacttctaatttgattgtactgtgatccaagagacttttggttatgatttcagtccttttgcatttactgaggaatgttttatatgtgattatgtgatcaattttaagagtatgtgccatgtgacagtgagaagaatgtatattctgttgttttggggtgtccatttgattctatgctgagttcaggtcctgaatatctttattaattatctgctttgatgatctgtctgatactgttattggagcattgtctaggagtctaagtctctttgtacatctctaagaacttcctttatgaatctgggtgctcctgtgttgggtgcatttatatttaggatagttaggtctgatggttcaattgaaccctttaccattatgtaatgaccttctttgtcttttttgatctttgttggtttaaagtctgttttgtctgaggcaacccctgcttttctctggtttccatttgcttggtagatttttctccatccctttattttgagcctatgtgtgtcattgcatgtgagatgagtctcttgaagatagcataccaatgggtcttgtttccttatccaagccactgtgtaccttttaattggggcatttagcctgtttacatttaaggttagtattgatatgtgtgggtttgatcctgtcatcatgatgttagctggttattttgcagacttgtttatgtggttgctttatagtgtcacttgtctgtgtacttaagtgtgtttttgtagtggttgttaatggtctttccatatttagtgcttccttcaagagctcttataaagcaggtctggtggtaacaaataccttcagattttgcttgtctgaaaaggatcttatttctgctttacttaatgatgcttagtttggtgggatatggaattctggttggcaggtggcactggtgttaaattaaaaaaaaagggttgaatattggcccccaatctcttctggcttgtagggtttctgctgagagatctgctattagtccgatgagtttccgtttgtaggtgacctgacctttctctctagctgccttttaacattttttctttcatttcaaccttggagtatctgatgattatgtgccttgagaatgatctttttatgaagtatcatactggggttctctacatttcctgaatttgaatgttggcctctctagctaggttgggaagttctcatggatgatatccagaaatatgttttccaagttgcttatactctccccatctctttcagggacaccagttgagttatagatttggtctctttacgtaatgccatatttcctggaggttttgctcgttcctttttattctttttctctgtattcttgtctgtcttatttcacaaggccagtctaccagctctgagagtctttcttccgcttggtctattttgctattaatacttatgattgccttatgaaattctcgtagtgtgtttttcagctctatcaggtcagttacattcttttctatactgggtattttgtctgtaagctcctgcttaccttgttccttggattgagtttcagtgtgctcctgcttctcagtgatcttcatgcctttccatattctgaattctatttctgttatttcagccatctctgcctgattcagaacccttactggagaggtagtacagttatttggaagaaagaaggcactctggctttttgagttgtcagggttcttgtgcgagttctttttcatctttgtgggcttacattccttcaacctttgaagttgctgacctttgctttttattattattatttttttttatttttttgagatagggtcttgctatgttgcccagactggagtgccgtggcatgatcttggcttactgcagcgtccacctgccaggttcaagtgattgtcctgcctcagcttcctgagtagttgggattacaggcacatgccacaacacccagctcatttttgtatttctagtagagatggggtttcaccatgttggccaaactggtctcgaactcctgaccttaagtgatccacctgcctctgcctcccaaagtgctggaattacagacatggaccactgtgcccagccaatttttttttcttgtatcctatatttgatgaccttgagggtttaactgtggaataaggtggattcagccaagtgactgtgttctggaaggttttaagggaccggtgctaagttcctaactcctggactgtgtgctttaactccggggtacttatatcagtctcaacttgattctgtctcctggagcgcaggtatccactgtgctggggagactgacgtgtttggggccgctgatcactacacttgatggatggtgtcagtcacagcatttggtagtgcggtgacagcaggatccatcctcattggcatgtgccagcagcagtgcagcgtgatggggtgcacacttgttggctgtggtagggtgctagttggtgctggggtgcctgcctcccagcctgcacttgccacagtggtggatgcaatgtggctagggggtggagtggggaacccctgttggctactgtgcctgtggttgcactggtggtggtggtggtggcagggcgctggcaggtgcaggtctttgtgcattctcagagggctcttggtcgctcagggaggtggagtgtccactgttctgtgtgcctagttttgctctgggcagtgttgctgaaagggccaggttgtggtgggggcggggctgactgctaaggctccaactgcagtgtcgttggtggggcaaggtgggggtgaagtgcactcctgctgcatgagtggcagggcagggtgcacacacacacgtgggtgctggctgggtgaggcaagcaaaacctgcctgcacatggcaaagggatgtgggaagtatccatgggccccaggggaagctgcagtgtggggagggaatgggtggcactgctgcgtgtctgtgggggccaccccactgggggtctccagtggtcaagttccgtctgccagggtagaagctatgatgggggcttctaggacactcgaggctgacctgaaagcaggtactttcacactgggaccctgcaagaggccaacagattaagggatgctcaggtcagactggcctcttcttatgggcaagacctccccgcagagttcagatctgacagttgccctagggttaaagtctcctatgggagcaagttgattctaggtggatggtcatccttggctgtgctccactacagaggcccctgcaccaaaccctgtgggctccagatcagctggcttgctgcccctacaacttctttaagcagctttccctgccaactcaagtgtccctgctggctgaagggtttcctcctgctgagattccagaggcctgtgcccagagcaggttgctctctgccagttcacctaacttgtgccctcagcatattgggggtcaagaacaagtcccagtgtgtggtagccccatgcagcgttcccagattccttctccttaagccaagcttctctctgtcttccctcctctactcttggtgctttccctctgaagatctcttaggagtgcaccagtactctcagtccctccggggcagctcttctacctggctgcgtctagtcagccatcttgccccaacatctacttttataaagtcagtctcttttcacacattgcatcagtttcttcctagataagaaaatgagtgtaaatttggacttgtgggtagtcagaaagattacaagaaaagagcattaattcctatgttgataacatggaaaaccatctcaatgctgaaacttcattgtgggtacagttgtaaagcatgtgaagacaggccaggcgcggcggctcactcctgtaatcccagcactttgggaggccaaggcgggcagatcacttgaggtcaggagttcaagaccagcctggccaacatggtaaaaccccgtctctactaaaaatacaaaaattagccatgcatggtggtgcatgcctgtaatctcagctactcgggaggctgaggcaggaaaatcacttgaacccgggaggcggaggttgcagtgaggtaagatggcaccactacactccagcccgggcgacagagcaagactctgtgtcaaaaaaaaaaaaaaaaaaaaaaagcatgtgaagacagacattatcatgacttcaaatttgttaaggcctctaaagaaacaaatgaaatagtcgaatatggagaacagtatttagtttactttatcaaggtattggtattaaaatgatactactaggagaattgcaggagttctggggcagttctttaatatctgcaattcaccatgttaactagcatattgtaaataaaaaaaggaagatgctttccaagttaagagctgtaaagtaattcccaagttgttaagagctgtgaagtaattgagactaagaggtttgatgtactaaaaaaagttacttcattactttactgttgcttctatatgatgtaaactttaaaaattaaggctcaaattttagaaatacacagaggacaaacatacactctaaaacatgtttatttcagtctaaacaaatgttttgtttatggatattagtgtttttgagaaatcactcagaaaatgttacttcatggccttgcaatgcttgatgttagtttagcacatacaagtgcacttttatacccattgtttaggaggttttatttttaaaattttcttttggataatctcaaaacaataaaggcatttagtgagtacaaatttggaaatcccattttatttttatatctattttcattgtttatcttattgtttgagacagaaattgttaccatgtgatgatgatttccctgttgttttactgtacaaatatctgcctaattgtaaaattatgaatataaaattttaatattgtataataatctttcttggaggatttttttgttgttgttcacagcacatactgaatgtatttctctgtttggcttctttctttgaatgaatgatctcccagctttaaaaaatattactggggctgggtgcagtggcttatgcttgtaatcccagcactttgggagtatgaggtgggagaatcacttgaggcaagaagttcaagaccagcctggggaacatagtgagagcccatctctgcaaaaaaaaaaaaaaaagttaaaaattagccaggtgtgatttcatacccctatagtcccagatactcagcaggctgaggcaagagaattgcttgagcccaggagttcgaggtgagctatgattacaccactgcacttaagcctgggtgacagagcaagaccctgtctcaaaaaggaaaacaaaaaattactgagagcggtggctcacatctttaatctctgccctttgggaggctgaggtgagagggttgtttgaagttgggagttctagtccagcctgggcaatacagcaagaccccatctctacaaaaaataaaaataaaaaaaattagccaggcatggtggtgcatgcctgtagtcctggctccttgggaggctgaagtggaaggatcacttgagttcaggtttttgaggtgacagtgagctctgatcacaccactgcactctggcctgggggacacagtaagactttgtctctaaaaaaaaaaatatatatatatatatatgtgtgtgtgtgtgtgtgtgtgtgtgtatatatatgtgtatatatatgtgtatatatatgtgtacatatgtatatgtgtgtatatatatgtgtgtatatatgtatatatgtgtgtgtgtgtatatatatattaaagaatagggaagtttgggatttgtttccctttttttgggaagcaaaggtacgttctttgacaaaagaccatgttattgtagatgtcgtgtgttccaccttgctatgttttttaaaagatagttatttctgttttcatttatgcagaattcagtgatgaggatttaatgaagcagtgcatttcagaatatacaagaaatactttagtcaaataccgggttacaatcatctagttatgtttaatgtcagtattctgtaccttaaatacattatatattcatgccttattttaaacagatctttgtataatatacataataggttatatattatactaatctgaggaataaaggtaagaatatttttgttagatggtagaaatttataaagcaagtagcaatgctgatgtttctgtacgatcaatatgcagcacaatctttgaagtgtgaagagttgtctctcttcattcatccttggttttgctgcctgcagccattattgtaatcaaatggtaactttattctctgtgctttctacttgagtcagactgtattttcttatacccccccatgcattccttctattcactgttgccatggtatcatcttgaaaatgtggtaaactaattatggggtcccccccttttatggtttatctttttttatttaaatactcacaagtttatatattagtacattaaaacctatgacccttacaaatcattccggcttatcagaaaaataagcttcaagccaaaggaaaaaaagtgcttcatcacagaaacttaaaaatcaacagctagccaatctggctattatttcatgtttagccatgaacatttcttaaatggtagtacacacacattgtatttttaccttctcttacctttgcactttagattgagagacaactacctatagtataaataacttctacttttttgtttatttaaatttagttttatgctttaaaaattgttttacttgacaagacactgaatgagctgtgttttctggtctatatcatggtttgcttctagatttaaaatagagatttattaaattctttctcttctaaattggaataagaaatctgtgacatcatgcaaccaaaaaatgctgaaaataaaattaacgtatttttcttctcccagatacctttttagaaagaagtagattttacttttcctcaagtaaatgtttccaggcgtaatgaaaaacctgatagttcttttgatctttgtaagtttaaaagtttttaagaaaaagaatttagtatcgtaatacaataatagctagaaggtgtttgataaattggtaaagataatatttcaaaaggtccactgtttcccaagagtatctctattaagacctgagcttttcttaaactgtattacttttcgattgcacagttttttaacacaggctttgatttgttttccaaagaagtaatgaatggtggcaatattaaattcttaatacaaatgccctctaatagtcttaacagtatgatttatgggctttaaattaataatattagacttgtataatttttctttataaacagctatatccattttttaaaaatttttttgaaattatttttaggaaaataatatttaatattcaaatattgccttaaatatatatttttggtcaccggagaattcctatgctttgcatagtacccaatcaccttttatccctgcattcttttttaaaaaaaatttgtagcgaatcactccattgtgctcagaaagctgtattgagaagtcataaaggatttctgcttaaaatgtctgtaaaatacccctatctttttcgtattcatggttctcccctggaaaattaggtttgtttggtgaaatagggagcaaatggataggaaagtttaaaaagatgtatatatcagtcaaaaatgaaaagttgaaactatccaagacatgaaagggactgggtcaggataggctgaatgaccttttgccagttattgaaaatgaaatttctgtttagctgataggttggattaaggtttttgagtcagagtttagtacctggctgttacttagatttgtttgaacctgtgacttgtttttttttttttccccctccctcttagtttgctatccttgatttcacaatgacaagaaaaccacaaaatagatgatgcagtatttttaaaaccagagacttgtgtcccatttatttcattttttatgatgtcttaatagttcttttttgcaaatggctagggaatgcggcttagagtggagttgtgttggtgttggtaaggaatgatggtcattaatgatctttttaaattggccaccatattttagctgaattccaaacacttcactaggagtttgcatgagtggatgtcaaagaaacaaaagttcacaacctccaaaattttgattatggcattaaagttggaattattagtattgagttctcacttactgtttttttcatgctgaaaaaatacatgcctattttgtttacatttgtaaattggtattaatcttgccccttttttctttgggtagagggaaattatctaaatttgttttgaacctttaaaagaagaagggagcttcaagtgttgattctataaaaaccaagtgtctaattgtagaacgatgaagtgattccattgttcaaattcttgaggtggaatgtgtttaattttatgcccttgatcttccaaattattgtataaacggaaatactactactaagagtcagcatagtacatgtaatgatttgaattaatacagatttctgttttaaatgttaaattgagaatcttcttgtagcattttatttgtattgtgttagggtatttattctctgctcatttatagtaactcattttgtctttattgcttagggtacaggctaaagcctaggttttgaattggttgtctgccttttgaatcctatctctgcatttttaatatttgaccttagtcaagtcatttaatctttctagatcttagtttgcagtacccattttgcagggctgttgtgaaggtttatagagagtagatacaatgggtttggcttttatttcaggttctcagtgaacaaggtagtcaggctgtaactctacttttggttcctgcattgttcggaatcagtgaataaagtattaagcttccatttccttcctttatgctttgtcttttctttgagcataaattataaaaagggaaaaagaaactgaaagaaagaaaagaaaccctggaacaattctatggttatttcgaagaacagtctcgctggtgagaatttaacaaagggacttttttattattgagtgaaaatatgatcttggttgatattaagtgctattgttactgagatgatcacataatactatcagcagtataaaatttggattcacaagtttttggacaagagttgtgatattgcatcacttagtagtcataatttatactataaatcttcatttaacatttattcagcaggagaaatacctgacctggagaaaaaaaaaagcctgtgttctaaccttggggtatgtttgttatgtaagacctgtttgtcaacacagtcatttgttaacattcctgaccaggaattttgacatggcatttgtagaattcctcttgaaatacaacgtgagaaatttcaaaatccacagtgtaaaactctagattagagtaataaaggaaaagccatggccacagttactacgaactacaaaatacttaacagttattactttatcagaatttctaagctgttaagccaaagggtaattgaaaaaaataataatagttcatttctagatcagaaacttaaattatgaaaagaactgtatttgaaattacatcgtttttctgtatttgaagatacatcacttatattttcgttaaactcattggtcaagacgttaagaaatagtgaaaatgggcaaaatctagggaaattaggatctctaaaaaagaaaaatctgtctcaagattattgattcaccaaaataaagtacattctatgaattttaatttgttgttcttgtatcgttttttggtattgcaagttaagttgtggacccattgggctgattgttttcctagatgtgggtcaaattgcttgtcttatagatattattggttttcagaacatttaaacattgagtgttttagaacataaagttgttattaaaattaaataaatgtatttattaaagcttttcaaatttatattaaactgttgaaaaactcaaaattttcaagttaacatccataaatttcccatcataagagcttgcttcaaaattacctttgtcttgtacaactaacctgggaaatccgttcattactcataaatgttcaatgtaatgattgtaggagacaattctaccagtacattatatggccctcaaaattatttaaaaacattaaaatacattcatttggtctaccaatatatatttagttatcctacttttgtaatgctggtctttgacttctggtaagtataggatggactttgtcaactgtgaaattgtatttttttttttttttttcatttattgtagattttactgtttacaaatgatttatattatagttctactttttctgtatcagtcacggttttatcacatttggcaataatcactgataaacttctggaaatcttcaaaaataatttgcaatatctgaaaccttcctttttaaattaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatggtatgtaatgatttaggtgataacttgaaaaccctgtacatcagtctttacgtagttttgaatccaaagcactgataatgaatagttgattttggagatagcttaacagcaacttaaattccgtagattctctgggtcaaagtacccttgtatgttgtttttataaatgtattgcttttagttttattgtctttttgaaatttcatgctaattgagaaaaggcatagttgagagtgaggagaagctaaacagtgctataacacaaattttaaaaagaatagacatctaactatcgtgtcatctgcaattttaaatgaaaattatttttagcaaatcgtattgctagggagtaggttgggaggaagaacaaaaactgtttagaagctgtaatttttttaaaaaaaatatcatttaagatataaatctaagaatatataatagtatttccccgaaagcagtgtatactttcagaggggacgaaaggagaaaaggattaatttcatttatttacctgtatatttctatactttatacaaatttgaaattctttccttaaaatagtctaaaatattttctttagtcacattttaaattggtgaaatttaatgagaaatagggatttagaacattctgaagaaagagtatttgtcttattttaaatttttttgtgttttttagatcagggttgtcagacatctcgaaccaaaatgacagtaagtattggtgaaatggagtgctgaattgtgatttttgtaatatggggtaaaaaataattaggccaatttaatgtgatcataatagtaatttttttggttttttttttgctttactgagacggtggagtattcagctgaattatattaataccagagactgtcatgcatgctaaagaatataaaggagaattaattatagcctctactcacaatggggcgatagacataagtgatatttgagttgacggatgtttccataatagatgcatctttaagacaatggcaatagtatgtttgaaattaagacaatggcaatagtatgtttgaaattaagacaatggcaatagtatgtttgaaatgactgtatttgttctgaaagatacgaataagctgactgtaaacagttgagtagaagattgccagataggcatgaaaagtaggagaataataaagtactaagcacgtgtatttggcagaactacttactagagccaagcctgaaggggatctttggtggaataatggaaaatgaggctgaaggaataggctgaggcagattattaatggctttatgcatttatttttcaagtagagatctgaagatatatgttggtggctagaattttttgagtttaacaatttgggaaatacacagtgtgtcctggattttttttcctccaatttatttttcttttggtgtaatacatcaaattctacacttttgttagcattttaagagttttataggttgaaagtggccattgatgttactaatgactactaaagataagaggcagtgcttttgccactgcctggccttggcatgctgcatcttacagcagtcaccagtggtgggtcctgctatttctggcatccttatccgagggaagctctttgggagtcatttattggcaataaagtctctgggctagttcttgttgtgttacaaaagaacagattagtggttcctagctctgactactcattagaatcacctggcaacttttcaaaaccttccagtgcctgggtttcaacccaaaaattctgtatttttaaaaagttctggctgggcacgatggctcacgcctgtaatccctgcaacaaggcaagtggatcacctgaggtcagaagttcgagaccagcctggccaacatggtgaatctccatctctactaaaaatacaaaaaattagccgggcgtggtggtgggcacctgtaatcccagctactcaggaggctgaggcaggagaatcgcttgaacccgggaggcagaggttgcagtgagccaagatcgcgccactgcactccagcctgggtaataagagtgaaactccatctccattaacaacaacaaaaaaaagttatttaggatgctgatatgtaaccagacatgagaatcactgatatagatgaaaattggtatttttacatttattctattcagtgtttgtttttgatgttaatagttggacagaatcctagaaaagtaagaatactttttccatacccccccttatggaaataacattttaaaatcagataatttggaagtacgtaaagtattcacttgaattatctgattttaataccagacacttttatccatgctgagggtatgaaagatgactactccctattttatatttataaggcaactattagcacgatattaaatatttttctcctcctacagcacttgaaccaaactatatgacagagggatagagggagcattattaatagggaaggataagtaaggctgccattgcagctgttgccttttgtcatataaagtcctctcccatcttttctttgtaagcttttggaatcttctaattctccacccataaacttcaaaggataggagcttagctgtataattttgggcaagttacttcactgttctttttgtgagtttctttatttgtaaaatcaagatgaatatagtacctacctcatgttgaatactaaacgtggtgtaactgttttgttccagacttcatagaggcagtatgtatagtaaagaacataaactttgacatcagatgagtcttacttgaatcctgatttcagaacttttagctcagtgcctgttgccaggttatatcacttctgagcctcagtttcctcctatgtaaaatgggagtgataaaaagtcctaccttttgtggtggtaggagtatgcaataagatttggtgcttttcatagtccctggcatctagcaaatactcaacagatggtggcttttgtcattataatttttattcttttgggtcctacttcagcatacacagataactgtgtatcctgcctattgactaaaaaagtaaaaaacattctaaaaaacaagtttggttcaagtgtagattttcaccaagtggcatagttaattgacataaagtagtatttgcagaatggcaagaagtgcaacattgagcaatcccaggacatctatgactttagatcctctcttctgggattccagttaagagcgaactttcctaatgcctggtatgtaacagatactgtttgctaagttattctttccattatgcaatggtggaaattgaggcataagagattgagtgacttgcctgacgtcacacagcagtggctttaagtatagttgacccttgaacaacatggatttgaactgcatttgtctacttccacatggggttgtttttttttttttttcccccaaccaaacttggatggaaaataaaggatttgcaggatgcgagtttgagagcatacttttcatatgggtgagttctataaaggctgactgtgggagttgtgtatgcagattctggtatgaggagtaggggtaggggcattggtggatggtggtggtcctagaaccagtcctccacatatactgagagataattgtgcagtcagtcctcattcatggatttcaaatttgcctacccaccaaaatttatttgtaaccccttaatcgatacttaagtgctttcacaggcatttgtagatgtgcagagtggtgaaaaatttgagttatccaatgtgcatgttcccagttgaagtagaacaaagcaatgctgtgcctttttgtttcagctctcatactgtaaacaagtgtccttttcttagtctaattagtgtcagggtgttttgtttttgttgtttgcatttttgtgttttctgttgatgatttttgttgtttagaagggccagcaagtgtggtgttgaagtgctgtctagtgtcactaagagcaagaaagctgtgatgtaccttatggagaaaatactgttagaaaagtttcatttaggcatgaagttataatgttcttggtgtaagttcagtattaatgaatcaacattatcgtacatctagaaaaaggaagaggaaatttgccagtctacccgagtgctatagtaacatctctagtttgtggtacagctaaggaaaagatacaataatgactaaacttacggattcatgagattatgaccaattttttttttttaaagcatactgaacagctttcagctcacaacaggttaatcggggttaggaaaatgttaaaacgttcttggctatgtgagagctagctggcttacacattttaaggcaatgtggtatgaaaagtgttgaagttgaggcgagttttgcagatcaagatactatggaagaatacctacgaagtgttatacagggaaaaggttatatggaagagctacttttcaacactaatgggactggcttatttttacgaggtcattggcatatgaacctttgaaatgcccttggccttaattcatccaaagagtgtgcaagcttgttattgtataccaatgccaagggcacctttaaatgcaaactcttgatacacagagctcaaaattcttgagcacttgcaggggaaaaccagaagtgtgtatcatttccattggaggtgggacaaaaaagcatggatgatacccaaaatattctgggattggtttcattgcttcatcctagaagttgaacactatcttcagggtgaaaacttagccttcaaagttttattactggataatgccccagttcattgctgtgaagaacttggaagtgcccatcccaatgtaggagttcttttcatgcccccaaatactagtctcttctccagcccctcagacagggcattttaaaggctttcacggtgtaccacatgagggagctttgtaacaaggcttgtgaggctctcaatgccgacaaggaaaccaccatggatagactcctggaagcagtcacaatatgcatcttcttgattatggcgacacaacctgggggcagtataaagcagtccattgataactgttgggaagatgtttgatcagactgaaaaggtgttaaagaaattataaagaacaatgttaaaaacataatgtgcatcacacagcaaatgagcatagaaggctttggcaacatgaaggaaggtgatatcagaatggaattctgtcttgggaaaaattgtcaataaaacagaaaaatgtggccctatgcttgagcacagtctcaattttaagcgctactgagaacatgccttgagatgcttaaaggatctgaggttaaaagctaagctgccaaggctgacacaatttttggagccactttgggtaagaaaatcactgacactgtcaacaaggcacaagagccagttctacaacctcggttttcatggggcacatcaaaggttgagaggtcagaccacacagcgcagtacctcatcacacattctgcagctccatccacagtgaaattttattaatgtttgttttgtttttgctttgttcttgagacaaagtctaactctgtcatccaggctagagtgcagtggcaatatcttggctcattgcaacctctgcctcccagggtcaagagattctcctgcctcagcctctagagtagctgggactagaggtgggcgccaccatgtccggctaattatttatttatttttatttttatttatttatttatttttgtatttttagtagagatggagtttcaccatgttggccaggctggtttcgaactcctgaccttaggtgatccgcctgtcccggcctcccagagttctgggattacacatgtgagccaatgcccccggccagcttttgtaaaactttgcttaatttttgtttaatattttttaggattttatatgcataagggtacagtaaacagtatgtgttcacagtgttgtttactctatgtgattactgtacaatatgtgtggagtactgtacagtgtgcatgtgctgtgtgagtgctgtacagtatgcgtgtgcattatatctgtactgtgagttgatttcagtacagtagtgtattacacaaatattctctaatgaaatattgttttattattaaaaaatactgtatgaagtatcgttaacaaaattatgtatttatcagttgatgaaaacattgcgaccagaggctcacaggaacctaatcttgtatttcccattgcagcagtggttcagtagtcattgtttggggcaaccgtatagaacataactattccgaattatgtacctacattttctccgtatcaatagatgatgtggagagtaccttatttttactcccttacgctcatatcttccacttatttcagattttatttatgtggggttttgtcttgtttgcaatgcaaataatgctgcagtgaacttagtgtgaaatatctgagagactgcatctgtagaataggtttcagaaattgccattgctgggccgcaggaaatacacaacttaaagtttgaggatatctttggtaattgttttcatttttcttttcaaatttataatcatatttaaagccatttatccagcagagggagtgagagtatcagagagccataataactgttggatcttctttttctgaaataaatttaaaagtacccaagtattttcatagttcaggtttgcaaccttgattttgtacttaaaagttagattgtctttttatatttttctaaaatcattctgatggtatcctttgaaggtgatataaatctatagaatgaataattgctaccactttgctagtagttaggatagattcatattgatccttatagattaagagtatggcgaacatagggataatagcataatttggttatcctcttctgcttttgtgtgttcccttcttaggactgaaaatccttcattgacactaggaagtattgaaaattagacataaaaataaaaatgtttctctttgcttctccatagggttcagcaccacccccttctccaacacctaacaaagagatgaagaacaaagcagttctttgcaaacctttaacaatgacaaaagctacttactgtaaacctcacatgcagaccaaatcttgtcagacaggtaacttaggacaatgtgacttacatacttccccataccttcatctcacctaatgaaatacatgcttttcttgaatgacacctccaggatagattcatttggtcaatttgtcattttctgttgattttgcttacgtaattttagatattacctggagaatacagcatctcattttaaatcattatgatcaatctctgataaaggcctagaatacaaattatgtcaaaagtgaaaaaatactatctcgaaaatttccttggggataagactactaaaattataatgcttcctctgagaaaatcatctctttgcatgtggtttgtaatggtaacagttctgtttccttcctgtcagaatgaggtgaaattgttcaaatatgtattttttatgaaatttacagtgttacctgtgtattctaattatttgattaaataagcctttggggaggttgttgaggagagtatggtagggtatctggaactacatagtgtttttaaaggatgttttctttcttaaaaaaaaaaaatccctaaattctatttgtattttctgtaagttagaacagctgctgctttcttttttgtcctgttctttttaagttacctaacttaaaaaaactgggaattaaaaaaaaaaaaggtactgaggtagttaaatttttctttatcaaattattttaacattgagcacctgtatataagtgttagttaacattgctccttaaatatgttttgtgtttttagatgatacttggaggacagaatatgttccagtgcctatccctgtgcctgtgtatatcccagttcctatgcacatgtacagtcagaatattcctgttcctactacagttcctgttcctgtaagtcacattttaagttctttctcattttgagatttagcagacacagttgggaaaacagtgtacagttgacccttgaacaacaagagtttgaactccatgcatccacatatgtggatgatttttttttttcccaataaatatgggcggccctctatattggcaggttccacatccgtgaccaaacacagactgaaaatacagtattctgcctgtaatcccagcactttgggaggctaaggtaggcgtatcttcagcccaggagttcaagaccagcctgggcaacatggtgacaccctgtctctactaaaaatgtaaaaattagccaggcacagtggcatatacctgtaatcccagctacttgggaggctgaggtaggaagattgcttgagcttgggagatggaggctgcaatgagccgtgattgcaccactgcactgcagcctggtctacaaagcaagtccttatctcaaaaaaaatgaaaataaaaaattatttgaggatgtgaaatctgtgtagaaggctgactgtaggggtgtggaacttgagtatgcatagactttggtatccatccacaggtggtcctggaaccaatcccctagaatactgaggataactctagttgcagttactagtttaatgaagctaataaaaccatctttacctttcttcgacagttaacttagatttggttgaatctctgttgtcatgattgattgctttgtgtatagtatgtatatgttcatcctcgagagtgacatttcgcggatgtctgtgcctgctctgtgcatattaagtttatatttgggttcattttcaaaaggaatatttgtgggccatgtgcagtggctcacgcctgtaatcccagcactttaggaggctgacatgggcagatcacctgaggtcaggagttcaagaccagactggccaacatggtgaaaccccctctctactaaaaatacaaaattagttgggcatggtggcacatgcctgtaatcccagctgctggggaggctgaggcaggagaatcgcttgaacccgggaggcggaggttgcagtgaactgagatagcgccattgcactccagcctgggcaacaagagtgaaattccatctcaaaaaaaaaaaagaaaaatatttgtgaagccataaggtttagaactgaaacatagaatttcatataaaatattattttatcccaaatcacttgcagtacttagaagaacactgtgtcagggcttggctattatagtcccctgggggacagaaatacttcaaaaattctttttctttaatttgaattccaaaaagtagatgcttgtattctaggctttcttatcacagttaacatcttagttttgtatgtgttcttttcaaagcttttatccagtgtgatattacaaagtagatcatgtgtcagagtaatttttaatttggaaaaataccttttaatgtttagtaaacctaactcaaaatgatttggttaattaggtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgagctacactaaattataccttgcgaataagtgttaacattggttatttataagtattgttacagtactttccagggcatatcattttgtttcaacttatgtgggggtgaggaaagcattgtaacaaaaatgttttttatattaagagatctacactgtatttagccaggtgccctcagacagatatccgaagcaggaatttggtctttggtctctgttttaagcaggatttgacttgtaaaatcaactcaaaattattcttgttaatggagtagtgctgatgcaaaactataataacttgtagtagactctaatgatgatcaaaactcttattttgtaatagttatccctagttttttgttttgttttgtttttttttttagatgaactcttgctctgttgcccagggtggagtgtagtagcatgatcccggttcactgagatctctgcctcctgggttcaagctatgcttctgcctcagcctcctgagtagctggaattacaggcacgtgccaccacgcccagccaatttttgtctttttagtagagacagggcttccctatgttggccaggctgatctcaaactcctgacctcaggtgatccacctgcttcccaaagtgctggtattacaggtgtgagtaccacacccagcccctagttttcttttattgcttatactaataaaataatttgcattatctaaaccagagtttatcttaacctctgttagggcagtgcttgcgctacatggtataacgtgatgagtgtgttgtggatggttctaagtcacttagaatatttattttccacccttaaccctctcttgatacccaaagtcctatttcaaccttgagctaattcttacccttaccctagaggacaatcaaaatactataattttctctggatttaataatgagacagtgtttttgaagcactgtggtaaggagttgtgaaattagtgggttgcaaccagtgtttttgtttaagaaaagaaaaagctaagtggaatagggtaagagaaatgacagtgtgaatccctcatagaaagggtaagtattattttgtgaaaccagtgtgtatacagatgtctttctgttccccaccatcaccttgcagtatgtgctggataaaatgcatttcttgccatgattacaacacaaaaacacttgaaagcaactgatcgaaccattaaaaggcagttgttaatatgcatatattgaacaatctgagaaacctgggtcaaaattcaaagagtattgaaaactacagttgtctaccctcattagtttatttttgacaaaaagttgcttttagaaatactttacttgttgaagttgttttactatcaaagcatacctattagcttttgaagggagtcctcctgtaaaatttataggattaaaagttttcatgtgcttgtgactaattatgaggtttatagtggtttacattttgagatagttatatatataatatgcccttttcttttgtgacattatacgtatttttttatattgcatttaaaattaaatgacttgcttttgccagattaaatacagataccattggggttttctgttttgattcctaatgataatatggattgatttcaggtgtaattattgaaacagatataattggttcagaccttttgaagaactctgacccagagacacagtccagcatgcctgatgtaccatatgaaccagatttggatatcgaaatagattttcccagaggtactcaaaacctttatgactatggaatttagttatggagtcaactgtggttatgatcatttaccatttgatgtttgtgtcattgccttttagcagtgttcatattttttattcttgttattttttaaactcaccttaagagttaacttcatattttgttgttgtttttttttaaaaacccaccttaacagttaacttctggaatgagatcacttgagtccaggagttcaagaccagcctgggcaatgtggtgaaacactgtctctactaaaaatataaaaattagccaggcgtggtggtgcatgcctgtaatcccagctactcgggaggctgaggcaggaggattgcttgagaccaggaggtagaggttgcagtgagccgagattgtgctactgcactccagcttgggcagcagagtgagaccctgtctttaaaaaaaaaaaaaaaaaaaaaaattctagaagtaattcattatagaaagtttaaagaagtgtttgtgtcctttttaatttaaaaatgttgttagcatctgggtgcggtggcttatgcctgtaatcccagcactttgggaggccgaggtgggtggatcacctgaggtcaggagtttgagaccagcctggccaacgtggtgaaaccccgtctctactgaaaatacaaaaattagctgggcgtggtggtgagtgcctgtaatcccagctactggggaggctgaggcagaattgcttgaactcaggaggcggaagttgcagtgagccaagactgcaccattgcactccaacctaggcaacaagagcaaaactctgtctcaaaaaatatatatatataaaaaatatataatatatataatacataaatataattttatatataatatacatcatgatgtatataatatataaatatatatttatatattatatacatcatgatgtatataatatataaatatatacaatatataatataaatataattttatatataatatatattttatatatattatatagtttttatatatataatatatatagttagctttttttaaagatcctttgaaaattaagttcaccttcaaaggaaaaattattttcaggtcttttgtaaaataagtgtgccccatttttcattattttcttaatccatggatggctaatgagcacactgagtagaatgtaaaacattagtttttggaaaaaacatttaatagattgaatcagatttgtaccaagaccatttagatcttgtaattggatttcagactataataatttttctggtatcatacattttcatgaaaattttatgttgatattcattttatatatgtttttaggagtttgaacagtgtttgtcagaattcacaaaccatgttaggtacaatgagtcatttactccccagcccagcctagattgtccccatgtatgaatgctggtttacatcctgtggttagttctttgttggctgtgtttatgtaaccctgtgctatttcatttaaaataaaagttctgatttggttgtcagctgctgaggagcttgatatggaaaatgaatttttattaccacctgtttttggcgaagaatatgaggaacagcccagacctcgatctaaaaaaaaggtacattcacttaatagcctatataacaatatttctctataggcaaacaaggatacagtgttcttttagtgtgcctgagaatatgggaacatattttgttttctaggttggaaaataatttattttctatttatatagaatatagtaataatatattactgctatttattactactatttattactatttctatttgtatagaaatagtaattattactatttctagtaataatagtagtaataatttatttctagtaataatttattactgtttctaagtaataaaaatatctcagatttagttgatacctcaactaaacttgtattgatacaaggtcaaaatagaaaacagttgctaaagtagtaagttcaattatttgacaaaaatttagactgttttctagggagctgttttttccacgattatttctgatgagatgatcagtggggttgaagtacacagtttattatttctggtctcttttaggcataccaacacacatagaaagacatgctggacagtttgatcattcaggtagaccaaatctacatgcattaacaagtgtaattgttataatattctgtcaactttctgtgtttctgacttccaacataaagcaggttttaaaaataccttaagaaagatagctttcacaaattgtccccaaaagaaagaaaaaaaaccggaaaagggagagaatacttggagtggaatgaaggtggacttctgcttgacaccaaacacaacaattaactcaaaatgagccatagacctaaatgtaagagctaacaatataaaactcttagaagaaaacataggcctaaatcttaatggccttatgttaggcagtttcttaggtaagataccaaacgcacagggaagaaaaggaaaaataaataaataaactggactacatcaaaattaaaaacttttgcattgcaaacagtgccatcaggaaagtgaaaagggggccaggcacagtggcacctgtaatcccagcacttacagcactcaggaaggctgaggcgggaagattggtggagcccaagagtttgagaccagcctgggcaacatagtgagacctctacaaaaactaaaaaataaaaaccagccaggcatggtggcacgtgcctgcagtcccagctacccaggaggaggatcgaggctgcagtgagctatgatcgtgccactgcactccagcttgggcaacagagcaagacctctcctcaaaacagaactccagcatggatacttacctggcaggggagataccgtgattacaaaactctagcatgggtgacagagcaaggccctgtcttaaaaaaacaaaaataaaacaataaaataaaaaagtgaaaagtacttaagtgtcactctctataaggtggagttgttgaaaagttcttcagtttctgttacagtaatatttagattattagtttattgtcttatatttattttctcatcattggtgactctcaccacagaatttaatatgattttgttgcacaaagtgatttatgtagaaacatcacatttcctggaatattaattgactgttgtcagattcaggaataccagtcagttcaaagcaaatacctatatttcattttttcttttctaatttcatgacacattaaacaaataactatatttttatgacagattaaacagataactatatttgtaattacagatgaccgttgtacaatgcagtggttgggctctgatcccccctgcacagtcacaaatttgtgtataacttttgactccctaaaaagttaagtactagtagcctactcttcactgagcccccctgcacagtcaaaaattcatgtattacttttgactccctaaaaagctaactactagtagcctactgttgactggaagccttgctgataacagttgattaacacatattttatatgctacatactgtatttttataataaagttagctagagaaaatgttatcaagagaatcatatgggagagaaaatatatttacgattcattaggtggaaatagatcatcctcattgtcttcaagttgagtaggctgaggaggaagaggagagaggttgatcttgctgtctcaggtggcacgattggaagaggtagaaggaggttggagaggcaggcacacagaaaaacatacgtgtccaagtggacccctgcagttcaaacccatgttgctcaagggtcaattgtaatttgcctttgttgagagatggcttgtataaagtaatgaaataatgtaggctttaaaaaagatattattatggtgttttttactaatagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttgtaagtgttttaattttgtttctcctaagtcctatttaaaatcaagatttctgttattgagtacctttaaatttaaaaaacataaatgtaacttaaaatacctgtaagaatgcattttattttacttcagagctcttacaaagaataacgtcagaaagtttcttaaccttaataagacgctaaataataacaattattttttattttatgtatttttagctaaatcagtaaagttaaaagaggatctactctctcacaccacagctgagcttaactatgggttagctcattttgtcaatgagatccgacggccaaatggagagaattatgcacctgacagcatctattacctttgccttggaatacaggaggttagtaatttgatggctgctttcaagtataacattaataagaaaagttgtggtagttcttgtttctgtagcattatggaacctttattgacttaccaagaaacacatctacaaagttgtatgtttgctgccatttatatataaatgataatcaggatgacattctttccttacccattgcagataagtgaattcacattataaggcatgatatgtagccacatctggctatagatccatgctgatctacatgtaaacagaaaaatgtcataactctgtaaataggtctgtttcactgtatgcttctgatgtgtttctaacttgttaaatagtataactactcattaattctttggctatttcataaaaagagatcattctttaggggtaaagataaacttcatccacatgtctatgaatttgttttctacagtaaacatggagatcaactttaaataatgacctctagttctgaacagattccacagatttgtgcccagaagtcagaaagaatctccaacttgacattctatgtattttgaaatatggtagatgacaggggagatctcttcagagttttgtttgtaggcctaaaaattcattttattctgctaacaggtgttagataatgaagtaaatcactgaagaaaactagaattgtcttaatttgtgttttttttactttttctttaggatagaaatttgcttaagattctgtaagtggtggtgcagatatatagtgcatggctataaatcactgtattcaaggaccatcatatatcttgcagtagcaacctaaaagatacgtgaataggtttacttttttcttattctcgttttataggtttacatgtactttgagcctcatgcttagatgataatataggtccaccattccacaaacctctgaaaagcagaatttttttcatgaaaacacagtaaacagtaaaacctaacttaaaggattgtgaagctgttgttgtctttattactcttggtgttaatattcgtccatagaacattaaccatagaatttactatagaattgttaatgtttctaaacaagtacagagtgtttacccacaccactctaggaatattaatgtattataattatgtacatgccctgtttcccctgtaaaatccaaacaatgatgaattccaaaacatgtgactccagtggttctggctgaggggttgaagatccatgtgtgtattttccctcctcttcttttattatacctaggagggagggggagactaggagtagcatttatactgtaccaggtgtagatgaaattgtcttggtcctctagtttcagaacaatttatttaaggagaacatttatattttagaaataattctgttatctagatcaattattttttaaagtgctgtagagagcactagcgttgtgccatatcaactcagcaggaagagagtttgagttctaggctcctcttgttttaattcattcctacttttgggggctgtgttttggggttatgtatggaatttcatttagaaatttcatttctggtagaaacaaggcttaaaaacatatttagataataaaacttttaaaatcaataaaaacaacaaaataaggggttctctgccccactgatctctagtctacctagttcctctccctaaggacgtgctttttgctcttttagctatttcccctggcattacttgcaaaatataactgatttttatatattcatcagttcactattctagtaggtggtcttgttttgttattttttaaatatatcttagaattttctatatacacaatcatgtcacctatgaataaggacagttttacctctttctgatctttctttgctttgctttactacattgcttgaaaccttcccccatttttctctcctgccacccaaaccctagtcctagtacagtgttgaatggaattagtgatagcagaaactcttgcctagttcctgatcttagaggaaagtattttgtctttgaccattaagtacgatgcaccctttagggttttttttttggtagctccgttaccaagttgaggaacttttcttccattcttagttgaccgagaattttttcaactttttattttgttgctgagagttgttttttttttaattataaatgcttattgaattttgtcaacgcctttttctgcatctattaagatacggatttttcttctcctattaataatggtatgaatataaattaattttcagacattaaaccagcctagcattcttgggatagactccaattgataatgttatcctttttatatattgccagattagatgtgcagatatattggtgatgatttttgcagatgttcataaggataagtagttcagagttttctttttttaacgataatttatatttataaagaacattgttctatgaacaacaacaacaaaaactcagaaaaaaaaaagtgatcagagtattatttatcacaaataaggcaactaatgccctggtatctcaaaatcctttacaaaaggagatagcttcataagatctagtcaaggggtttttggtatgttactttttttttcttttatgttactttgtttttcttttcatctgcttccatcttaagcataatttcttcagctgtaagacctcccacttgcttattctttgcttacttaactttttgtttgatgctggccacatgaattttagtttcagtagaagcttccttaggtttcacatctggtttttctttagatggaattaaagttttgcttctttgctcatctcttaccgagggcttctgcttgtttagcctttattgcttccatttgctgctactgcttctgatttgccttcgaaaagtattcaccactagccagttcgttatcaatctgactttctggctgtggtggtgggaatggtgtatattctttcttaacatttttttttctttggttccttgcatttattcatatttgtatgtttgaattgtggcaaaaatctctcccaactttgtggttgaaattcagagtcttttgccaactcttttagtcattaaggttttaatattataaataggatgcatattcttcatagtatataggactacttttcaaaccttttttttatttttttgagatggagtctcgctctgtcaccaggctggagcccagtggcgcgatgttggctcactgcaacctccgcctcccgggttcaagcaattcctctgcctcagtcccaagtagctgggactacaggtgcacaccaccacgcccggctaattttttatattttagtagagacgaggtttcaccatgttggccaggatggtcttgatctcccgacctcgtgatccacccatctcagcctccctaagtgctgggattacatgcgtgagccactgcgcccagccagtttcaaacctcttttttaagtcactaaaaggtccagtggctgaaactgtgtttccctgcatcataatggagcaagtacattaagagttcttcagtgtagatcctttgagaccaataagccattgtctttttacaaatctctttatttcttactaaataacctattttaatgatgttacatgcaacatcatctggaagaattcgcactgcctgttcaaatgaaacagtccttgctaacagttctagatctctggtcccaatgatcatatatgaatcaaaagtcttctggtttttttttgagagtcttgctctgtcatccaggctggagtgcagtggcaccatcttggctcactgcaacctctgcctccgggttcaagcaattctcctgaggaggctggcattacaggtgcccaccatcatgcccagctaattttttgtattttttagtacaagtctttgtacttctgttaacggaaggaaagtcttgagtgttaattgtccaggttcttggcgttttgaacaaaggattggacaaaatgcgtaaacaacaaaggaacgaagcagcgaaagcagaaatttgttaaagcaagaaagcactgaatagggtgggaatgggcctgagcaagtggctctagggctgagttacaaagtcttcttggttttaagtactccttttgaggtccttattggttgccccttatctggatgaaggatttggtctaatactaataaaaggctgaggtgaattggccccctgtgcagatgaagggatggtccctgcttggcccgtggccagtccagggcactctctctttccacctgagacctggcagaagggagaggattgtagggagagtagcctttgctatgtgggcatggggagatggggttttcctttctggttcagctttaggaagttggcattaattggccttaagttccctgcccccaggtgttttcccttgattcaccatgaatgactttaatttctctgcctccagaccccatctttctgcctcagttcaaacagtcatgctgccctggatccagtgcagggttgcgttaacattgatgttcgttcaaggctttctgcaccaatggccagcactttctagtaagcttctctgtattttgggaacaaagttatataattgctttcctttaagagtcctctgggattgtcctctttggaaagagctgtttccttccaaccatcaggaacagtaaggaattccgattcatcttggtctcttcagcttccgcttctggttatgaaattcactgtttccagccccctttctggccggttcagagaggaagacaccattttcaaattgcttctggtggagctggaaataaacttgaaagttctcttgtctttacctggctttggtttgagggtagtagtggcttcataaaatgagttggggctgggcacgagggttcacgcctgtaatcccaacactttgggaggccaaggcaggtggatcgcctgaggttcaggagttctagaccagcctggccgacatggtgaaatgctgtctctactaaaaatacaaaaattagctgggcgtagtggcgagcacctgtagtcccagctacttgggaggctgaggctggagaattgcttgaacctgggaggcggaggttgcagtgagctgagatcacgccattgcactccagcctgggcagcaagagcaaaactccatctcaaaaataaataaataaataataatttttaaaaaagagttgggaaatattccttcctcctattttctgaaagaatttgtgagaattggcattcttccttaaatatgcaatagaattcaccagtgaagccatataggcttaggattactttttgtggtgggggtggcagggtgtggatgggtgtggtttttaatcacttaatcagttcctttagttgatatcaactgtttagatttcctgtttcttcttgtaccacttttagcaattttgtctttcaagaaatgatgcatttcatcaaagtcgtcaaatttgttagcctaagtttggtaatattttcttattatcctttcattcctgatactggtaatctgtgccttctttttgtttcttagttcttttttttttttgagacaaagtctcactttgtcgcacaggctggtgtgcagtggtgtgattttggctcactgcaacctctgcctcccagattcaagtgaatccctgcctcagcctcccaagtagctgggattacaggtgcctgccaccacatctggctaatttttgtatttttagtagagacaggacttcaccacgttggccaggctggtcttgaattccagacctcaagtgatccgcctgccccagttttccaaagtgctgggattacaggtgtgagccaccatgcccagcctctttttgtatcttgaacaatccagctcaggaatcagccaactttttcgtaaagggcaagatagtaaataatttaggccttgcagaccaagaggtaaaaatttagactgtaatatagctacttatatataactgctttaagttgtaaccatttataaaagaataaaaaacaatccttagctcataggtttgtgggattgggcccatggagctagctaggtctgtatagttggcctagacactcatgtagctaaaggtgtatcattttaatttttctcttgtattgagtctgagttgtattatttcctttcttaatttgctctctttttatccagtttcttaagatgtaagcttagataattgattttagtgtttcttctttttcaggaaagcatttaaaactaaaattttctctaaaactagtttacttacatcacgaatttttatatgttgtgttttaattttccttgacttaaggaaaatgctatcacaggaagttgaatctctggattgccttttattaaatgattatttaaataattaggacttcaataccgttaagaggttttgagagctaagtggattgtgtaataaattatgaagtatgtcttaaatagtttttttttctctcagtttttgttgtagtaaaatatacataacataaaatttacggttttaagcatttttaagggtgcggtgcagtggcattaagtacattcacattgttgtgcaaccagcatcaccatctatctctagaactcttttcatcttgcagaactgaaactctgtactcattaaataataactctccatttccttctctactgagccctgtaagccacttttctactttctatctctatgattttgactaccataggcacctcatataagtggaatcatgcagtatttgtcctttttagtctggcttatttcatgtagcataatatactcaaggttcatctgtgttgtgtagcatatgtcagaatttgtgtgtgtgtgtgtgtgtgtgtgtgtgtgtgtgtgtgtgagagagacagagagacagggtctcactctggcgcccaggctggagtccagtggcatgaactttgcttagtataccctcaacctcccaggctcaagtgatcctcctgcctcagccctttaggtggctgggaatgtgggcacgtaccaccatacctggctaactaacttctctattttttgtagagatggggtttcgccatgttgaccagtctggtctcgaactcctgggcccaagcaatccaccttcctcagcctcccaaagtgctggaattaacaggcatgagccactgtgcccggcttccttcctttttttttttttgagacggagtcttactctgtcgcccaggctggagtgcagtggcgcgatctcagctcactgcaagctccgcctcctgggttcacgccattctcctgcctcagcctcccgagtagctggcactacaggcgcctgcaaccacgcccggctaattttttgtatttttagtagagacgaggtttcaccgtgttagccgggacggtctcgatctcctgacctcgtgatccgcctgccttggcctcccaaagtgttgggattacaggtgtgagccactgcgcccggccttccttcctttttaaaataggttccttatgtattgatgaatgctttatcaaaaagttgttttactactaaactgcacatttaaaaatggttaagatggtaatttttttgttctacagtttaccaaaatttttaaaaattgtggaatatctatttttattattggatacattttcacagacttgttttcaaagactgtggtatttataagcagctttaaaagtaatcctgaaactcagtgtaaagataagataactaaagtaaactttccagaaatcagtgctgtttaatgttagttcaagatgtgtacagaaatagaagctatttttggaaaagtgtgcatatttttctgtctgttggattcattagttttgctcacagctgacaataaagatacagttgacaggaagtatgattttcttccgtatgtctatggaagaaacagtatctttttttgtaaggactaagtcttatgaatgtatactgaagtaagtagtcacttctgttttgtacattgaaaaattaaacataattgtaaatagctggtactgtatgaaaggggagctcggccttattttttcttgttttgtttgtttgtttgtttttcttactctttctcaaagtaactgactttcctccactgattttgtataaggaacggtggttattgttaaatgttcacataatatgaaaatgtttgaggaagaaggaaaatgataggaaatcctacgataaccatcattaacatttcatgatcattctttcatacactgttttacatatgtgaacacatatccgtcatactaaatttattatgaatagaactatagacacctttttttttttttttttttttggagacagagtctctatcgcccaggctggagtgcagtggcgccatctcggcttaatgcaatctccgcttcctgggtttaagcaattcttctgcctcagcctcctcccaagtagctgggattacaggaatgagccaccattcctggctagttgggttttttttcccccccatcccgtagagacgaggtttcgccatgttggccaggctggtctcaaacgcctgatctcaggtgatccccccacctcagcctcccaaagttctaggattacaggcatgagccaccatgccagccacttttttttctttaatctccccaccttatcactgttagctagatgtgtataattctgtttttcatgaatgtgatgaaagagatagttttgtcagctaggaacactagaccatattatatacttctacatcttactttctcttcatctacttcccagtaaattgtggcagtccctctaagtcagcaggaacaggcctaactatgtatgtatctcattgtgtgctatatcacaattaatttagtaatttccacaatgatgagcattctctttgttttatgaaattttgctgttatagacagtgtatactttccttcctcctctgctcccctcctgccccacacaaatcttctataattatcctaaagaactgatgcatttgtttctgagatatgattccagaaggggtattattggatctcaagaaaagtatattttttatttttaaagatattaacagatttctttcccaaaatgtttgaggatctttttgtgtttattgaccatttgcttttctgtgaattgccccatcgtttatcttttttagtttgtgagtttcttgtttattatagacagtaagtctttgtcatttttccaaatttttctccagaatttttattttttactttctacatgttaagtcttttatatggagggatgtgttttttaagaagaaagaactttatttactaaattaaaaaatatagtaaactcacagtgtggcttgttaatttaatttgtatgtaaatgggtagttttcaaataattaaattctattaaaatacatagaggatttctaagcttatttaatctttattcagaggaatttaagatttattttttattttattttattttttttgagacggagtttcactctgtcacccaggctggagtgcagtggtgcgatctcggcacaccgcatctccgcctcccaggttcaagtgattctcctgcctcagcctcccgagtacctgggactacaggccaccatgcccagctaatttttgtgtttttagtagagacagggtttcaccgtgttggccaggtttgtctcgttctcttgattacaggcgtgagccaccacgcctggcctctttattttttaatagcagtgatgaggttgattcaggctatttgaaaccttctttcattggttaatttagcaaacattaagtgctgttgtatgctggatactggacattggagtaggctttggagactgagataagcatgttgacaacttacatttactgactgtttactgctttccacatactatgctacgtgcttgatgtgtcattcagtcctctcaacaactttactataattatcagcatttttttatgaggaagtaaagttacttgcccaagttacacagctcataaattttgaatctggtgagcagtttgaattaaaagccattacaatatgttccactgaaagagttgaaatacacagacaaataatatttaaataatgttatgctcgtgttgtatacagacttggtaacacagaattgggactaattaattctacctaagtatatacaatgaaaaagtataggaatttagatgacattgagttttaaattttaaattgagttttgaagtacatatagaaatttattcagcaaagggatgagagagggacaatggcagtacaagggcacagtttaccaggaactacttagcctggctggaatgtataatgtgaagtggagaaagctttggggtattgaggctgagggctgcggtaagtaagagtcataccacaaaggcctctattccttgataaaatgtttagatttcatctttatccagggagaaacatgaaaaggttttaagtttttttcttttttttttttttgagagggagtcttgctctgtcacccaggctggagtgcagtggtgtgatctgggttcacgccattctcctgcctcagcctcccgaatagctgggactacaggcgcccgccaccacgcccggctaattttttgtatttttagtagagacggggtttcactgtgttagccaggatggtctcgatctcctgacctcatgatccacccgcctcggcctcccacagtgctgggattacagacgtgagccccactgcacccggccagttttaagtatttttaaagatgatacttgaaattttttttttcttgggcgtagcatctgaaagctggaatattttcattgaaacacaaattattgtgcagaactactgattgatagcttaaattaatggtggattattttatattattattaatgaagctttattcatataacgtttaataaaacaactgatttgagagacttagaagtagaatctaatagccctcaaattatgaatgtcttatattcccaatatttaattttataaattgttatgtatattgtttgcacacagtgtttcttgctttagctagctctccgaaacatttgaccatatgtttgtcatattagtgacaatacttgtctgaacaaacatgccaatagtctgaacatatctaaaatacatgcttttcaactctctgttagctgtgttttatgagattttcattttgcttctcaagtactagtaccataatttctgtttaagtagatatctgtcaacgtgctgctttgccctacaaagcattttttatccataagaaacagggcctttgaaatgtgggtagtctgaaatgagaagtgttctgagtataaaatatatacaagatttcaaagaattggtatttttaaaatgttaaatatttttatattatatgttgggattacatgttttggatatattgggttaagtaaaatattatactttttaacttttaaaatgtggctactagaataaagttaaatgtataacatgttacatttttatcattcagtactgctctttacagatgttccaaaattatttagggaactctagttttctcatgtatagtcccaaagaaatctaagtgaaatgagagaccagtaactcttaaaaaaggaatttatatttaaaaaaaaaaaagatacttttattggctgggcgcggtgtctcatgcctgtaatcccagcactttgggaggctgaggcaggcagatcacaacgtcaagagatggagaccatcctggccaacatagtgaaaccccgtctctactaaaaatacaaaaattagccgggtgtggtggcacgtgcctgtaatctcagctactcgggaggctgaggcaggagaatcgcttgaaccctggaggcagaggttgcatgagccgggattgcgccactgcattccagcctggcaacagagtaagactctgtctcaaaaaaaaaaaaaaaaaaaaaaaaaaagatacttaatgaattcaaatcccataattgaagactttctgtgatgattttttttttaagaaatctactcttcagacaggcctattctatctataagttgctgctcttcttcgcagcttctcctttgcctctgttcctgaaaccacacacaggatttcttctgtagattctcattggttgcaagggctttggtgctaagggagccatatgtgtatagattagatgtttgtaagttgtgactgcctatggtggaaaataacagcaacaataatatggcattgcttcccatactaccacaataagtaataaaacattttgtaattcattctgtaacaacagcagatcatttatcatggattgcctagagaaaccttttcaggaggattaagtgttcgcacttcatttaggaactgcttttagtagagctgagttgggaacttagtttttggtttattattgctaaggttctaaatgttacatagaaattttctctttgtactagatttacagatgaaaataattatttcagaatcatttccctcattttttattacacatgttgctttatgataaaagcaaaaaatataaattgctattctaaacttggggattttactttagtgattgttttatgtaatacccaactaagtttgtatatttagaaatccagaaacaatgcaaaagtttatagtcccgttaaatagctggaatcatgatgttatattttaagcaatcactgctgttctcattcataacaatgaggatctccaggtagtttaggaaatgctatttttagagcatcaaccctttaactaacccaaaagcaggggagaaacctagcattgtcactttcttgatttgccaggcttttatcagttggtctatcattgtatttgaaagacattaattaggagtttttgttctactattttagaattttgctgactaatattcctttgactagtttgaataacattggatcaactcagatgatggcattcttatgttttgattagtgtatacatggtgtacattttttcttttacttttcacttatctgttcttttatttaaaataggctttttgtagacagcatattgtcgaaccttgcctttaaaaaaatcgaatccgacaatatctgtctcttttttttttttccttgagactgggcctcggtctgtcccaggctagagtgcagtggtgtgatctcatggctcactgcagctttgacctcccaggctcaagtgattctcctgcctcagcccgtcaagtcgctggagctacaggcacatgccaccacgcctggctaatttttgtattttttgtagagacggggtttcaccatcttgcccaggctggtcttgaactcctgagctcaagctgtctgcttggcttggcctcccaaagtgctgagattataggtgtgagccaccactcccaccccagtatctgtcttttaattgctgtttagaccagggaccaacagactttttaaataaaggaccaaatggtacatggttacaggtcatgcttgtatgtcatgcagacattcaactatgctgtaacatgaaagctgctgtacagtatgcaaatgaaccagtatgtctgtattccaagaacactttataaaaataggcatgggccagatatggctccaggactctagtttcctaaccttggcttagtgtaatatgatcactgctgtcattgaattaaaatctgttatccttctggttgttttgtattctatctgttctttgtttttccatctttttctgccttcctttgaattaatatgttttgtgattccactttatttccactattggtttattatttgtacctcttaagttttacttgttaccttaggtttacaatctgcatctttaattaacatgtctgcattcaaataatattatattacttcacatgtagtttaagagccttagaacagtgtactcccaattcttgccttccattctttgtgctgttatcatataattttatgttattttctctttaagccccactaatgtttatactttaaatgattctgtaaccaccctcactgttaagatttttctaggtttgtgacagtaagttacaagattcataaatttgcactgttttacaggtggagaattaggaatatagagacaataagaaaaaagcgttagcctgacaaagtcagagtgctagaagagagctttcaatagctacagataacatttcctctcattcttaccactcagtgtttttctttagtcattaccttaattataactcttactttataagaaaaaaaactaaaaagaaaaaaacacttttattttaaaatttacatttttcttcatgcactatataataaacacgggagtcaaatattcttttttttttctgtctgacagactgaagattgtcatccagtttttacattcttgattctggggtgtgtatttcagctttgagtgtttcaagcaacagatttgttgataatttatgattctttataatttctaggtgcatacataaaatcagtcatgttttagtatgcatttcaaagacataaagctttatttttttcttaagaaatacggagtgtaatatgtttactataattagctgattttctttcaagaaagtttgtggggcttttttttttttatagtatttgtgtggaagtaatcgaaaagacaacatatttattgatcctggataccaaacatttgagcaagaattgaataaaatactgcgaagctggcaaccaagcatacttccagatggtaatgctattttcactaaaggtgttgctctcttgatattaggattgttatttttacagagtatgtttgaaaatattataattaagtcacttaaattagataacattttctgaacacttactcgagctcatctgcctttcatctcttgttgaattagaaacaaatgtggtcaataactagtgtttatgaagaactttgtaagaaatgtaatctactttctctggagtacgagactggatgttcatgtcttaagccttccagtggagcttctgatgtaaatttctcttaaaccactgttttcagtccgtgaagaaaatgtgtatgtatgtggagtcatcaatttttttcaggaatttaaattcctgaattttaattttaaaaggatttacactgttttctgaccactgtttgcttgtcctactgaagaacagaagcaaacatccagtcccttattccatagataatagttccatagtagcctctgtattgttaaagagctgcataggtaattctagaattattctagttgatctaatatgaaaggagaattggtatagatttgtccttaaattaactgtgtctgcttctagatggttaaatgaaaacttttatttattataattcttttaaaatagttctctctatttaagggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaaggtagtgtaacagattgctatttttatttttatttttaaattttttttgagacagagtttcactcttgttgcccaggctggagtgcagtggtgcagtctcggctcaccgcaaccgctacctcctgggttcaagcaattctgctccctcagcctcctgagtggctgggattacaggcaggcgccaccatgcctggctaactttgtatttttagtagagacagggtttctccatgttggtgaggctggtctcgaactcccgacctcaggtgatctgcccacctcagcctcccaaagtgctgggattacaggcgtgagccaccacgcatggcccagatttctattttgggattgtctatggtagggatatccaaaccttgccttactaaagaccacctgggtcacttgttaagaacctaaggactgtcagttttataaaataagacaacctatgtcttaagatgtctcagttccttttgtttgaaaaattgtacattaccagaagccataacttaaaactccaaggggcacctggtcctattctttggtataacagacactaggagtgatgtttatatctttcttcaagattagtttaggaggtttatttcacttttattttttaagataaaattactactggaaaaagaaaacatgaagatgatgagccagtatttgaacaaattgaaaacacagccaatccttccagatgtcctgtgaaaatgtttgaatgctacttgtctaaaaggtgagtgttaatgatacttaacttttaaaaatgttggtagaagttggctggtttaaatttaacattaccaagaagtgacttttttagatggattctttctcagatttcttctctctcagttatacccaagttcattcagttataatcttttattttgaaatacccagtttatacatcatacttagagtttaagcatgtgttaagaaatctctctctactaatgaaatttctactgctgtcattttcttttggagatggggtcttgctctctcaccgaggctggagtacagtggcacgtgatcatagctcattgcaacctcaaactcctgggcttaagccatcctcccaccctctgcctcctgagttgctgggactgcaggcatgtgcctccatagctggctaatttttgtattttttgtagagacaggatctcactgtgttgcccaggctggtcttgaactcctgacctcaagccatcctcgtgcctcagcctcccaaagtgctggaattacaggcatgagccattgcgcctgtcattgtcttttaaattacagcaattccaatgacagcaaagcaagggacacaaactttttcttaaacggtcagatggtaaatattttaggcttttgggcctatagaatcactattgtaactaatcggttctcttgtgactagaaagcagccatatactatatataaattcatggcatgtggctgtgttataataaaacttcacataagcaggtggctggctgtagtttgccaatgcccggtgtaaaggtatgctcaaaggtagtatagataggtggaaatgtaagtgaagtatttacatttaagagaaaacagtcaagcaggtatgaaaaatggaatcatgttctggaattttttttcccctcaatctcagaccaacaggcattttaaaaagtttaagccaataaaacgtttagagaccatagattattttatgcttgcctgttgttttaagtaagcactctctaattttcagaaggtcagcatgaattcaaaatgtacttccctgtttaaacaaatttataaatcacaggtccccaggatggccctcaaggacttgtaaaaacaatagtatcatgtataggatgatattagtacaagttgaatgcgccttatccaaaatgcttctgaccagaagtgttttagatttcagattttttcggattttggaatatttgcatatacattataagatgtcttagggctgggacccaactctaaacatgaaattcatttatatttcatatacaccttatacatgtagcctgaagataattttatttatgcatagcctgaaggtgattttattttccccttggggttgctgaataacctgtgtgttatgtgcctgtgttttgggcgcgaactcctcacatgaggtcaggtgtggaactttccacttttggtgtcattttggcaaagagtttcagattttggatttttgaattagggatgctcagcctgtatttctcaccatggtttagggtggtcctatttggctgcagtagtgtcagggtcttcagttggtagtaactatttgttagtaggaaattcctatctcactattaccttgttggtattttaaaaattgagtttctattatgtagtgctgtaagaattttttaattttatgtgctgccatacatatttcatcaattctaagacattttcacatttcactatttctgaaactgggatgcacagtttaaattgttgcatcttgaaatcataattggcagtgtttcacttgcttaatggtagcattaaaataatgagtggtgtgtctattgatagtgtcttggatttagtgaagtagaattaaaattgtgggaaataatctctatctcagaaaataactttgagaatattttaatgacagaataatggagacagtggggcatagggggtctggtcatataacgtgattaatggggtctgaattattcttgaaaaaagaaaaagttgtggaaattttgtgaaattgactttttctctttttcctcccgcctccaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcat

SEQ ID NO: 13118 - DNA, 107800 bp, Human
gggctccatgccatgacctcccagccaggcaggctcctgcgtccgtgctgtctgggttcccacaggccctaattcttagaaaattcccagggcacagaatctgtttcctctcagagccctcctagccccacgagaggtcttgtcaccaccacaaggggtggtgacataaaagtgggtacgtagtttccccttccactggggcgcacccccagaaactctgggtctgacaagcagccctttccctgacccccgtgacatgggccctgatgcagccaggaagctgctaacggtggtcgcccagagaggctttgaggtggcccaagtggcacaactcttggctggtgggacattctgggagctccctgggagggaggcagtgcccacaactttgggccaaagggccaggaatgggcctccgctttttcaagctgcaggaatttattttgaattcttcgtaagactccaaaaaccacataagctttggggtccactcaaatgtcaaacaaactcctaagtgggaccagatgtcgccatgctggccacagagatcacaggagtggccgccctgctctgtcctttgcctgtccagcctctgcacttctccctcccctcttaccctctagttccagtgcccggtgatgatttccaatgataaggatggaagccagagcccggcccagcctgccaaggagtcagtccctagagatctccaggagaagcccttctagggagacgccctggtctaggcatgtgggtctttagctgcagagtcagggccgggtggaaactgctggtgctgctggagtgcgccagacacccggaagcaaagtttggggagctgagtgaatgccccagcactgtaggtcagcgtctcatgggggtgccctcagagccaacatcaaggagtagctgaagggctgggcgcagtggctcacacctataatcccagcactttgggaggccgaggtgggtggatcacctaagctcaggagtttgagaccaccctggccaacatggtgaaaccccatctctattaagaatatttttaaaattagccaggcatggtggcaggactgaggttgccatgagccgagatcacgacattgcactccagcctgggcgatatagtgagactcaaaaaaaaaaaaaaaggagtagttgatggaagaactctatttcgctatagagtaagtcctgtttgcctctcaaataaaaattgtgcctccacataaaaattgtgcagaggcagcttaacccacatccccagccccatcctcctaccagcttgccaccttgtaagcacctcttaaccagggattctagagccctgttccttcagtgcccactcagggctcagccttcccacgcaccagactgccgggggctgagactcctcagtgtgcattcgttggcaggtaacacctcgtatgaccttgagactgttttatgtgtgtcttccagcctcccttggatcgtcagcattggtagggcaacgaccatggtgtttttttgtgtgtgtggttttttttttttttttttttggtgagaggcaatgtagagttggagcatggcttagagttgggccaacccaggtttgaatcaggctctggcacttacctgctgtgtggaattggcaagtcactgaacctctctgaagtggcttattagctttaggatcactgtcattgttgccccagtggactgccttctttatgtcagatgttaaacattctcacctcatttaaccatcataacaactcaattaagcagctattgttatctccattgtacagatggagagagtgaggtttcccagggatgtgcagagaatggcagagtcaggattcaatcttagatttgcaagtagaatagggacagccttcccagcctctccatgttcctccaggccctgcctgtagaaggtgggactgtcggaggggctgtgaatagtccccagctctgagcatccttgtgttgactctgttttggtgaccccacaggaggaacgtctgcgggggacagtgctgcccaggatggacaacagcaaacagcaccaaccactgtatcaaacgtgagtgcctccaccagtagcagacactccgctctatcaaacgtgaagtgccattccccaccctactcccagggcaggtcaagcttaggtactccagaacctggagcagaagcgtctttcctagtctgcgtcctgaagatgcagcccctatttaaagtggaggcaacatccaatggaagggaagaggtttaaaaatgcctctagctggggccgggagcggtggctcatgcctgtaatcccagcactttgggaggccaaggtgggtggatcacttgaggtcgagagttggagaccagcctggtcaagatggtgaaaccctgtctcttctaaaaacacaaaattagccaggcgtgctgatgggtgcctgtaatcccagctactcgggaggctgaggtaggagaatcacttgaacctgggaggcagagtttgcagtgagccaagatcacaccactgcactccagactgggcgacagagcgagactccttctcaaaaagaaaaaaaaatgcctccagctggacacagcttctcaaatcaaatcactgcttgtgttttcaaagcttcctgcactccctcctgctgtcctactgtgttggccccactcacactgccggcagggtctcaggagactgcatgcacctatgttctgcagaacatgcctggcccagagcctccgcatcccacatttccaagggcaccattcatgtagcatgtgatgagaatccacctctgccctggcccctggcccaatggccctggcctctgttagccactctaccaggatggtcagatgacactgtgacccatgcctggagccgtctccccttggactgctctgatgcctggcaggctggctcgaaggagagaaaagccatcttattttgtggaaaccaaggagtgagttaggaagagctagagccttcacacctgagcctcttccactgatggtatcaggagcattaacaacaacaagagccagtaccttcatagcactcactttgtgcagggtgcactttaaacatcctctgtggcgggtggatgaggaacgtgaagcacaatcaggtaacttgtccaaggtcatgtagtcaggaagtgcagagctaggatttgaatccagacaacctgacaccagggtccctcttcttaatacctgtaccctgctgccaggtatcttaccttcatttctgggcctcactttctgcatctgtgaactggaggtgatggtactattgctgtcactgctactgctactgctactattagctaacaactgagtatgtactagtgccccacactgcgctaagctcttcacatgcattatcttagttcgacctgtcaatcatcttatgaagtaggtgtatgcttatcatcgtggcttacagataaggaagctgaagctcgggttgcttgggaaacacggccaagctctgctgctgcaagtgctgagctcgggctggacccaggcagactgactccagaactccaggctccgatctcctgggcttcgttcactcccgacaccagcgaggcctggatattccagagtgtggaatccccacagaccatagcagatatgggagtctgagggagcccgttggatctttctccttcctcccacaggcccctcttgggtccacatcagctccccaggaactccacctgactatccttcaggtgactgcccctgcctctgccagtcccaagcctggctgcaaagcctcagtctcaacagctcccttccttcaaggaccagccccaggcccttctcggtaggagggcttcacagctaatagtccaggtgtgtgaaaaaacgtatgatgttcccagcatgatggatgccttcatctgggaacatcatacgttattctatgataacgtatgataacgtggttgtcctaacaccccacttgatgggatgcgatgcgattgctcccattcccgcgagtctggagatatgggttcaccaagctcttggcttctgcctcaggcctcgtggccctgaccctctgcctgtttgaagatgcagctcaggcagaattttgggtccctcctaggacctccaaataacagaaccagagccaaaaactcaaaaacaaacaacgaagcagatctgcttaaacaccctttccttttcagggaacgtggatgcctgggggcggctcagaggtcaggccctcagtggtcaggggcaccggtggggagaaacacttgtccctcattatttatttttatttaattaattaattaattttttgtagagacaaggttttatcatgttggctaggctggtctcgaactcctggcctcaagtgatcctcccacctcaccctgccaaagtgctgggcttacaggtgtgagccaccacgcccagcccctcataattttaaagaagaaagtgagcctcagagaggcggtgacttgctcaaggccacacaccttattggaaaagaacctgagactcaaaatcagctctgagcaactcctctgggtagagaagccagggatgtgggcggccaggtggctttatgctaagcagaggctctggggctggggcctggcactgtaatttttttaacagcatcccaggtgattctaggtgtggtcaaaaatcactgagcagagttgggggtcagtcataggaagatctgccttgggggccctcctcaaacttgaatgttcccccaaccctctaggaatcacatcaaagagaagattctgattcagcagatctggggtggggcggatattctatgttctaaccagctcccaggaacgctgacgctgctggcccagggaccacactttgagtagcagggccttccaggactcaggaggcctgggcaggagggactgggacttggaggtgaggaagagggttggtatgtttgagagagcttagcctttgttgggaggttgggaggcagcgttggctgatggagaatgttgctgaggtttgagctgaagctgcagcgggtggcttcatagggggtgggcctttccccagctgccccaggggtctgggcataggtctcacttgggccctccagccctggaggttctcggtttcctaacttgctagtgatgttccagtgttattctctgccaaactggagtttcaaccctagaaactcaaggttgagtgagtttgcatactgttacagtaccagtgcatgtgtgtgggggcatccttgtgccccagtgggtgctgcgccaggatgctgaggtaggatgctgccataccttctcccctggtatttctctccctggccgtctcaccctgctgcccccggtcacccaccctgacccaggcatacaggccagctgctctcctgaagggagttgccagtgggcaacagcccctcccacttgaagttggctcgcccgtggcagggctgtgtgctcattaactggtccctgtgctgtttgcttgttgctatttggctgctaataagcctaatgagaacccacgcaggcgggcggtggggtgttggcactggatggcttcatccagagctccgcagaaggtggggctcttggctccacaccccgtcagctggctctcccccacccctgtggctccgcacctccctctcccctcccaacagctgccctcctggctggggcagagactgccaatgttggggaatgttcatgattctgtcctagcagtttcacacatgaagggatgccttcctgggccagtgagagatgggggctgacatcccccactgccaagagtaaagtctagtgccagaaccacagggagactcagtctctcccagatatctgtgggcccaacccactgcccatgctcagggagtgctggctcctgctcagttgccctctcttgcctctggcagaatcaatcccaggtcactgtcacacaccagtccatctcccgggcctgccctccttccgccctgttctgcaggtgcccattgctggaagcccagcccctccttccaccttggcgggggctagagctgggccgccatctcctcctccagtcttggtatctgcctttccttctgtagctttgccagctctctctcgggacttatgtgtttatgtatttgtggaggcagctgattgcggcctgccgggccctgcccagcagaggggaagaactggagggtgtggagtgacagtgtcctgtttatagttgcagcttttggaagactgtccattcttcccagactggctcccgcccaaccccaccccaactggggaaggggatttgaatactccctagacttctcattttatctcagcctggacgcacaggggctggggctgctttggggaggacagaagagaatccctgcagctgtcgaggagggggcaggcaagttactctcccactcctgcccccagcagcaaggctcgagattaagagcatgtactttggattctggcaccagatccctggagacgtgtttgagtcccagctctgtgtcctgggggaagtgactggcccttttctagccacagggcctcgtccataaaatgggcataacaatctatatagagttggttttggggatgaatgatatgaacgcgatagctcttactgtgcaccaggtaccattctaagcacttcatattgttcatttttaatcctcacaacagccctataagctagattggattttttatccccatttacaaatgaggtcggctgtctgtccgagtcatgcctctgagactcatcagagcccagacatgaatccaggtagcctggttccagagtgcgagggcttagctctgtgctttctgataaatgagtaaatgtgtgtagacagcctggcgcaggctaagtttagctggtattttaatgctagatcaggagaccatgctggactgcctgggtttaaatgtcagctctcagctccaccacgtggctgaggggctatgggcaggctgcttaaagtctttgtgtctcggttgcctcttctgtaaactgggatcaacattgggccctgtctcccagagttgtaaggaacaaacaccgtcacttaggtcagatgtttagctcaaggcctggcatgtgcgatgcactctatacatgtttggccttgattttgagggcagggactgtgtctcaccaccctcagcaggcagcacgctgggtacaaggtaaagggtccataagtgtatactgaataatacagagcctatcccggccgtgtgcctgagagagccctttctgttgcccaagttctatcagcccttccagaaactccccacggtgttcaggggatcctggggatggtgacgctggagtgggcctgagcatttctctgcgtgtatcacgtgggcaatggaatggcatttccccaagtccccatctcagtcctacgagaaccctgtctctcctgatctgagctcctccttggcttccttgagggagcctgtttgccccattcatgacaaccacatcccaaagtggaagactgtggcaaggtggctaagagccccagctttggagtcaggctccctgagttcaaacccttgctccatcacttactagcatggtgatcttgggcaagttgttgatggttctgcctcagtttccccatatgtcagatgaggatgagagtagtacccagtgtagttataagaatgagatgtttatgtgaggtaatacatgtaaagcagtgagcgcagcacctcgctgtgggaaatgcttaacaagccttaggaaaaggagtaagggcaagggtaggattttcatcttcactgactggttagcacccaccaggagccaggaaccaggagccaggaaagtctcatctccggatgaaccagccagtggggactctgaagttggcagggagtggtggagaggaaggtgggaggtggcgaagggtaataattatatgacctcagtggaacccagctgatatgtagggtgcactctcatcaagagaccctgtccatttcttacccctgcatgggggtacccttcctggggagatcttcctggggagcaggttaccctgaggctctttgtccaacgaggtgattaggagatgtccttgactgggagcttcctgaagccaggtgctgtgtcctgctgacaccagtggagtgcctggccctctctccacacctgtgtcctttgtacatgcttgggacctgtttatcaaagagctgagtggggaaatgatggcatgggtggctggcagtttcctccctccatccccagctgcctcttctcagtctccttcactggcttctccctctctacctgacgtcttaatgttgggcttccccaggactttccccagaccttccaaatccctcaccccaaagagggaggccataggagccaagcggagcatgaactgcccctgggtattgagtgccagcaggcactgtgcccgacaattgacatgcaatactaacagtaatgcccggggctcactctgcctggatgtgccaaatgctgccatcttccttcaaaccctcatggtgttctctgtcctggtcccctcctgtgtccctggctgctgcttctcctctgctcactactaaactgtgggtttcccaggacttagtctggggtcttctattttgtttttgcattgctcccggaacaatctgctgccttctcatggatgtaaacatcatctccgggccaatgacgcccaaattcacatgaatcctctgccaggcctcttgtctgaccttcagtctttcacatctgctgcctgctcaacatctgcgcttgatgtctcccagacatcctcatcccaacttgtctaaaatgaactcgtgacttcccttcctctgagctaactcccccgtgcaggtcttactcactctgttaactggcacccccatcgacttgactgctcgagccagccacccaggggctacagggacaccttcctctcactcaggctttgacatcaacccattaccaagccctgtttgttttacttcctcagtccctcgtggacctgcctgcttccctgctgcctctctgggccagggccctgtcacagctctcctgggtgataccacagcctgctgcccgctctccctgccgccctcaacacatcccacctgaaacttcctgcagcggcatctccacactcacccagctccctgagtgcagcctgggccactggcctctaggctggtgcacatgctgctgcctctgtgtctgctccccgtcatctctctgtgcggctggcccttgtcatctacccagtctctgttttgaggtgtcctcctcagaggggctgccctggccactcttgcttgagtggcccccaccggccttgttcttctggatcttgggccctcgactgtctcctccatccctcacgtaccaagttctgctccacttctttgtttttaatttttatttatttatttatttatttatttatttatttatttttgaaacagcatctggctctgtcacccaggctggagtgcagtggcgcaatctcggctcactgtaatctcggcctcccaggttcaagcagttctcctccctcagcctctcaagtagctgggattacaggtgtgtgctaccacgcctgactaatttttgtatttttatagagacgttttgactaatttttgtatttttgtagagacgtttcatcatgttggccagactggtcttgaacacctgacctcaggtgatccacccgcctcggactcccaaagtactgggattacaggcatgagcaaccacgcccatcctgctccacttctttgtttacctattgagtgacagtccctctgactaaattgtaagccccaaaaggacagtctctcttgtttgccatcctggcaaatcgtgcgtttgaatgcattactgttttctagagaagaacactgaggctcacagaggtgatgaaactggccccaggtgagatcccacagtcagaactcaaacatgggtctccgactgcagggccaaactgtccttcatgcccctgccctggcctctctgatttgtcagtgtttggggtggtgttctcatccttcccgaccatcctgggcctgggcgcggggctggtgctgctgtgggaggatggctggctccactccagcctagaactgtctcccctggaagctgcttctctggaaaagactcatccccagggacccctcccagcctgtctcacctctggggcccctctggcactgaggcttcctcccagacaagccttgggactgtggggatggacagacaactcttctctgctttggggcagcagctggagaggagcctaggcctctcagccctgggccatgagctgggcccagagtcttcctcctcatgcctgctggagccggtgggattggggctgctctctgccccagcccctggccccgcggctccccagccctgacctggcccagtgttgcagcatttgttaatgcaattaacagggcggtccatgctgaagggctgggggccaaggtctgactcacacctccccttcctcccctccagccgccaaacccaaacggtagaggcccgcttggtctgccagacagcgtctgcagagagcaagtgaggggccaagaacggcatctttctctcattaggaggttttatgcgaacacaactgctattttggagctgggcacttggccggcccctgagccccagtgcagtttccagccgtcctgagccatggtcctggcacagctgtgtgggagctgggtgagcccctgaggccctgacttctcccacagcctgggggctcgggtcctcagtcagggcctgggagacacagcccctgggcagagcttgagagtggagagagcgattctgaggtggattccgagggtggattccgagtgtgggtgtgagccagacagggattccctgggctaggggatctctgacatcagggtccctctccttcctgtggaaaccaaaagtcaaggttgtggagaaacagctcagggccacaggtggaccccccagtaagcagattccagggacaaactgaggtctccaggtgagggtcccaagttggatgcccaggggtgtctgaggtaaatactgtggatgaggtgcaaactgtcccgtctgcgaaggcctctagctgtgaaaggggacagggccccggcctgaggaggggatcgggtggctcagtggatagggtcttagcatcccactggcacagattttagggaaaatggaggtttaacctgggaagcagctgagcttcaggaatggggggctgggcccagagtctggagttgaagttcttcccccagaccagagcgggtggcactggaagccactgaggaagggagaggctaaaggggcccaccctgaagttggtgcctcctctatctaacgggtcatagatggagggcaaaggtgtctctggggcccaggagagagagccgatgacaaacgccttgcccggggggtagggtggcagtggggaggggcctggctatatttgacacctagaaagcagtccccacccagcaccatggcccttggttgtttatctctgtaaccagggcttgatccctggagacgtgtttgagtcccagctctgtgtcctggggcaagtgactgggccttttctagccacagggcctcgtccataaaatgggcataacaatctatatagagttggttttggggatgaatgatatgaacgtgatagctcttactgtgcgccaggtaccattctaagcgcttcatattgttcatttttaatcctcacaacagccctataagctagattggatttttatcctgagggcctgagttgacattgccctttcctggggaaagggtcatagccaagaagctcagaggccatctggcctctgggggagtggttagttttgttgttgttttaggctttgctgtgctggccagtggaacttcctgtgatgatggaaatgttctatatcttgctgtccagtgtggtagccctgagccacatgtgggtatcgagcacttgaaatatggcttgtgagactgaaggaactgaattttaaattttatttaatctgaatccatttaaatttaaataaccacatacagttcgtggctacagtgtgagactctcttgaacagcacagctttagagagtacaaagtacacccacgtccaggtgctcagctgacactcacaacagctctttgaagcaagaattatcagccccatatcgtggacgaggccactggcacactggtggagacatctcagcgagatgacatgtgtccaaggtcatgcagctgagatgtagcagagctggggtcaaaccaaaccaatcctcctgcccccgaccccgtgttcttgctactacccagtagccaatgagcaggggctctgagcagatggtaggagcagcctgcatggggtggtcgggaggggctgtttctagaatctctcccaggcctgcccattctgagtttggtcccttcccaaaagtaggggttttgtgtggaaaatctgagcaaacctctgttgactgttctggggtggagtgaagggagaaggggctcagctaggaacatggggagattaggggaacaatgccttttatttcttgcttttaaagcaatttcaggagttttcttcctcttttggcgtcctgctgactccacagagcggaacacccaaagctgggactttccacctctctaatgctcagtgaagagcgggccaggggggtgtggaaaagaaagggtcctggaggagcccaaattacgaatggctagagactggcattggcaagcgaggaggcttcgtcacagtgtagtcttccggttgtccgagggtactgtcccaggggctggggggtattccgtcttctgcagatcaactcccgcaggctaaatgtggacatcgcggtatcatgcttgataaacggaccaataatcaagtggagattcattagaaccacataacccatactaggttgatttctcaagtataaggcctggtctgttgcccaggctggagtgcactgacaccatcatggttcactgcagcctcaaactcctgagcccaagtgatccctcccacctcagcctcacaagtagctaagactagaggtgtgcaccatcacacccagctaatttttaaagttttttttgtagagatggggtcccactctacaaaatatataagtataaggcctggtctgttgcccaggctgggcaacccttggactaaggcaatcctccagcctcagcctcctaaagtgctgggattacaggcgtgagccaccgcacccacctctaggatctctactattgaggaaaaattggaggcatcaaactccaagggcaaaacatgaagactcgctggcccaccatggatggaggttttctctcttaaaattcccacagcaccgcatggaactgcctctcctgggacctcagcgtttccttctttgctctaagcaatagcctctgccactggagattctgagatggccgatttccttttggatatttaagttttgaaatcatgctcatttggcataggaatgtttcacttcagtctcctttaaacaaaaggacacacaaccacgattgcccctccctcccgaagggtcactggacttcatgcatcagtaatgtttccaaaaatatcttaagtaccaacatgcagtggccagcttttcatttttccaagtgaagccatcaggaaaaaacaaaaaacaaaactaattaccacttgtcatcacctttaattaaaaagaacattttaactccaaaaatgtagaaaagacatcatctcaaaagacactctttagatgggaaaaatatagcctatgaaaaagaaacaacccaggaaagtgtttcttttcctgactttatggcagatgggtaaaaactgtcagaactgtcccattcatagacaggcactggaagccaccatcatggaccatttaggggtgacttttgggggaatggagagagaggagaggagtctacatacttcaatcccataatgcaaacactcagctcaaaacacaatgcttaatttccgtgaggaagccaggtagttccaggcatcttgccgagacttgtgaaaacaagagaggatgcgagtgaagccggcgagagctggttctaaacctccaaaaacctgaaacttcttggaggctctgcctcagcagattgggcctctgcacagcatcctacatggttaattcagaagggttaccttcctgaggggatttttcccaccaacacgtctggctggtttggaagccttttagaacttgatttactaggctattatatactaaatgccatttccacagttccccctaaccactcatttcccatgagctgtttgttcattgtaccaaccaaagtttgccagccctaaccctcactgaagacctaattccctgcttggaaaatggtttctaggaatgtgggaacccccactggccagggcttctccctctgcagggcccagtcttgttcacctttctggcctcggcacccagtctgatcaagataaggtgctcactacatgttttcggaatgtattattagcaagcaaggcagaaccagagctaagtgagtcgtggtgtgccgtaggggcttggctcacagggtttggggtcttggatttctagacagtgaaagatcttattttatatatatatttaatttcaatagcttttggagtacaaatggtttttggttacatggataaattgtttagtggtgaagtctaagattttagtgcacccatcaccggagtagtgtacattttacccaatatgtagttttttttccgcaacccttcccactctttcccttctgagtctctaaagtccattgtatcactctgtatgccttttcatacccatagcttagctcccacttgtaagtgatgacatgtatttggttttccattcctgagctacttcacttagaataatggcctccagctccatccaagttgctgcaaaaagacattatttcattcttttctatgactgagtaatattccatggtgtatatatatatcacattttctttttcttttctttttctttttttgaggcagagtctcactgtcgcccatgctggagtgcagtagcacgatctcggctcactcctgggtttaagtgattctcctgcctcagcctcccgagtagctgggattacaggcacctgccaccacacctggttaattttttgtatttttagtagagatggggttcaccacattttctttatccactcattggttgatgggcattaagttggttccatatctttgcaatcatgaattgtgctgcagtagacatacacgtgcgggtgtctttttgatagaatgacttctttgcctttactcagtagtgggattgctggattgaatggttgacctacttttggttctttgagaaatctccatactgttttccataggggtggtactaatttacattcccaccggcagtgtataagtgttcccttttcaccatgtctgtgccaacatcaattgttttgtgactttttagtaatggccattctggctgggataaggtggtatctcattgtggttttaatttgcatttccctgatgacgagtgatgttgaacattttttcatatatttgttgtatgaaggatcttattgttaatgtgaaggatgggctgttctcagggctcaggaggggaaggatggaagctagactgttttccaaaggccatcctcggggcaaggaccacacactcagaggtggaagctgcatgaccttcctctcacccacgccgggctttgggtctctgtggcagagaggtgtgggtccatgtgggagatcactcaggccttcccattctattccctccctaaaaaaaccccaaggccgagacctgccctgggcacatctgcttcctccatgttcactagcactggcgtggctgctgggctggccccagctgaccatgtttccagtggtggtggtgacaggggcctggcaggtggtcaggtggggactaagtatgcttgggcagatggaggggtggccaggccaaaatcctgccgtggtggcagtttgtgtttggggaagtgctctgggttacaattctctgacatggttttacctagaggcctggagcctgccaggaagaggtgcctgggcatgaagaaaaatgctctggcctcagagcccaacttgtggttggaatgctattaaaacctgttatttcccatgctctctgctgatagactggtcttgagtgcccttggtgcacaatgtccaatttattcatcctttgtgtctctggtcagcatcacctcctccaagaagccttccctgactttccctactccctgcctcagcctgggttagagggtccagctgacatagcacttgtcatataacttgtgtgttctactttccgtgtcagacagtgtgctggagacactatcacaagcttcacatccagtgagtgctctacgaatgctcattggataagcccatgagatgacgtacatcctccatcattatttaaaaattctgtgtgggctttggaagggtgtgtggtcctggggtctccactgtcagggccaattgagatgtgcagtttctcagggcagagttcccaagggtgcatttggtggctgacttgaagccaacagatcccctttatttccttatcagctctgggccaaggctcagaaatagtagagaggaagaagaagaaccatgcccacccttctgggagtcagtgggggtggaaagagcctgggcttctcagtcacatagaactagatttgaatcctggctccaccattaactagctgggtgacctcaggcaagtctcttaacctctctgagcttcagcagcattatctgtaaaatgggaatcatagtcacacctgctgcatagaattgtcgagaggcttcagtgagagcgtgtatgcagagcacggtgccaggcctattgtcacactcatcagacagtatctgccataataaaaataataataatcatgttattgttaggcatatgttaggagctaaagttacaaagaggtgtaagagacagtcactacacttcaaggggctgactatatgagtcaggaaattgagacacatgcataaaaaaactaatggcagcggcctcgtgcggcggctcacacctgtaatcccagcactttgggaggccgaggtgggcggatcacctgaggtcgggagtttcagaccagcctgaccaacatggagaaactccgtctccaataaaaatacaaaattagcagggcatggtgtcaggcgcctgtaatcccagctactcgggaggctgaggcaggagaatcacttgaatctgggaggcggagtttgtggtgagccgagatcgcgtcattgcatccagcctgggcaacaagagtgaaactccgtctcaaaacaaaaacccaaaaaacaaaaacaacaacaacaaaaactaatggcagtatgcagggcacgcccagtgaatggcaaacacgacaagtgtttttcctgttaatcaaaggagggagcagctgctgagaggtgggtgtccagcatggggaagtgggtcttgagggaacagtaggagccaggtaaatggagagcaagtgggaaagaagagaggacatagcacatgcaaagacagagagaagacagagcagaggctacctggggccacagccagcaggccagctcggctggagcacattggcttagaggaatgttagaggggatgagaccaggagggtcttcagcgctcgtctatggacttgaatcctgaagacatcagggagccattgaaggtctctgtgacatgggccaggtggaattttggagatgtttatcccggccagcccctggtttggattctggtactcttctcagaaaggagagttcagctcacaaaacccaggaacctgctctgggtagctgtgcctggtagtttcacaggtgcccttaggatccctgagatgacagggtctgtgtatctgcctcctcttcctcactgaccttgcctacacctcctccgccaccagaccctggccttcctgggtctctggcggcttctcgagtatgccacgttccttccagcctccacagcctggtcttcgcctcgtcctctgcttgggaaactgcccaggtctttgggggttcgcttcctttgcacgctcccatctctctcttcagagaggtgccctggccgccccatctgagtctcctggttcggcctggacccctgcatcacctgggttgtcttcacagcccttgaaactgcctgaggccacatcatgctattgttttcttgcttcctgttggtgtcctttactcgaccgcaagccccagatggacaaggactttgtcccagtgcctgacattcactagggctcaacagctatttgttgaatgaatgagcgacagatggatgaggcattgggtttcgagggtgcggtgtgagccagaccatgcttccggggctcacatgtgttccccagtggaggtcctggtgggggaggggccggactccatatcccagtgtgtgcctctgcgtggaatgttcccttggccattaatcatgggatgtggctctggactttgcaagggggtgaaggacagtgaagagaggagtcagcctggggagctggtggctaatgctgcatagggctaaccgggaggagggcctggtttcagctccaccttgcctccggctggacccacagcccaggaggcagaatccagagagagcctgagcctgaacagaggccccacagagcggggcacttacctggccggcagcggctgtggtgccggcagctatattctggccaccgtgctttctctggccgcagtcgagagttctgccttgctaaggagggtgggagatggagaacaatgggaaggagaggagagaccgtcaagctgaaggtgcctttgaaggacccttagagtcctccagcctccttagttcacccctcccgtgatttaggcgcaaatagaggctcagtgaagtcaagaccatgcagctcacaagtgacaggaaaaccccagcaactcaaaccgcttgaatttcaggccagtgttgggccctttcccgcaaaagagactgattcattcatccattcgctccatgtttactgagaatctactctgtggcaatccctagtcaaagttccggggccgctgtctgtcctcagggggcttccagtctggtgggagtgaacatttcagtatagacacagtgtcaggcagtgcacttcctcttcagggtgtgctgtgggacgtggtggtgtgagccactctgcagctggccatatagtctttggttgtccagagatcagaggtgaacaagtcctgggggtctgtggatggaggtgggagagacatgggtcagggagccccctgaggccaggagagtggcttcctgcttgagcgacagggttgcagcactcaggagggcccttctgacaggaaggtgtgggcagctgtggtctcagtgccctatggccactgctgtcacctctctccctgtgtcctcagccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggtaagtccccttctccatggggcttggggtctggggctcagtctctttttggaggggcttcttcctttggaccgtttggtgaaggctggtggagaaggccgcagagtcctcccttctctcctccccaccctccttggctttccctggcatggccagagatatgagcaggagagtaggtgttggggctggcatgggctttgccagcctggggtgggaagaggaggagggaagcgaagtctttgccctcgagtgcctgaaagaaagctgaggagggcgtgtacctgggaccacggcttcttggttcacagcctggctttgccatttcccaggtgggccaccccaggcgagtcacttacctctctgtgcctcggattctgcatcagtaaggtgggacaatgataatacctgtgctatgaattgtcgtaaagattaaattagtcaatataaagaaagtgcttagaacagtgcctggcacatatggaagctctttatacttgttctcccacaccccatcctgacctcctcctcctctgcctgtggtccctgtgatgtaggaaggactcctctgccagaagaagacccttcggtttcctcggcacccagcttcagcctctctccttagaggggagaagaaggagcatgtgggagaagggagtagaaagaaaagtgaacaaggggagtgttcatgggcaggattccctggcctgcttgccagcccatctggctagactttttctagctcaggacaggaaatctgaactttataaacgagtccatttctaggggactgtgttttccttttcgtttttcaggttagtttttccattcgctttctgcttaagaagttctttctgaaatgttgcaaccttgccttgctgaactaaagggaaagaggatttgctctttcagagcccaggagaaccagggagaggaggccgaccttgaggttaggttccagcaggaaaggttaggagagactggctgagttggagggagagcaaagaaaggaggttgagggtgtccaggaactctgagagtgggtgaggtcaggcggaccaggatcttggtgagctgggttccggggccctggtcacccaagcagatgttttccaagggcagctaggagcaggaagaaagaaaggatggactcaggtcaagggcctagggaactccaaggtcaagagcaaaagagccaaaccctgcagccaaggcccaggggtgctgcagcagaaacaaggagcagagctaagggtcccaggtggataacaatgagggcctgggattggcagtgagcaggtgggcagtgccggtgccttgttctgatcggtcctggctgagggtcctaggtggtaagcctggtgtaaggcacctggaggaatactagaggtgccagttcaagggccagccagggcaggggtgggcacagagtccttccagcagagcttcccccatctcttttggcttgtgggattcatttatttatgatgcactgatcccatgtaggtgtgtgctaggagcaggggttgctgggcaagtcactctgcctctcacactcttgaatcttgagtcagagccgtttgaagtcccctgctgcatcttcccaccagtctgactcctccccattcttcaaggtgaatcacattcactaggctctctggcccctgcagcacttactctctggcatgcatctgcgccctgcacccccagctgcttgtagacccagtggcctgtgctctggatttctctacagcccccctgcatagtgcctggcccatcaaaaatgctcagtccatatttgctctgacactgggtccaaactacagttagcctaacaaaagggcctacttggcgctgaaccctcagctgtacctgcagccaagggcaccaccccatgtgttgctcagagggcaggaggaggtgaggcccctgccggttcccatggtgggttctccatttttccctagcgcagcacttttcaccctgccttcagatgatctgtccatttgctcactggaccaggagctacccgggagctcacagggactgtgttctgctcattcaaaattgtgtccctggtacctaacaccatgcctggcacacttctgtgctcaatcagtgtaagttaaatggataaataaatgaggctaggtgatggggagaggggaggctgcaaggccaggaggatgggcagtgtgagccttctatcccccagtgaaggtttcctgtgtgtgacaggcagtggagggccaaggtcctgggtgaggtctctggcccacagcagggctgtcctctttgactttcacaggctccctggccaggggctactgtgatgttcttaatgagctgcagcctccaggccagcctagtctctctgtgccctggggcctcaatgccatgaaatctgggagtgccctactgttggcccagctgctggcccagctgtgttttgctttaggaggccaaatcctgcttgcctggtggtgtcagacatttcctgtgaccttggccaggtttctcaagcagttgctggcctctctcctgatagcaacttggacaagccctgtgtgtccagatagaggtggtgacatgacacagggggcattctaggagttggggagggaaatgtctggggaggggaacactgcagggattggtgatggccagaggccctctttaggagagcaggcagagaccgagagacttgtgtcctggaggaagaccagagggagaggccaggagtgtcccaggcagcaggcagggtgccctacagagggccagatgtggactgatgctgtccagctgttgtctgggctgactggaggggcctggagactcccttgagcctcatgtcctggcttcttccccaaggctgggcagagtacctgcctcacctggagatcaaaagccaggcagctgggaagggcctggagagatgggagagggctggttacaggaacctgcaaccagcaggctttggaaagcagtggtttagaccagcacttctcaaactgaaaccagtaggtaagtcacctgggaacttgtcaacatgcaggttctgattcggcaggtctaggatgatcagctctaacgtggtcccacaggatgctgatgctactgggccacggaccatattttgagtagtgagggttagagcccgggctttggtgcattctaattctggatttagcactcaccagctgtgtgttaacaggcactcatcctaacctctctgagccaatagtgtccacctgataggatgacaggaaagattaaatgagaccatgtgagtagaacacttagtgtggtgcctgatatgaattagtgttcaatacatgatagctgtcaatgggcaggatctctttgctgtgaggacttgggtggatgggaggaggtggcaacaagcagagagaggaaactggagtgtgtgtgtgtgtgtgtgtgtgtgtgtgtgtatgtatgtgtgtgtgtgcatgtacacagaacaggtgtagacctgttctgggaagaaatcagagcccagactcagcctcagtggtcagcaggtccagtagtggctttggctggcttgggatacagttattccaccaggaccattgtcaccagccctagggaagaggaggttaaggggaggtgtcaagaatgggagggacctccactgggtttgctctagacctgaggacctagaggctgagccctggagacatcctacacaggcttgagaagaatcacttgaacccaggaggtggaggttgcagtgagctgagatggcaccattgcactccagctggggtgacaagagtgaaactccatctcaaaaaaaaaaaaaaaaacaacaaccctaggcaggctttgtcacaacatgggcaacaaggggcctgaaggcagtgctgagccctgagtggggtggctggggtgtgtctggggagctgtgaccctgtggtggtggcttccagcaggctgctcctgcctggtcgctccctctcctctggatctcttcctctctgcacaccccacctctttatccactgtattcgttttctatggctgccatgacacacgatcacaaaattagcaggttaaaacaacacacatttatttctgtacagttgtataggtcacacatctgaaacgggtctcaccaggctgaaatcaaggtgtcagcaggctcctggggctctaggggggctcggtttcctcgctcattcaggttatctgcagaattcagtcccttgcaattgtaagacggaggccccatttccttgctagctgtcacttgagggccatatcaggagctgccctcattccttggcttgaggccaccttcctccatcttcaaggccagcagcagcaggtggactccatgtttggatctcccctctgcctgcctctttggctgtctgtctccctgactcactcccttgcctccctcttctacttttaggggcctatgtcatgaccctgggcccaccaagataatccaggaccatctctctattttaaggtcaactgattagcaaccttaactccatcggtaaccctaatttccttttgctatttaatataacatattcaaaggtgtaaccccaggaacagagatcatgggggccaaccacacccactcactacagcacattccaactgggacccttgtccaaagtggaagagctccctcttatcaagggcttgccacaagggtggccctatgtgatctggccccaaagcctgtctgacatccccagtgtccaccctcaccactcacagcccgtgttcatcctgcttctgctctgccagctgactgtattttcctcaaatgtgctggagatgctcccacctcagggccttggcacttgctatccccctccctggagccctggaattattattattattattttttgagacagggtctcactctgtcacccaggctggagtgtagtgtcacagctcactgcagcctcgacctcctggtctcttgcaatcctcccatctcagcctcccaagtagctgagactacaggtgtgcaccaccatacccagctaatttctgtatttttttatagacgtggtttcaccatgttgcccaggctggtctccaactcctgggttcaagcgatcctcctgccttggcctaagtgctgggattacaggcgtgagccactgcacctggcccctgtgttagttttctaaggcttccataacacactgagtggcttaaaatagcagaaatttatgctcttatagctcaggagctggaagtccaaaaatcaaggtggcaggattggttccctctgagactctgagggagaaggttctgtgcctctctgctagcatatctgttggcaatccttggccttccttggcttgtagctgcatgaccttgaccccgcctcagtcatcacgtggccttcttccttgtgtgtgtctgtgtgtctctgtgttgtcttcttcttataagggttcagccattggatttagggtcctccctaatccagtgtgaagtcatctaaacctaacaacatctacaaagactctatttccaaacgaggtcacattcataggtccggggttaggactcacgtcttcatgaggacacaattcaacccgcatcaaaacactcttcccctcacactcccgtggcttcttctcccctttcctttgtagtggggccctctctgtccaccacatctaaaaccatgccctccacatcctccccacctcccacctggcatttttctctgcaacactaacgtcttaggtattttacctatttatttgaattcttcttcttcttaccccaagaaagcgtcagatgtgggaggacaggggtttttctctcttttcttggcagaaatctctccagcacctcgagcatgactcagcccattgtagcattgagtaaatacatgcccagagtatggttgagtcaattagctgtctacacccattttgctttacgtctacaatcggctgtctacatccattttgttttacatctcacaactccctacaacaggtggccagggttgccgttctgttggtgaggagaggctcagagaggggaggtagcctgtccttaccccttcccagcctggtatttccagcacctgtcctctgcctgcactaatctctctgagtttttgtccgtggggagacagggaagggccagggcaccagggcagctcttgttggaggtccaacctcaggtggtgagtgccaggactgctgggagcgtatggcagcatgtgcctgcatgtgggtggtcacctgggcagaggctccctacctcagagcagaaccctgccttgcctcagcctccacggctccacaggagccctgttggcactttttggcatgacctttaacctactgatgctgagagtgattggcatgacctttaacctactgcactgagagtgagcccacgggtttcccgtggcagtgctgcctgcctccacccaagaccttgactaactttcctgttgggagcacagggactctgctcccaagtcggtggtctctctaagtctgagggaacggagggaactatcaaaagattgctgccccagagccactgccggggagacccaggcatcccttcctaggggcaaaggtgcggggaaggcagcaccccctggttgacaaaatggcaaggggttttcccagtgacgaggcagaatcagaaactaggtgctggggccaggcgcagtggctcacacctgtaatcccagcactttgggaggcagaggtgggtggatcacccgaggtcaggagttcgagacgagcctggccaacatggcgaaaccccgtctctactaaaaatacaaacaattagccaggcatggtggcaggcgcctgtaatcccagctacttgggaggctgagacaggggaattgcttgaacccgggaggcagaggttgcagtgagccaagatcacgacattgcactccagcctgggcaacaagagcaaaactctgtctcgaaaacaaacaaacaaaaagcctaggtgccaggaacagagtggctgggaacagacacccagcctggggacctcagtgtggcagcttgtaaattgtgtccccttcccccagtgccagcagcaaaggggttggggtcagggaggacacaggacaaggctccctgcagggctgttgtggacaggtctgccgatgatatcgtgaacctagaggcgggttcaggcttggctggcaggaaggaggccgtgtggcactgttatgggggagtgcagactagtttctgactggggcagtgctgggtgccctgaggattagagtctggtggctggatgaggggacatgagtagggtgcctggtggcccagtgtgtgtgtcaggggagcccggggcaggggggttaaatttggtgttaggcagaatgtaaatcctgatgccctcacaaactttgcaagcccctttacctccctgaaactcaatttctttgaccttgatgtgggaaaatgaatgtccatcttctacgatggttgggagaatttactgaaataatgtagcacgattcgcggggtgtctgccacacagtcggtccaataaacctgaaatctcttggcctacctgcctactccatgtgcttatgacagatcagtgtggaacacctcatttgccaggatgagtttttctgcacctcactgtctgggcttatagctggggaaactgaggcaggatgcaggttggccactaggttgtgggcccacctgaaggcctgccctggccttctgagcctggctcctgctccagcccctcccaccgctgccaccctcccctctgggcttctgtgtgctgctgcgggccttctgcttgttcctttgggctacgtggccccctctttgtctttcttccttctcattcaagtcccttggacccaagattgttctctgattcagctgtgacgtgccagaagaccaacgtgtgctcggagaccttgggaaaatcttctgcccttcctgggcttgttcccgcatttgtaaatcagagggctagtgtggatctcctctaagctcaagagctaatggtcagctgggcgcgctggccatgcctgtaatcccagcactttgggaggctgagacaggcggatcactggaggtcaggagtgcaagaccagcctgatcaacatggaaaccccatttctactaaagatacaaaaattagctgggtatggtggtgggcatctgtaatcccagctacttgggaggctgagatgggagaatggcttgaatctgggaggtagaggttgcagtgaactgagattgcgccactgtactccagcctgggcaacagagtgagactctgtttcaagaaaaaaaaaaaaaaaaaaagagataatggtctaggattccggccagcctggccatcttccatccctaatggtgaaatgtgctcattctcccctttgcctgtttccaaggttgtgacaagaacatgtgagcctctcaccagggcagaccttcgctgtccctgacaccttggcaagcctgcagagggctaagcagcctgcatcttctgtgctgtgtcacccatttcctcatggccactgagttctctttctctgcggggttaactcaaacctacaaatctgtggtggcctccgagggttgagcccttctctctctttcttttctttttttagcctttttttctttctttttcctgacctgtttgtataactctgattcccaaaattgctccttgggtttttctggaattcccccaacacttaggaccttgaaaactattttgaatagactcggaatcagtaaacccaattttggcctcttagttactaactggccttgtgaccttgggcaagccacttaacatcactaagcattaatgtccctttctgtaaaatgagagggttaattctcccctcactgggatgttgtgagaattaactaagacgtgtgtgaaagattgctttgtgagttttaacatgccttgcaaatgcttgttattactttttagctgtcctgacactgggcttgggtatttgctcatgcctggtatatgtacagaagccacttttaggaagaagctccttaatgaggcccttgaggaaatagtttagaggaaatcttttaattttaagcttagggaaggacatcccctgttgtgtccatcttaacacaacaacaggggatgtccttccatcatatcatactctctgtgacaggtaccccaagagttgtacagtgtacagcgtatgcagctgtatgtggtgaccccagacctggcttcttccctagaaggagatgtctcccatttttccaatatttaatattttcaaacctcaacttgagagtcctttcctctggctcactttttatttccacagtactttctattttccactttctaacgtagcatataatttacttatttattacattggtatataatccatttttcccagttactatattcctcaagagcagggatctttgttttgttcactgacatatcccaagctcctagaatggtgcccaggatatagcaggccctcactaactaaatatccactgaatggacacccctgtcctaacgcatcttctgttgcttcctagagcagagagatggtctcagggccatttccttctgagctgatgctcgggccatcccctagcaagtcactgacatggaggggctctcccagccctcccaacaggtggtgcttcctcaccctgtgccccttggccctgggagtcggaagccaggcaaactgagggcaatgcctctcccctgagggcagggagagtgggcttgacagaccctcaggagtgctgagagtctggacagggggttgtggcagctgtaaaggaggctcctcctggtttcttccatctcttgggccttagaagagcccccatgactccccttccctggggctgtgggtttggaagagggagggctcagaggggttaggaagaaggggaatgctcactgtaggcctccagccagatccaatggaagagattttattttcccaagtctgagggtgcagaagccctgctcatgctttttgaggagagtgggaagagacctttgtctcagccaagaacttccttcaccacccacgccccatctccctgctgttgcagagggtaggttctagaaatgtggatgggccacactaaggcttgtggagggtcccttggcactcaacctctgccagccccagtgcatccctgtccagcagagactatttggagtggccagatgggtctgaggcactgtgttccagccaggcaggggagggacgcctgctgttctgcattggacctttcagctgttggacacaacaccaggggttgtccttcacattatagtctctgtgacaggtaacccaagagttgtgcagtgcacagcctgtgcagctgtatgtggtgatactagacctggcttctttctgggaaggagagagatgtctcctatttcccttacaaagtgtattgcttcaaggccgtcctttccagctgggtttggctgttgaggtcccttcgaggttcccctgaaagggggatggatctctgggcctttgtagtgttaacgtgcatctctccaacccacacaaatacctgagatccatggaggtcaggccctgagcaggccacggctggccttagggggtacaggtgtgggatgataaaaagactccagctctgggcagatgtagcccagggcacacggtctagctatgctttgatccggagcctagaagtcccaggagaggttgtgaggaaggtgggggccagtgtgccttccttcttctgcgtgataaagccggcaacctcttccttttctcatgctgggcacagagcagacatctctgggttggtgaggatgccgagctcaggcctctgagtgctcaggggaggaggccccgccttctccccacatggggcactgggcagattcaagggaaatggtgtctgctttctacacacttcctcctaccttcccccttctcccatttgagcctgaaggcggacatctggcccaagaagatctcaaactctctgatgacaacctagtgactcccttttttagtattctcccagagctgaggaatatatggaccgcatcctgggtttggtttcaggagaggactcctcccagccctgccccaggtccagccctaaacaaatctctgagatacgagctattcaccttctgtcctcccagagcctacagttcggtgatggggaaagctaccttttccagttcatcatcatcatcttcatcatcagtaggatttattgcaccctgctgtgtttcaggcattgtgctagattcctaccctattcttttcctccttgctgtccccactttagagtcaccagctcagtgacatgcaggacatggatgttgtacaaatgtcttttggtcaattgtgtcgtgtccaaatagtggagtataaatggcatagcacagggaccagcacccaggagcacaggggtgcagaggttccccagagctcatcatggccttagtggtgtgcttagaattatggttaccatggcggaagtttgggttaagattgactagcactaaggttgtggttagggtgacattctatttaacagtacggtagtggttagggtaagattagaggaataactttagcagtgcagcattagggtgaggttttaatcttaggattgtggtcagggttgggttagggttatgctaaagtaacatttaggactgtgggtgttttcgattgtatgtgtggttgttgttctaacccaccattgatggagccttattgaataagctgacagtttacaggcaccacctaatttaatactggggacagctcggcacagtggctaagagcatgggccacgagtcagacagatcccggttccacttgactcggttactccccagtcgtgctatcaagtgtgttctttcacctccccgagtctcaatgtgaaagactgatgataccaatactggctgcgcagagctgtggtcagaataacacaaaggaatgtggataaagtgccggctcacataggtaagtgctcagtactcgatagcaaatactttttcttgtctgggtcagttagagttccagcaggaaagggatggcacactcgatgtatttatttacaaaagcactggcagagtcaagagaaaacaatgaataatggtggagtatcccagggtagttacgtaggcaagctcttaccctccaggtctaaaggggcaagggaccagcagtcataagaacccagggtagctcaggctataggagagggccatggacagggctgcggcctctggtggaggaatgcagccactgctcacctgcagtacctgttgcgagggagctgggaggatctgcacctccactcacccttctcctgccctctgacctcctgccacagttccccactgatggaactggaccagaaggcagagggcaaaggaatctcccaggactcagagtgggatggagagggatccaggggcaagtggaagatcttcagcacatttgccagtccttgccatgaccctgtgaggagggtattcccatgactcccactttgcaatgaggacactgagggtaagggcgattccagcctagctctcctcgacttcagaacttgtgattatagtcattgtgcgaaccagcctccagggcatgtgagcgtaggcaagtgcggaaacatccagcttggcttggaaactgcagagtactgggttaggcaaggtatccagcgtcttttcagaaaactacagaagtcggtgagagcctggagcagcattcggcctcattaaaatgttaatgtatacagtttccagcaccggacttaaaataactagtgacaataaacatttcaagcttgtagctatgttcatagcatctagccaacttaaatcctgtaggatttttgtttgaaaggaagaggctgggagcaatgaagcaagaaaagagaggaaagactggcaaagctctttttcagatggcccagggaaggttcgccccatccggctgctttttacagaactggctgctcactcagtgagggtctccctctgcgggggtatgtgtgtgtatgcgtgtgtgtgtggcggggcgtgggtggaagctgtggagagaacatgtctcaaaagtcataatggagattttttcaggctccgtgaattctccttttgagctcaagtttttcaaatatgtatcaggtttcacctcttgtccaggacataaaggaggtttctgatttatgggtccggtagtttttccagttactccatctttaaatctgccatcagttaattaatttgccacggtcagaaaaggcactgtgagcttcccaggtgaaaataactttagcaaagtatgatcacagtttaaaaaaaaaaaaaagggaggcattctgaaacatacacttgtttccacttgtgaaattaactgaatcagtgtctcggcactcctcctcctccccctgtcatggcgcatgcacacacacacactctctctctctctctctcacacacacacacacagacacacacacacacacacacaccccacctctgcagaagggctaaaggggaagatttaaacctggcaggataatttcccagaaaaggattagaaggggaaaatggattaactgcaaagtcatctgatgactgtgttgtatgaggctgcttgggacccagaggggtgtattcgtctgtctgtgtctatctgtctgcagatgacaccgggaagattgctaaatgattcccaataatgaaatgtgaaaacacatagttgctttgctagccacatagctgtggttttgtgtctgtgattcatggtggaagtgagtagctgcgacaagcattctgtgggtttttttttttctccttatttctcctacaaaaatatttgtgaaaggtctaaaaggaagtggagtactttttgaaaagaaaaaaaatccctgttccttgcaaaacaaagattacagatgaaaacttctggagctaccacatttctgcttccagatgtcgcctacgctgcattttcctcctggagcctcagccctgcccacgatgtaacatgtccacccgcgagtgcccgcagcagaggccacttgagggagtctgcatctgcaggggtctggcggtatcctctcaagaccccagccaggccacgcccttccaggggagaaaaattaattccacatttctttcttttttgatgttcttgggacaaggtcagaggctccacaaaatgcagtagcgtgtgagggcagaattgtgaaataatttatgtcttaaataaacctgagtttgaatctcagctccaccacttagctatgcagcctacagtgagtgatttaaccttgtgagcttcagtgttctcatctgtaggctggggatgatcattgctaccttatggaattgtcagaaggattgactaatccacgtaagtgcatctggcacatttttggtcctctataaatgacacccagtcttttttggtggggaggaggatggagtctcgctctgttatccaggctggagtgcagtggcatgacctcggctcactgcaacctctgtctcccaggttcaagcaattctcctgcctcagcctcctaagtaactggggaattacaggtgcccaccaccatgctcagctaatttttgtatttttagtagagacggggtttcactatgttggccaggctggtatcgaactcctgacctcaagtgatccgcccacctcagccttccaaagggctgggattacaggcatgagccaccgtgcccactcttttttttttttttaatataaagaaaagtggtttatttggttcatggttctgtacatttgttcaaagtctcaccgtacccactcttacttgtcccctgcctcgggggttatctgagcctttcagaaatgcagcagcggtcatcagaaactttgagaatttgcccagagcacttgaaggtgtttccagacctgggaggtttctggtcacagccaagggtgagcagcagggtggggaagggaatctcatcccccagaggcagacagagctcagcctgaagaccctggcccagcacttccctgctggggatgaccccgggcaagttagcaggctccctgtgcttcagttttctcttctgtaaaatggggacactagttcctgtatcatagggttgctgtactaatcaagtaaataaaaaaataaaatgccttagcagaggcctggcacatcataggttgacagatttgggctgctagattgctgaatggaagctttccaggttggggccctagttcccatagaaatctccttttgtttatggccccggggtaaatttccagcccctgtgagagcggaaagggcaggctgggactttggccagttcctgaaagtgtatctttgacccaggtccctagctgccttagtctacagtgtgcttgtcggggcaggcccacgagtggggtaaacacatctggagtcaggcctgtgtttgctgttcaataagccagacctgctaagcttgtgcatgggcatgtgtgggggcgcatcatggagggtggaagggtcctgaaggccatgagctgggaactcaagggttcaggaggtgagcatctcatggccaagttagtggtggtgagatgtttgtataccaggtttgctgtggctttgggaaagagtcctagctcaatcccctcagcctaggtgtctctcctccccttcctccagcccctcctccaatctcctgtagcacttgccaggtccctaggccctgccttgcattttcattcccttttcatggctgcagctctccagccacttctggttttcatacacttccttgtagttaatgcagcatcaccatggcagcttgtggagggagtttggctgcagtgatgggaggggtgagatgagctttagagcctggcagtcctgagctttaggactgtgggttttgccgttcatgagatacgtgagcttgggccagctaccttcctccttcatgccgcaaatttctcataggtcatagtggggcagagacacctatgtcttaggttcttgttaggggacctttataaggtcatgtgtgtttggtgcctggtgctcagcctgtgtttagtaagtatagcaattatttcatcaagacaggttgtgtgggaaggactctgacgccccagcagatacccagaggaagagataccagtggacaaatctcattatagtctgatctctgcccctcagcacagctggcttctgtcattggacctgggaggagtaacccccttttggcatgagcagatgccctgttctaatagccaggggaaacccaggccttgatctgagctccagcagcacgtctgtacacaactttagtccttcagttcaacattcccagtgtctgcccacccaaagaacctgtgctaagagggggtctcctgcaattagaccccataacacattccaagtggtaagccaggaataaataaccttctcctgtgtgaatctcatacttcctattaatcattcttccattcattcaggccagttggaagaaaggatgctaaaaagagggatgttctctgagtcgggcaactgacaaggattttgttcagacttggccacccttctttccctccctccctccctccctccctccctgcttcccttcttccctccttccctccatctctatcttcattccaggcactagatgacttggacccatgcctcgcctctaagagctcacatccagcggtttgacatgctcaagcagctacagcacacccagcccttgggaagcttttgcaagtgctctaggagacaaggaggggagcatccctgggcagtgtgggtaataggggtaggtagggggcctccaaggggagttttccatgactatttttaaccttgttactttctggtgaaaacacttttttcaaggcttccttttcaagcatgaggttcataggatgaggcccagactgttggccttctgtactaggtcccgaagtatagttctcaagatggtgcaaagattcgtggtataggctctggaactagaatatctgcagaatgcctgtatttgattcctagtcattgactatgtgaccttaagtaagttacctagcttctttatgcctcatctggaaaagggataataataatacctacttcctaattttaatggtggttaactgaattaatatatgtaaagtgcttagcacagtgcctggcatatgattagcactatgtaactgttggctattattattctcatccttgactcctcctatttctctttaatcagacaggtctgattatccctgaacaccatgccagcacattcctgaatatgtccgtttatgcttgtggctctctctgcactccccaccccttcctccggctcatgtctcccaccctctggaaagcattccccagtgatccagccccacggccgcgctggaacatgctggctggacagcttacctggccataagactcctggcttctgcccctctcctccatctctgctcttggattgttatgaaatgctcgcatgcagggggctggcccggggctgctgtatatagtgtacctgctgtgtcctgcacaagggtgccaggcaggagatgaaccctggggccaaaatctagcctgtgttctgctcacccagcaccgggaccacgctacatcagcctgaaggaagtagggcaacttctgtaaactggctgcccagagaggcctcttgtgatttgtgcgaaggcaccaggtatgctcggcctctccctaccccctgccccccagtctgggtggcaagctcttggtgggaaagatgccctttgcataatgcctgatgggacggtgcacgttggcggtggttgaacgacgaattcatgaaatccaggttcaccgtgtgctgacaagtcttcccgagggaactcggagccaggggcctcagactgcctgcgggccctgggtggctgaggaatggggcccagctagggctggggagatggttccagtgaggcaggaggactgggagaagccatggagaagtctgaagttgagtgtgagaaatattttcagggcagcagctgtgtgcccagcgctgtgacgactccatggaagatatgaagagggtaaggcccagtcccttccctcctgggggtctgtgtcccccgccgagctgcaaccctttgggtggtccagctgggcccagaaggagacagggaagcacttagaggggctctttttcctggtgggaagaagagggctatcgccacagcagctggacacatgggcaagctagggagaaaatgaggggcatttcctggagccctgagaacctctcagggccacccccaccccgcctctgcccctgaggtggcccgggtgtgagcccagtgcccaggcagctcgctctggctctcttgcctggctctcttaccctgccaggagggaacaaaggccgcgcaggatctcgaggggccagggcttggcagcccggcagcctaaaggctggctgctcggtggaaaagtgttcacagtggaccaacacatgagggggctggagggtggaggggagagatgtggctcctaggagtctctggaccctttagaaactgaggcagcacctacttcagggctgcccttgaggggggaccgggctgcaggcaagggctgggtgcccctccctgacattaaccccgacacgcagagctcatgcctccctccgtctccctgcctgaaacaggaatgctgtgttcccttgagctgtctgggaagcagggcagggtgtggtctggacaggagagactgccccagggctctacctcctccccacccacagcctggcagggtcatcccctggggtctgtgtgctggggaatccagtcctttcagacctaggtgtggccataggaagagctagaggcccagagcctcagagcactggggatgtgactcatggcagccaggtggggtgagtggggtgcctggagctgactgatgagggcaaagaggttgggtgggtgcgccaagcagacacagcagcaggagtgatcttgagactccttggggacacgggggagagggctggctctcgaccctttaggataggcaccagggaatgttgatgatgccctatcagcgtgccaggcaacaagaaggtacagattccaatccaggctctgggcccgttgaacatgctgtccctactcgtctccctatcttaggtccccaggggtttggcagccaagggcctgcctggccagacaggaggagaaaggagcagagctctgcaagggccttcctctgccttgccagcacccagatcctcaggggagaccaagccatcagggaaacacagggcatgttaagctgaagtgagctgcccctgcagccgcaggaaggagcagcctctgcgctttggccggcagcagagagagttctgggaacgccttcctctcttggagctttctcctagatccttcctattcctctggctgctcccttccagatgccttcagagcctctccctctgtctgcctcttaagcgttggtgttccctaggccccctctgcccttctttgttctctttcctcttacatttctcaaactgtttaggtgtcagaacacctggaagtcataaggagtaccacgaaatatcaatatacttaatttcatgattagagctgggaacagttttattagcagaaactatgacgattgtctatgtatgcataaaaaaaattaaaaaaaaaaacccagctataggcacacgcacgtgtccgtgaaaagcgcaaactgtgggatgaagtatgataggctgttgccacatttttccgttaatattaatttacggcttgttcgtttgtttaatcgtgtgctagcagacaagtggtagcaggcgccagaggttggagaagaatttatgggagcaagacttagaactgagaccattctgttcattattacattttccccttttaaattggaaaacgttggcagagttaacgccccagtcaggcagtggcactctgaagcatggtttgttctgcctgctttcctcgaatgatatcatccttccctcttaactctacagctaccacctctactcttacaacctcctcccagccccaactgtgtctacagccccaaaactctctcccaagttctgcctcctgggtgtttccatctcaagataccaagcactcattatatccaaaactgagcccatcattcacttcttggatttctcatgttgagatcttggctcttggaactccctccacctattagtccaagtcatagctgggaattatctgtctctacatctgaaatagcccttgcatccatgccttcttcttggttctttcctcggccactgatagcctagaccacagccaaagccttccagctggcctccagctcgcctctctttagtccactctctaccaggtggtctttcactgcaataatcatcatttaagaatgcccatcccaacatgtcctaggcctgcttgaagaccacgagtgacttgaggctaacatgtggcttcccctctgccccctcacctttgctagggtactagtccctttgtccaccccgcattggagcttaggggacaaaagacttcaaccaaggttggagtttttgccatccctggggtcagtgcatggcctgtaacaggcactcagtacttgccctttgaatgagtgaaaaagtgtagctgttcttcggaccgggtcatttcctgcttcaaaatctcaggacactccccttcacccactcagtacagcccagacacctccctgaatatttcaagaccttcaccataagggcacagacctattctttaatccctcaaagcctcaatgtcctcatttgtaaaatggcgataaagaaacgattaatggtagatttaggatgaagttacctggtttggtaacctggcctcagcacttaggagttcagccaccttctgcaaggcatagaacccccatagcctctgttttcttgactataaaatggggataatgagtatctaagtcttaggatatggagagctctatgtgagaggatgcacgtaatgggcgttattggcacagaacatggcacaaagaaagtgtcattaaattatagcaccagttggctgggcctggtggctcacacctgtaatcccagcactttgggaggctgaggtgggcggatcaccaggtcaagagttcaagaccagcctggccaatatggtgaaacaaaaacaaaaaaaaattagcctggcatggtggcgagcacctgtagtcccagctactcaggaggctgaggcagaagaattgcttgaacctgggagacggaggttgcagtgagccgagactgcgtcactgcacttcagcctgggcaacagagtgagactctgtctcaaaatatatatataaaaatatataaaatataaatatatatatataaatatatatataaatatatataaatatatatatataaatatatatataaatatatatataaatatatataaatatatatataaatatatatataaatatatatatatatatataaatatatataaatatatataaatatatatataaatatatatataaatatatatataaatatatatatataaatatatatataaatatatatataaatatatatatagcaccagtttattccctacccacccacttcccacttcctgttctccaccctgccacatacgtaggtaaccactgttattaatattccagggtatccttccaaggttgctttatgaatatgcaaataactgcaacatatatccttattttctgtatgttacacaggagttcacatgccctacaccaggagccagcagacttccataaatggccagacagtaaatattttagattttctgtgacatatggtttctgcaactactcagcggtgccattggagagcaaaaccagtcacagatgaggagggcagctgtgttccagttaaactttatagatgcttaaatttgaatttcatatcatttgctcatgtcttgaggtattattctttttttgatttcttttccgccatttaaacatgtgaaaaccattgttaggtcatagtctgtacaaaaacagtcagtggtgggattgggctgttgtgctttcacttttcagtgtatcttggaaagcttaacttattgatgtaaaggagctgccgctgtgtttccagggcctattaccccattctgccagcagatccttgtttgtttaaccaatcccctactgaaggacacttaagttgttttcattctgtacaaactattttgctattacaaaatagtgcttctgtaaatagtcttgttcatgtatcattttggacatttacgagtgtcttaggtcgggtcccctagaggtgggattccagtgtgtgtgattttgcgggggaaatgcgaaaggaaagaagaaagcagtgtgggaaaggggagagagccaagtaaagatgtggtcccaggtaaatcaagctttgacctgattgaggatagagcttacaaagttgtttctccttaaggcctgggggcccaggcttttgaacttccctttcaggcagtcattggctgtgtggtcatggtggtgggaggagcttctcaggtggttcccatcagccaagagcatggcttggaagaaatcacaggtataagcctttagctgctacacttgcagatacacaagccagaaaggggaccagggcagggcagcaacacctaccacagaaggtttatctgcaggatagtcttggaggtggagcagcagggtcaaagcacagatgcattgggatgtggatagacgttgccaaattgctttccagaagggtcatgtcaatttacattcctgccagcagcatccgagagcgtctgtttctgcatagtctcacaaatgagtatgttattaaacctttgggtttttttctaatctgatggattaaaaaatgctacctcagcatagttttcatttgcacatcccttacaaggagaaaggttaagcatatttttctgggttcaagaaatatttgtatttttttttctgtgacctgttcatattccttgctgatttttcttttaaggctgttggtctctgacatttctgtttctaggaactctgatattatggagactcatcttttctctctgatacgagttgcacatatttttcccaccatgtcatttgtctttttactttaaggtgggtttggccaagcaggggtttttgatcatagaattgtttggacaagtaaatgatatattagctaaaacacttagcatgatacctgccacctgataggcattgaattggaatgatttcccttcccccctctcccctctaatctgtgctttacccaaatggtgcttattcttcttcaaacatggcctgtgcttcccacctccatgcacttcttatgttatttttcttttcttttcttttctttttttttttctgagacggagtctcactcttgtcacccaggctggagtgcagtggtgcaatctcggttcactgcaacctccacctcccaggttcaagtaattctcctgcctcagcctccaaagtagctgggattacaggtgcccaccaacacgcccagctaatttttgtatttttagtagagacagcgtttcagcatgttggccaggctggtctcaaactcctgacctcaggtgatccatccgcctcggcctcccaaagtgctgagattacaggcttgagccaccgtgcctggcccttatgttgtttttctaatctggaatgtctgcctcctcattttgggtctgttaaaatcctatctatccctgaagctccctggatccttctcctagatatggtctgtattctatctgaactcctgtacctctgctctccaacacagtccatcgtgggtcctagttatgtgtacacattcaccatgctttttctgagcctcagtttccttagctataaaatggagttgctgggaagaatagagatttattttgattacaaaacaaatacatgtttattccatgtgatgcatatttattgtaaaaatttcaaaaatattgaaatgataaagtttaaaataggaggtacacacacacagacactctcattcttaaagagtggccactatttacagatcttccggccttttcctatgcttatataaacatctgtaggggaagagagagagaaaagcttttcttaaaacacaaaactagaagcatactatccatatattctgcaactcagttttttcattcactaaaataacatagataagatgatgtatataaaatatctggcttcatgttcataatgataattacaactattctatgcatctttttttttctttgagagggagacttgctctgtcacccaggctggaatgcaatggcgtgatctcggctcactgcaacctctgcctcccgggttcaagtgattctcctgcctcagcctcctgagtagctgagactacaggtgcccaccaccacgcccggctaatttttgtatttttagtagagacaggtttcaccatgttggccaggctggtctcgaactcctgacctcaagtgatctgcctgcctcagcctcccaaagtgctaggattacaggcatattctatgcatctttagtaacactcttaaattttttttagcagcaagagcctttccaaacaaaatagtacagtcatccctcgatatccacagggaatttgttccaggacccctgtgaataccaaaattcatggatgttcaagtctctgatataaaatgacataatgtttgcatataagctacgcacatgctcccatatactttaaatcttctctagattacttataatacctaatacagtgcaaatgctaatagttgtcatactatataatttttatttgtattatttttcattgttgattgctatttttgggggttttccccccaaatattttccattcacagttggttgaatctgcagaggcagaacccatggatatgatgggccagctgtttttggaagcccgatttatgaagtaaatagaggagagcagccaggctagggtgagggtgaatggggtagagggcacagagctcctcgcccacttgtcttcccatcgctgttgggaaaccttagtgtgtcgggcagggtgtgggcacaccttgcacatttcagtaagtggcatcattatgggtacagactgcccaggcagctttcttgtgggcctgaagaccccggccactgggatgagaatttttcctcatcttggttgaaaagcccagagtccacagttgagaacagactgtggtggatctggtggctgtctcttggctctgtgctggcctgtgatggggatttcatgatccataaagaaatgaagaaaataaagtcatttggtgagatttccatgaagttaggcttattcaaacgtttcttttttggctctgaaatgtcttttctttcgtgaaattatggtggtagtgattggcagttttgtgtgtgtttgtcttaaagtcttagcaacctaaataaaaagcgactttatgttgttcccccaattttgttccaaaatcttacggattcatgaaatcctgaagtctagagatgactttttggtccattgtggaggcttggccaggacttccctggaacagtcccagaaagatagcaagttccattcttgtgctgggtgagtttgggaacctctgtcctttgatgaaattgcagcggttcttccaaggctgatagtagatggagcatctcctgggggctgtggtcaccttctcattgagacttgccttcttctgttaccagacctctactgtccttaatcggggggatactgcttctttggaccagcctggggcaaacatggcaccagacccttctcttgatgtcccacaacctgagactaggaaagaacatgcaaacaggatttggctaaaggcttgcgatttgcttaaaggaaatgagtgcaaagataacacaaggctagacagtggggtttgcaaactccacagctcacagtctccactccatcctagctgcctgtgcccttctatggggtgatggcagtggtaaccaattggagaccaccagggatccagagttgagccaagaacctgcagccctccacacagcgagagcctctctcgctgctcacctctgaggcctaggctgggacttataaagggagttatcaacctccttatatggatgctttaggaataagaggcaggacctataaaaaaacctgggagcttcttcctttactccacgacgagcctctcagaatgcagggcttttttatttctgtcatttaaccccaaatccccattagagtagtaggtgacaatgaattaggctcagaggactccggttgttaaaaatgtgttgacaccagattagacacttggccctgtgtatatataaggacacttggacagcaataacacttttttctggagtctttttatttcccttaaagaagaactttaagtggcccagtcatgttttcttatttgcttggggagatgtatttagtccaaactgtagctaactccttttttcctccttgtttctgcaatttaaaaattctggcgtatttttctactttgaccatttacttgtatttgtgaaataattgcatggtctcactgttctcgtcatcctcacaccagccctatgaggtgggcattgctattcttgtttcagtgatgaggattctgaggctcaggggagctaagtgacttgctcaaggctgtgctgctagtaagaggcagaaccaacatctgtctggcccagtcccaacccctcccctctgtacagccaggtcctgtctatgactagggaatacatggtttgtttatttggttttcctctctgcaaaactacccaactggcccttaagggatttgaaccctgggatcttggtgccatgagctctgagcaccaattagagaaaaaactgacagcagcaataacataacaatgacaacaaaccaccaagaaagaacactttgagtttccatcctgaccagactggagagctctttgtcagggtcaagttcagaaaagtggcagtggtctgggcagaacatgagctactcttttcacctctctgggatgctctgtggcgctgccactaacctgagcatggcaccagcctggtacccaggacgaggctcccagtgagccagcagttcagccacctctctctcccaggcgctttcttggaagtcctcggagggagtttgctttcttttttgttttgtttttttgagattgagtctcactctgttgcccaggctggagtgcagtggggtgatcttggctcactgcaacctccacctcctgggttcaagcgattctcgtgcctcagcctccccagtagctgggactacaggcatgtgccaccaagcccggctaatttttgtgttttttgatggggtgtctctctgttggtcaggctggtctcgaactcctgaccttaggtgatcctcctgtctcagcctcccaaagtgctgggattataggcatgaacaactgtgccaggccagtcctagtttgccttctgccaggaaagcataaggagtttgctcatggcctggtcaccaagggctaacagaactggggtggagatttggggagggagagaatcccagggccttatcccacttgggcaaggaaaccagtggggagggttggcatgggacctactgggggaagggatgcccccgaggcctgagcagaggcttccaggctgagctcccactggggtctgggctggttgtcggctggcgcaggacacaggttgtggatcaggccctgggttggcatcctggtgtccccatttagctcttgtataaccttgggcaaggactgagcctctctcagctttgatgtctgcaatacgcttacacccaccacagtccagacactgtcgtatacacagtggttcatagacattgtgacaatgacagagtatttacaacagaggctgccttttagaacagcctgcccaataataaacatcaagagaatgtgtccaaatgtatgagacaattcaagcagttaagatgtcaaaggacatgagcggaggattttcacaagtggtaaataaatacctgaaatattttaacctcaaaaataattttttaaaggagagaagggaggtgaaaagaacattgaagtaccactttgtgcttattcaaagctagcaaagtattaaaaattaataatatgctgtgctggcaagattgtgctctaagtggttcatttatatatttggatgcaaccctttcagaaagcaatacaccagtgtgtgcctccagacataaatgtttgtaacctttgatacagtcattctagccccaggaattcatcctaaagtttttgttttgttttgcttttttgagatggagtctccctctgttgcccaggctggagtgcagtggcatgatctcagctcactgcatcctccacttcctaggttcaagtgattctcagcctcagcctctcaagtacctgggaccacaggcatgcaccaccacacccagctaatttttgtatttttagtagagatggggtttcaccatgttgaccagggtgatctcgaactcctggcctcaagtgatctgcccgcatggacctcccaaagtgctgggattacaggcgtgagccaccacgcccagcctcatcctaaagttttaatcctttcaagatgtttcctataacattttttcaaatatacaaaataaaatagaatagtacaacaaatctccctgtactaaaggaatattttaacagaagacaaagtcatataggtaaggatgtacacatttaaaacttaaaaacagtccaggtgcagtggctcacgcctgtaatcccaacactttgggaggccaaggtgggcggatcacctgaggccaggagttcaagacgagcctggccaacatggcaaaatcttgtctctactaaaaatacaaaaaattaaccaggagtggtggcgggctcctgtaatcctagctactggggaggctgaggcaggagaattgcttgaacccaggaggcagaggccgcagtgagctgagatcgcgccattgcactccagcttgggcaacgagagcaaaactcggtctcaaaaacaaaaacaagcaaaaaactttttaaaaaatctaaatatgtaacaggtaaatgtctaaataagttgtgattcatctttagctggactatcatatagcgatgaacatgacaaatatgacaaattgaattgtgtaaagtgtgatctaatgttaagtgaaaaacggaatttaaaattgtatctctaggtgatgacaatagtgtaaaatcatatacgtgagcaaaggttgaaagaaaatatgcaaaagtagttgctgtgttaggatgggagatgatgaattcatgtttttctccttgaatattgttgttacattattcttacaataaaaatcaatgagagggagactctaggctctgccctgaatcaatcttgaaggtgtgtttgttgggcacctcttctacaggtaattcatattaagggatatattaagaagtggtagggagtaggtacaggacttggttttagggcaggggctggtccatagtgggttctcaaagacttctggaatgtcagagctacgtgaggaccgtctaacacccccattttgcagttaagggtcctggggcccagaggagctaagtgatttgcccggaataacccaccaaaagcctggtgattccacataggggttggtatttctacaaaactagccggcaggccttagatcagtccttctgcctcagggcaccttcatgtctgggagtcagccatacatgggtgagaaggcagccagagagcatttttcttgtgcaaaggcagagagtgggtggctggatgaggagtggcacagacacactgttcccagggtgcaaacccccgtgccgcggttgtctccacaggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctggggtaaggataccctgtcttgggtcctagaagagcagggcctctagaactctcttctcccaccttggcttccccctctgctctcacagaggggctgagttgtcaccttgtccctcattctttcagccaatcaacaaacgcttgttgagcacctgctttgtgccggggtccaggggtcctaaaccggtggacctggacttcaccccgttgcaacctttagacctagactgctctatttctgcccaatctatcatcccctcctgcctttgcttccctcatatcccgctgtgaacctcaactccctggtcccactcgttccacctcatccctcctacaaaccccaactctcctggatcaacccaaccagttgttacctcagcacctacagctgcgcctctgcttcccacagaatctctgtggattcacgccatggcacactctttgttattgcctgacaacccctccctgtgtgcctggacattttctccctccatttctcagagcagctactccaggcctcccctcccctcccctcctttcccgaggccccatccatcagcccacagacatgcccccacctcccagagagctcctcaacttcctgcctatcacacccaccactaccctgtttacatctgtgcctgagctcacctccttccttttttttccattttaaaaattgaagtggaattcacataacataaaattaaccattttaaaggctacactgcagtggcttttagtgtatttataattgtgtgcaaccgtcaccactatttcattccacaacatttttatcactccaaatagaatccttgtacccactaagcagcagtcactccttatctcccctcctatccctggcaaccactcacctatttcccgtctctatagatttgcatatccttgacattttacatgaatggagtcgtacaatgtaccatcttttgtgtctggcttctttcacttagcgttacattttcttttcttctctttttcttttttaagagacagagtcttgctctgttgcccaggctggagtgtggtggcatgataacaactcactataatctcaaactcctgagctcaagtgatcctctcacctcagactccagagtagctgggactacaggcatgcaccaccatgcccagctaatttttaaatgttttgtagagatagggtcttgcatgttgcccaggctggtctcaaactcctggcctcaagtgatcctcctgcctcagcctcccaaagtactgggactgcaggcgtgagttcctgtgcctggcttagcataacgtttctgaggtttatccatgttgctgtgtgtatcagtgcttcattccttttcatggttgacgattcctttcacgccatcttgagggggaggtgtccctcttatctaaggcacgttctggcaccctttgtcatttcctctggaacgctggcatcacttgtcccccctcttctgtatcttcaccctctcccaccctctcagccctttcccctcaacgtgtacaattgcttacagctctctcattcacacacacacacacacacacacacacacacacacacacacacgtttctccgctttcttcctatctcctcccttcacagtcaagcttctcaaactcatggtcaaaacatattttttcaatttcctcccctcccatttctccctcaaccttctgcctctggcttctgtccccaggctccccgtactgaattaatagcccaatttcattgccaccactcttgggaaatgaagcggcctcagcttgcactgctgccatgacctcccaggtggtcaccctgcctccggaccccccagcacatcaaagccagcatgatgtcttgcttaaaagtcttctgcagcttccccatcacccaccaaataaagtgcctgatccttgttctggtaatcaggtcccccacaaaacctgactctaatcctttcaggctttatcttctcttctcttagaaaactctcctctctggcaagctggggctgcattctgttccctgcccttgggttcaaagcccagctgcatcacttgctagctgcgtcacttgagcacccaaacttctctgggcctcatttttcttagctgtaaaatggacacagtaggttggatatatgaaaaataccaacactcagccataggaacctacaaaaatggcaatttctaatgattcaacctaacataccacccactcaagagggttgatgtgcatgaagtgtgagcttggtggctggcacatctgcgagcttctcaaaggtatcaccttgcccctacgatgggaccctgcgtccagtaggtactcagcaaatgcccttgagatgaatgcagccctagtcccatggggctttctaaccagactctggaggtcacagctgtgcctctcagccctgccccctggacccaagccctctctctgcagggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctgtgagtccctttcctgctcagatggttcccagctggccctggagggtagatggccagagagccaggcctgccttggactggagcccgctgctcccaaactgtggctccacaagttgtcccaaatcacatggggagctgagtcctcacttggcagcctagctgtgtgactctaggagtcacataacctctctgagtccaagtttcctcaacagagaagagacagagttcatgataatgccacctccccatctcccaggttattgtggggtgcagggaaacgcctaaatagacttttcaggaaggcaggggctggttattatccactcttcttcactctacatgaatgaagtggaaagtccctacatttcagggggctccgggctacaggagccatctagggtcagggttctgccgcctgtttctctgtggtggtcaccagccacagagcgggtgctgctgttcttccaccgctggttaccttgagggttgatgttgcagatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctgggtgagtgccggcacagctgggccggcgggaccctgggaggagtgccagttgggtggaggctgtcaccatggctgtgacagggatagggaagctgcctgtagtccttcctttatgatcaaacctccctctttctcctggccctcagcgctaagtttcattccctcaacttctcagccccctcccatcggaatttatcgacttgtttttgccctttccctgtgctgggaaccctggggaagacaaaacagtgtaagggcagggtgccgccctcaaggaatccatgggcctgggtaatagagggagaatggatgggaaatagaatatcagcataaaacatttcattttccctgccttccattattaggtgccaaaaaaatacagaatgctttaggggatcaggggatggagaggctcctaagcccagagtgctctgggacagctgcgtggaggggatggactgcagttaggcctgaaacaatgggtagcatctggttaagcagagggactggcacgagcaaaggcacggaggtggggccatgcaggagacagggggctggagttccagggttggccagggtcatgggggaggtagaatcaggaaggtagcttggaatgtgataatgaggctccttcagtgacagagtttgcacttcatcccgtccccacaagggatcattctggggttctaacttgggagcaaagaaatggaaggagagttttggggtgacacatagccagtggcctgcctggcccaggggtggtggatacccttcagagggttggaaatgagggtggggccctgcttccctggctctgactctagcccctgtgcccagcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacaggtgagaacacagctctggcctcagccctggatgcttccaggatggcagttgtccccagtctgcccttctcctcctctctgtcctctttgttcttatggaatgtgagtgtctgcagagtctcccatttcccagatgggaaaacccaaggcatgaaattgtccatgtatggagagtctgggcctccttcctgggctctacttggtgcttgtcaataccaggcacacagaagaggacccaaggaagttcccctctggaggagctgtcaccagcatcctcaggtgaaggcagcctagagatgctgatcctatgacccctggcacatggaccagtggggctgttaggatctggccaggagttttttatccagttgaggctacagttggggtcgcagaggtgtggaattaacaaatggaggttaaccccaaagccctggtggtacaaagatgagagatactcctattgccctctggaaccatcctcagctcataatgggaaatcagggaagattttctgaggccaggcacccaagaataggggttagaccagacccagtatggtttttcttggggttgccaggaaaccgcttagtttccagaaactaaggtatttccagaaaccctatctgagattagggaactggaggaggtgggacagccaaggggtaaacaccctgaattcccagatcatccctggcctctcaccttggggtgtccctgagcctggggctctgctcacaaggcccactctgtgggtgaccctgcagttccctggaggtaggcagaggaagctcttcctttaggaccctttgtctgtggttggggccatggagggtggtggtttgcagccctgcacagggcagatcttgtgtctggggtgtcccatccacacacaaggtttagggctgggagagtgcatggcaggtttctctgcttccttctgggatatgggctgactcccttctccccttctttggctggggacatcctctggcagaatgtggggagtgagctctgtgtcctaggctttcccgggacatctctgtgcacagcctgggagggaaggggggtggtcacaggtgtccatggcctctccttccagtgtgccaaccctctgctggagctgactacccaggaggactgctgtggcagtgtgggagccttctggggggtgactttgtgtgccccatgcccacccagaccaggtgagtgctggagtccaaggtcacgtgttgtggaggaagctctccctgggcctgccctctcctgccagggtttcccctccagggtgtcagaggccaggcaggtagaacaggctggtaaactgcagacttcccagacctgccttgaaggtgtttctggccagcactgaggctcctggcagccctctgctggtgcagtctgtcctgcctgctccatctgattgcctgcaagggcctgctctctcttgcagagattcttgatcagattttagggatttcactcagtgttcccctgcacacccctcccagatgccaggggtccagagatcttgattcagtgattcagtgttttctttattctctccctgatggggcccccaggcctcctctttatctccttacctcctgttccagcctccctgactttgaattagggttgaatgtctgtcctagatgtcctcatccttggggtatgggagccctagttccttgccctcttttggacgatgggaaaaacctaacatgtgttaattcattcattcattcattcagcaaatactcactgggtgccttgtatgtgccaaggactgcaatttcaggagtgagcaagatgcctgttcacgatgctctccccagtcttagttgcacaattgggaggagggtgaccagacgcctgtgcgtgagtgtggcttctgcccatttgtctgtcttctccctccaggcctcctttctgggcctgggcctgagcctggtgtgtatttcctttgcctgtcagcagtcagcttggtcaatcagctttgtcaggaggctggacaggagcccaaagatgggaggggcagggctgttccttgcatcagactcagctgtggagcagtgactatattttccaaactaaaaataagtgtagacagttttacagtgtgatagaatttttggcgaagtagcaaagggtagtgttcagctcccaggcttaaatgtctaacacatactacgtaccagtcccagctcttcctgatcacctctctctgcgtcagtctcttgatctgtaaaatggagatagtaatagtgccagcctcgtagactgctgtagagattaaatgaaatgatgcacatgcttagtattaggtcaataaaccatggctattacaatcattatcattattgtaattagaaagtatccctcaagaaagcgagaaaggaatggacccactgcacaggagatgtgcatcaaactgcccaggtctcccctgtaggccagagatgtttttgccacttttcttctttccttgttttcttttctctttcctatcaggcgttgaacccttgaaacttctatatcccacattctaatcagtcgacaaatatttacattgactaagcccccatttgaagaggccatagcatgcaggccctggacagagagtagagaaggtggtaaaaaccgcaccttcctctccaagcttacgatttagtgggtagtcatagatggctggtaggcatcaggaatgaagaggtttgagcagtgtctggtcaagtgctgagtgctgtgcaaacacaggcagtggagcccaggcccctcataggtccagtagcacctttgtgcaaattagaaaaacctgcccttccatttgttcaagatcatcttcataaatatgccaatctaggatgccaatgattcccttagagatggtgcttttgtgcagtgcacaacttgcacatctgtacactgtgggatgggggccctacaggctaaaccctgtggatcagggaaagcttctcagaggaggtgacttccaggatgagatttgaagaataattaggggtaggacagttaagtaatggggaagagtttaacaacccaaggaaattgcatgtgcaggtaagaccaagagaatgagcaacattttctggagcacagtatgtctcttgctgagccctgctcagccctggctctcctgtagaaaggcaggcatgtcagaagggttaggtggggccagggctcccaagtccctgctctgggcaggttctggttcccaagagctggctcattcagacaagtgggtgggggtctctctccctttaccccatcaaccctctgaggggcatgcagtacctgctgcgctgaccaaggtgctgacctgccctgggacctcctgacccagttagggctgtcctaggagggagctggcttttctaggtggtaggaacaatgagatttcatccaagtggcaattcaggggcagccttagaagtttcccctccttgtctcagggctcagaagctgtcacgctgttgcctctggaatctgagaaataatgaaggggaagagtgggctcagctgccaacagcgtgagtgtaaaggagtggagtggtgcagctgagaaacaggcttccagaagggccttctcagaatcccgcttcactgctgggattctcctcccagctgaggtctatgcccctctcggaaccttcctctgggcaagtcttcaggccttaaggtgtccttgatttgggtaccaagcataatcctgaactcttgagatgcagccctctgggtggggtgtcagcgatcagggccccacagggtccttgggtcagtatctcctctgtaattcactaagccaatctgacagtgatgttagtggccacagacctatcaggtgacattagtgaaaatgaaaatagagccactctggattcttcacttatatgtcacatctgccacttataggattggaggggacagtgggagcacagggcctgcctgtcccaagctctggagcccatcaggggtgcagagatgcaggctgtgaggtccatgccagggctggctgctgccaatggaggattctaggcctgttgccctcagccagggctgacaggcaccatgaccacatccccagatcttggaagcacttctgagagtgggggagccctccactggaagggtggggagcaggagaaaaaggacagagtctgtactgaagcagctacctgctcgcccacttgctgcactcctggttccacctgtgtgccagccttgagagctcagcccacctgatgcccaaggaacctgctccaaatacagctggtgagctcggttcagacagggctagagcccagtggcggtgggcacgggagcagagctctgtggatcaggtgcgtgcagaacacgaattgtacccctcccccaacacacccaacgctcagcccttgccctcgctccgccccatcccagatggtggcctcccctactgtgttcagaacatctcagcgcgctgggcaccagggtacagaccctggaatgtcaagcatcccagcacactgagcaagaaataacaaagaccagggcaacataaacatcaaaaacacatgaaagtgcagttgggcattgtatagagaaggggcaagacgttggggagccttgtttgtgttgacagagtgccaggcacctcgcttcatgcctgaacctggggctggggtgggcacatttctttaagtggggatgacaaggaagcttctatacaagaagcagaggaagaaaagacaagctgccagggcaggtttggggaaggttggcaagacagacaggacttctggatcctagatcatccctggcactagtggctttgcctctctgagcccctatttctcctctgataaaataggcttatgcttctgggggaagcctttgtcatccccagtaaagtgttctagcaaatcaggcagtggtgggagtgatagggtgagcagcctgggagtggcttcatggcttcccttcagtcacattctggctttgaggctctgtgctggactgttgaagaaggtcgcaacagaatgccactattcctgacatggaaaaggactgccttgaagtcttaattgcatggcataggtaaatcccttttgttccagaatgccacagaacttgcatggagagctggcccgggagtcagtctagaccagcccacagttcccctctgctcccttcactctgagtggtagaggtaatgtgtacccagctgaactcccaggacttagcctgagccaggtcttcctgaccccttgggatttatcaaagggtcccagctcatagccctcttcaatcctcctgccagagtctggagaacacacggttctcaaaagccactttgattgaggccacatttttgagttttcatctgagaaagacagacatctgggctgactggaaagttggccactgccccatctggcttggcactggctgtgtcaacccccaggcccctttgctgggacaggcggggctggcacatggctcagggcctacagtggtgggctccagctgtttgccatgagatcgtcttgccatttgcctggggtgggttgagttcacctctgaacccagggccctctgtatctccagggagaacagattctcttgctctgccctttcaaggaactctgcacctttctctcttaaaccaagaatagccgccagttcctgaactttcacattacactgggcccttcacatgttttgtctcactgaatttgtacagccacctgcaagcccaggatttttaaccctatttgatggatgaggaaaatggagctccaagaaggctgaggagcttgtccaaggtcatacatctagggcaggtagagccaggattccaaccacagtatgtctgactctcagctgagcaagatctccctaatcattctggggagacctgagcctccctgaaggaaacaaagatcaggatgctagactggaattctgcagccaagaggatgcgcgtcaagattgggttttgtgagttacttgtgctatatccgtcaagaagatttgggttagatagaggggcaggttagcaacatgtagccccggcctgcgttaagagaaataattgccctagggagaagggtgtaggctttcccccacgtggttctcaagagaaatatccaatgtgtggtgtttctggtaaccagagctcgacttgaaactgatcacaagggacaacttattaaaaactgcaggtgcccagcaataaaatgggttgtgcctaaaagtagtgggctccagatcacagggagaatgactaccaagaacagatttttcataggagtcgacaaagaaaattgatttttgaggaaatgggggtttttagagatgtttgaaaatgtatttgaaccttccaacagaaagaaggctttgctttggtcctgacccttgcccatgacgagagttataggtgtagctctgtgatgccagcccctggggaggatgggtatgggagggtgctgggggcatgaggggcagagagccttagggcaggtcacagcagcaacaccattattatcacccttatcatcattcacaaccatttattcagagtacttataagtgccaggcacggtgctaagtgctttttcattttcttgcatcctaacaatatttctagatgttgggtgctattatccccattttacagaagagaaaattgggcctgaaactcccggcctatctgactccagttgcctgcttccagccactctgcaagtggcctctctctgctgcttcttgcacccggcacaagcatttgctgaactggaggaccccggcttggggaacagctgtgctggggtggggctcctgttctctgggattctggatgagatgcccagtcccctactctaaagaaatgggattttcagaattccagttgtcagctgaaaaggcagtgtctctttggctcagagatgttctgagagcttcttccaagggacttgaagcctgctgggaatgaattgtgcctcaggcttaagtgagcaccctcccaacccagcaggggtgggtgtcactgacatgtggcacctctagcccggagagcggaggaagggctggggcaggggtggctaggtggcacctgcctgagccaggggtctgaccagactctttttcgacctcactgtttgtggtgactttggttctatcttgctctgaggaggcagtcagaggccatctttgggcagaatgtccataatcactggggggccccactggtccttcaccaaggagggaaatctgaataatggacattatgagaattcctaaaatgggacaagtgttgtgctcagagttgtacatgcttatttcatgttcatcataaccccatgaagagggacttatcatctccagtttactgataagaagacccagcctcaaagaggttgtgtaacctgcccaaattcacccagctagtgagggacagtgggccagcatgccagccttgagactgtggggaaggaagggaggaaggaagggagggagggaggaaaaagggagggaaggcaggcaggcaggcaggctctatagggtttgtgccatgcatctgcgaggttcagtctgacatttattgtttcagcaaagctaatcctcacaatgactccacaagctgagtcttcgtcctcactgtttttttttttttttttttttgagacggagtctcgctctgtcacccaggctggagtgcagtggcgcaatctcggctcactgcaagctctgcctcctgggttcatgccattctcctgcctcagcctcccaagtagctgggactacaggtgcccgccatcacacccagctaattttttgtatttttaggagagacggagtttcaccgtgttagctgggatggtctcaatctcccgacctcgtgatctgcctgccttggcctcccaaagtgctgggattacagatgtgaaccaccgtgcccagcccagtccccacttctacagatgaaaaaattcagccaggagcggtggctcacgcctgtaatcccaacactttgggagaccaagatgggcagatcacgaggtcaggagtttgagaacatcctggccaacatggtgaaaccccgtctctctactaaaaatacaaaaattagctgggtgtggcagcgcgtggctgtaatcctgtttactcaggaggctgaggcaggagaattgcttgaacccaggaggcagagattgcagtgagctgagatcgcgccactgcactccagcctggtgacagagctagactccatctcaaaaaaaaaaaaaaaattcaggctgagaggttaagaaatgtgccccaggtcacacaggtagtcagagtggagcctgggattagatgtgggtctggctgccccagcacctgcactcctactgggggagtagaattttctctccagcttgcccttctgaggtttgcaaatcaaaggggcaaggcaccagcctgctcacgcgtccctgtgtcactgagcttggcctcgccaggcatgtatgtgtctgtccctgggcagaggggctgtgtggtagggacctttcacatctccctgctgcaggcacctgtcatcacaggctgagattggcacagcttgtaaacagccctgtggccagacactcttcactttctcctccacagctctactcatggagtcagcgccaaaactgtctcgagaaattagtttgcctttactgaggcctccttgggagtcccagcagccgagggggagagttagcagggcaggggcaggctgcagccaggggcccatctgcttctttcttcagtttgtgagcaaccgaggcacggcagagggtggacagggccaaggccagggaatcagaagaccatatgtcccgatgtctttaccaggaaggttccccacatccgccctgcatgcttcatgagcatttgtgatgtgaactccttggagttcaggtcggtccccactgatcctgggcagctgctttggctttcccaagtctaagagtctgaaaggcaaggacactgcagccctgcaaggcctccttgaagcatccgtgggagtcacagcttagccactctctctccccaggtctcacagattctcttctttctactctctgaccccttaccccttgtgataaccttgatctggctgaggagccacaaggggtaggatgagttctacaccatttcctttgtcagttctgcccggcactttggttatgcacatcgtggagcacttaccaggcatctgatcagttcttctgacctccttctgagtatccctacttttttttttttcttattccctctcctgacccctcatttaaaaacagggtagaggtttcctaggaagggtgctaggttttctactgggcaggtacctccattggtccctagggttttctgcctagacacccctaaggcttttcacaaatttatttatttggaggcagtggggagaatggttcagaatttctcctctggagctagactgcctgagttcataatcccagctctgtccaccagcggggtgaccttgggtttgtttcataacctcatccattttatggatgaacctcaatttgctcatccataaaatgggaataatattagtaagactctccaagggctcttatgagcattaactaagttaattcgtgtaaagcctttataatagggcctggcccatagtaagtgccatttgagtgtttggtcttcttatttgttcctattttgactgagtgcccacacagctctaggtgtcatgcttggcaccagagacataacagtgatgaagaagaataagacaaggtccttgtcctcacgtagcttatgctttgtggagagatggaaaagtaaacaggcagccacgacacaccatgaactgagtttttcagctcaaaagctagtgctgtgacttgggcagggctgtatgtattgggagcatgcaagagggacacctggtgtgggtggcagggacggtgacaggtgtcacctgccttcacctgtcacaaagctcactggctgctgaattttcaccctgagccatatggccatctaaacttccactttctcccaaggagatttaacctgaatttaacctacatatataaaaaaatatatatatatatataacctatatatattttaaatatatatatttttaatatataatatatatatattatatataaatatatataatatatatataatatatataaatatatataatatatatataatatataaatatatatattatatacaaatatatatataatatatatatatattttttaagatggagtctcgctctgttgcccaggctggagtgcagtggctcaatctcggcccactgcaagctccgcctcctgggttcacgccattctcctgcctcagcctcccaagtagctggaactacaggcacccgccaccacatcccgctaattttttgtatttttagtagagatggggtttcatcatgttagccaggatggtctcgatctcctgacctcatgatccgcccgcctcggcctcccaaagtgctaggattacaggcgtgagccactgcgccttatttatttatttttaagacatggtctcactctgttgcccagcatggagtacagaggcatgatctcgactcactgccacctctacctcctaggctcaaagaattctcccacctcagcctcctgagtagcgaggaccacaggctcatgccaccacgcccgctgactttttgtatttttggtagagacagggttttgccatgttgcccaggctggtctcgagttccagagctcaggtgattcactcgcctcagcctccaaaagtgctgggattacaggcatgagccaccatgcccggccttaacctgattttttggattcaatgctgtacttggtcttacagaagctaggaactagccccttatagactgtctctgagaggtgtgaggaggggtgctgagggccctggttttggggtggaggttgttggtaaaaatgggagtttccccagagacagtggcttggcatttatttccctctagaagcctgccttcatgaagaattgcccacgcaacacactcccttcaggccagcaggggggcaggttccccttattaaggaggagaccattttatataaaaagcacatacatgtatccagactaatgggtggacccagctcctctgagattcactcattcctcgggttctcacagttttctgcaggtgccagcagctggttccactcttgcttcctgctctcatccaagctctctgctgctccccttctgatcactaaagaagcaggggcctctgcttcctccctctccctctccctctcagtctccgtctccgtctccctctgttgcccaggctggagtgtaatagcacagtcacagctcactgcagccctgacctcccaggctcaagtgatcctcctacctcagcccccagagtagctgggaccacaggcatgaaccaccatgcccagttaatcttattttttttgtagagacggggttttgccatgttgcccgggctggtctcaaactcctggactcaagggacactcctgcctcggcctcccaaagtgttgggattacaggtgtgagctaccatgcccaacatcatttctccctcttgacatctagagagttgatacctttccggcctgctggctcacccagctcttcctgatctctctctctctcttagagaagcacagtggaaggtaggagaaaggatgtggccttcacagctagaggcccgatttcaaccctgcctctgctccagcaactttgttacctgggtcagttacttacccctcactgagccttgctttcctaatctgtaaaatggggatgacggtccctgccttagggcataattgttgtgagaaacagacatgaccatgtgtacccatggccttgcaattctgaagcactggacaaatgtgcacttggtctctttcctcagccctctggcagcagccttgcatcattctttcccaccttctgctcctcataatgttcacaggctgcatctaatcagcctgccttctgagtttctccaaaggacttctctttcttccctcctctctgtcctcagtttataccaccaggccccacgccagggacgtgcacatctcccagcctcactctcatctttccatctcattctcagcgttttcagaatccccgtgtgtctccacaagagtggccttctaggctggaccctggtccctacatggaacgtgcaaatccggagcgggccagtcctggcaggaaaacatttttgaacttcagtttacattttttaatcttaaaaaagttaagcgttactaatttatgtcctcacttggtctgtccctatgtcaggctgtcacatgtcatgcttggcacacagtgtgtcctcagggaagagtggggcttccaagaaaatgtggcgcctccttctatttgtctttggcatattgcaacacagtgcagttcacagtgctgtgtttactggattttttagttatgtattctggtgttaactaacccacacaaaatggagaggtggctcttaaaagctcctgcaaagaaactgtggatgcaaaatgacactagtcccataatcacaagcaatcattaaaaaacgcaatgccgacccttctcagggggtcttaccatgtcactcagccttattacaaagtaaaaatcgtgacgacctatcagatgtgacccccaagtaccccaggatccaaatgatcgagaagactatatgaaatacagattgatgtaggccattactaataacaaaccttgcgctaagtgtgtaagtgcccagagagagcagctaatggtgaaataatagctatcttgattagaaaaacattttaaaccaccaagacactcaaattttgctgtacaattggataaagaataaatatctctaacatgcctcttggtatttgcaagaattcatttcaacaataaaaatatatgaaaggctgggtgcggtggctcatgcctataattccagcactttgggaggccaaagcaggcggatcacctgaggtcaggagttcaaaaccagcctggccaacatggtgaaaccctgtctctactaaagatacaaaagttagccagccctggtggcacatgcctgtaatcccagctactcgggaggctgaggcaggagaattacttgaacccaggaagtggaggttgcagtgagccgaggtcacgccactgcattccagcctgtgcgacagagcaagactccatctcaaaaaaaagaagaagaagaagaagaagaaaatatgaagaactctctttttgtaaaccactaaaggatgaaccagtggacatatattctcaacagtaaatgacttcctggatgacaataagctttagcaaacaacactgaaagtgtagctactgatgttatgactgggagaaaaaggaattgggataaggtaacagagatggagggtgcagcattcagagacaagctattgccacaaaggagtcaaagctagaagacggcaaattgctacaggaagccatcatgcagctacctttatagagcaagacctttgaaatatcatggtatatttatggaactttgtatggaataaggtctgtggcaattgctcgtgcctgcttagaattgctggctatctataggcaaaagaattgtcagacttatagctgagttctctttttgttccacaaaagatagtattcccctgccttttcctgtgaagacaggtggcgatcagaagtatgcctcctgctagagcttttcaagagggttggcacactagtctgttcctccaaagtaatggagatttttttcctgtttttatttaatgtcaactctttggtttttttttttttctttgtaaagtaagggggaatgttgtgatttcaaggcaggatgtgtatcagcataaaaatactgagaataatttccttgttggtcaatctgcaatcagacatctgtgtatttttagtatttcaaaataaaaagcaaaaagtaataacaataaaatccatgttatatatataacatgcatgtagtgtagtagatactatatgtaataactatgtatgtgaagtatataatacatttttcttagtattaacaaaattttaattgacaaataaaaattgtatatatttgtggtgcacaactatttgtttgtttgttttgagatggagtcttgctctgtcactcaggctggagtgcagtggcgcaacctcagctcactgcgacctccccctcctgggttcaagcgagtctcctgcctcagcctcctgagtagctgggattacaggcatgtgctgccatgcccagctaattttcatatttttagtagagatggggtttcaccatgttagccagactggtctcgaactcctgacctgaggtgatccacctgccttggcctcccaaagcactgggattaaggcatgagccactgcgcctggctggtacacaactgttgttctgaaataagtatacattgtaaagtggctaaattgcacccatgtgtattacctcatatatttattttttgtggtgagaacacttaaaatctactctcttagcaattttcaagaatacaagacgctgttattaaccatagtcactatgtcgtacaacagatcctttgaacttattcctcctgtatctaactgaaatgttgtaccctttgatcaatatctcccctctcccccaggccctggtaactaccattctactctgcttctatgggtttgcttttcttaggtcccatatgtaagtgagatcatgtgatatttgtctttctgtgcctgtcttatttcacttagtactgcttttaataaaagcgaggtgggctgagaggagtctggtgagaaccaggaagcacagctgcccagggcgatggcttcgggggctggggctcactgctgccgggtgggctggacatccagactgcacccgcttcccagcatgggtgacagaggagcccaggggccgtccagtgagacctgtccgtatctccactcttcagcctccccggtgattgagaatggccagctggagtgtcctcaggggtacaagagactgaacctcactcactgccaaggtaggacccccagggccagggctgggctcaaggatgccggggcacactcccagcaccagacaggaggggtgtctgtcactggccgagtggtctccactgagtccctctaagccccagctttggggagtggtggggggctgctgattccaggggactaaggaaatccagggacttgcttgagagtgacagaggaagccaagggggccgacacctcccctcgtccccatctccacccacacccacctggaacacaggctaggggctctaggctatgtggggctgtgtctgaaggggccaccccagtctgtgcacttccacttttctcctgagctggtctccctggagtgggaagaatttcagctctagggtgggaaatcaagtcagcctgagttgttggggcctctgtgggcttttcccaactgaaaacctttagctactcaggcttccctcccgcttgcttcaacccatagccaggaaaggggacggggagcacgggggcttcctgcctgggacaggctcctggggctggcagaggccagtggggaacaaggtggcttccctgtggggagctttgacaactggacaaacagttgtctgtatggtttgctttgggtggagctgggtcagagacgggggattgacccagatggcctccaaggtgccctcctcctggaggttgcttcagagagaggagtctggggaagctctgcatggctgggctgtcttccttgggggtgccaggctgcagaagtgattcctagcccgtggataagcaaaggtgctggggccaagcaaaagggcaggtctctggcccagcctagtccagagtcagactccctcaggagccagtggtttgagggccaagcagacagtggatgtagggagaaatacgtatttttgcctttggagggtacatcggggctgttcatgtctaaacagtcaccagttgcttttcctcctggtatgtttcccaatctggagctttaaggttatactcaggatctcaaatgggctctctgccctccctctactgagccccaagattcaggacaccaaaggaccttccctcaggaggccctgcccctgaaacctccccttcccatgtatgtggctgtggtctctgtgtctgcgaagggacctgctcatctctgcacccgcatgcgtcatctctcctctctctccatccttctctcctacttccacagagtattggaggggaggttactatgggctacatacactgtgctaggagtacacagtgatggagaagacagtcctgccccaagtgcagacagaccccctgaacaatcaggtctaatgagcggggcattcttgagagaaagcagcagtccctgagtgctacaggatcccatggtgggggcgccttcccagactggaaggatcagggaaggctccctggaaaaggtgatacctaaggccaagactttaaaaatgagtacacgttggccaactaagaggatgcaagctctccaggcaatgtgaaccccataagcaaaagaacagtttgtgctgtctggagtgtcccagaaagtactgtgtacgtggcctgtgtacacacgggagatgccacatgtctgccagtgtctcatcagagccacctgtttacccacaggctttggggaaaggtagagggccttggataccatgttagggtttagagcctccctctaagaagtgacagggaacccagaagcagagggaagcaagtcagatttgggtatggaggcccacatcccactgtggccacagtctggatgcatatggatcactgccccttcccatttctcagtagcaccttcccagctcttattggcaccctgccacaatggggcatcctaccaaggagtagtgccccttggtgctcaggctgggtcacctttcagtccctcgttcctgtgcccagtgccaatttccccaaaccggtgggtgacctggctctgcagacacagggctgcctgtgttaccgcctggcctggaggcaggtgcccctcacaagcaattaatgcttatcatctctgctgccatcaccaccatcaatagaagtgccatcatcaagatggcccccgactcctcatatcttagattgtgagggctgagacttccccttggcagggagaagtttgcagcaggaaaagggggtttccccctttgaggtcacagaagaaaccagtgcacctcccttatttgaagaacagcatgagcctccacgggtttccggggggatgcgtgcagcctgcacaaggaagggcgttcaggaggacccgaagatgtgcccttctgaccctcaacctttgcacactcttaactgtgacccctgctgtccccttccccttcagtgccttcctccagcctctgcctccttttccttaccagggtcctccctcctccagctcactgcagacatgctcccagggtcttggggcctgcagaggtgcttcagggacctctggaggaaggctgaataggagggacttggctgccccttctccaccttccaacccacacagtccccctgatctgtttcctgtctgcatctcaacatgccactctccagctgaatgactctgtgcccagtgccaatttccccaaaccagtgggtgacctggctattcctgggacctcagtttcttctcctgtaaaatgaggacatgtgggcctatttgataaaattgtttgtgagaattaaatggggtattatatgttaatacccagcagagtacgtagcatgtaataggtgctcaataaacactagcgcttgaggcctggcaaggcagctcatgcttgtaatctcagcacttcgggaggccaaggcaggcagattgcttgaggcccagagtttgagaccagccatgggcaacatggtgaaaacacatctctacaaaaaatacagtacaaaaattagctggatgtggtggtatgcacctgtcgttccagctactcgggaggctgaggcatgagaattgcttgaacctgggaggcggagactgcagtgagctgagatcacacccctgcactccagcctgggtggcaaaacgagactctgtctcaaaaaatagataaataaataaataaacattagctcttaatattatgatcattgttacatgccacttattggacaaagtggtttgcaatttgatcttatccatttaacaacaccatctggttgttactatcattatcctcattttacaaatgaggaaactgaggcacagggagaggaatcccactgaatacatagcagctcttttgttgttgttttatctggagagagtatttgaagatctctgcccagcccctctgctccatcaggcctccgtggggcgggcacttggtcatctcctccaaccctgcagatatcaacgagtgcttgaccctgggcctgtgcaaggacgcggagtgtgtgaataccaggggcagctacctgtgcacatgcagacctggcctcatgctggatccatcgcggagccgctgtgtgtgtgagtgctggcagggatggggtgggggtggacagtgggagacaagatgggacacttcaggtccacaggccaggcccagggcagcaattttccccagacctgatcacgccatgctcagggcctgtgtcggctattcaacctggagttgggcccaatgtgaaaaacctgatcagcccatcctgctggaacagagatggttactacttcactttttacactaggcattttttccgggcctttgcagtttggaattcgtcttttctatttcttattttttttcctttctaatcatttctgttccatgtgtagcctcgttttctttggtggcgggaggtggtgggggtggcctctgctctgatgtctggctgagccttggctgctgagtgacctttccagaagggctgtccatagcattcatggagctgctgcccgacccgagggcctttccacaatcctgtggccccttgtggttctgaagtttctccttatctgtgaacacatagtgggcattagcattgtgtccaggtatgtacatgcatgtatgccaggcagccctgtttccagagacctctgtggtttccagggtgagaggcccaggctggcagcagcccccaatggcagaactgacaccacagcccagatagggctttccctgggccgggaggcctgaccagagctgaataaaaccagtcccaactggcctctgggaggcagcagccgaggttggatgggccacgcccagctcagcagagctccctgcaaccggccaagccctcagtctgcaaactttctggtactgggtttgggagggccatgggattggacaagactccagtgccacccagaggctgaacccagtggctctagggagagaagacagcaagagctataggaggggggtgcccagagagtgaggggcccagagtggggagaacatgtcagaccgctctcaagaaaccttcatggtggcagtggcaggtgatcaaggccttgagaggcttacacccttccttctactccacatcacttaagatccctttaccagagaggtgtgtttgacatccaaggtgacttatttattagtcccagaaagagacccttaatacagggaagcagagatggctctcgagtgtccttttttccctctctgtccctggtgttactccctccagcctcctacagtgattcacctccctgtaagtgggaggggtggcacgaagtttctcttccctttgtttctgagttctgcctccttccctccctgccgcctgaccaggtccagtggggcagtctacagggctgccccagcctcctgatattcccacctgggtcatctccaccctggggttcaaagggacagagcccttccttacagtgtcccaatggaagtggctgctagaagcagagtttgcacctggagatccagggctcacagacggctgatgatttacctgtggcgggcacatgacctttaacaagccactctcacacacctcactctatttaatctccacgacaataccacgaagaaagtttattaatcgggagtctttggattgcaagtgacagaaaccaaactcaaactgccttaagcaaaaaagaattcgctggggctgggccccgtgcctctcacctgtaatccaagcactttgggaggctgaggcaggtggaccacttgagttcaggagtttaaaaccagcctaggcaacatggtgagaccctgtctttacaaaaaattaaaaattagccaggcgtggtggtgcacacctgtagtcccagctacttgagaggctgaagtggaaggatggcttgagccccagaggcaaaggttgcagtgagccgagatcgtgccactatactgcagcctgggcaatagacaagactcttctcaagaaaaaccaaaagcattggttcacacaactaggaagtgcagacgtggtatggcctcaggctggctgacctaggcagccacagtgtctgcagggcatgtcctgctctttcctctgtgtgagtttcatggttccttcaaaggtggtcaccagatgctctaggcctacaccctctcagccttgcaaactcaataaaaaatgagccccttttccccaataacccaggaataatagtctcaaagctgattatcattgggcctccttggttaagtgcccatccctgacccaatcactgtaaccaggggtatggaccacaagccttcagccagaaaggcgtcagcctccactccagtcatatggaccaagggtgggaaagggtggttcctgtaggagaaccagagtgatgatacgagaatatggtgcatagactctgggcaggcagaaatacaggtgtcccctgcgatggaatcatcattctcatcttcattttacacgtgaagaagctaaggcccagggaggtctgtagttcatggtggagcagggatttgaacttggtctgctgcgtcctgggcctgaccagcacttccccagaatcattcattcctaaactttgattgatgtcctcttcagcccactctcctcctcttagaatccagtcagccctctacggattccagactcttccaacctggcatggcctcctcgtcttccattgagataacatacagaaactattctttaatatttattttcaaagtacaagaaaggagataagggtggtggcattgctatgacctaagcccagcatagctcaaactcacagtgaccctcagtattttgattggctggttgattctgtgtttgattggttcattgacctagccatccacgcatagcttcaacaagcattactaagcatttgcatgcaccaggcactatgggaggtgcctgggtgacagagatgacccaagatagggtccctgtcctccgagctccccatccggccttagctccttaccttgcctcatcttcccagggaggctgtggtcctcaggacatactgctgcccgctcaaccctagggacacgtggggccttcagtaaacacttctaaactcggcactggagacaagcagctgcatcctcattccctgctctcaggttctccacatgcaggtggggagtcacgagtctcatcaagcacacaacatgggcaggtgctgaaacattccactacgcctcttcctcctaaagttcttgtgagcatttgcagggctccaaacttcccaactgagatatgggccaggccagtctgagtgcatgtggccagccacacctccatccactgccctcccagctgcgcattcccctcccactggccacctgcccacctccacgtgctgtgtctgttgcagcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacaggtaacctcctgttcccatcccagctttcactgcccaggggctcaaggccagtgaccatgttgccaggcctgggtagacttccctcaatctggaagactgaagtagccttccctgcctgctcacgtgcttatcccaacctggggctccctccctccttgctgccacaattgccgtgtctcccaaagggagggaaaggaaggccctggtttcctgcaggaacagcacctctcagtttgtcctctggctgttggctttgcagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtatctgagctgggggagatgcctgagggattttcctttcccctaagtttccagcacctcagagaagtgtgggtgttaatcctgggtccctgggcatcccatctctgtggcattaggaaagggagcttggagcagcagcacccaaccctggcagccttctctcatggcctggccccacccacttcctcttccatatggggtcaagaggtgcccacgccccagggagttgcttgtggaggtgggaaagatcagccgcagcccccaccccagcgatcaggcctctccatctcctgccctctggccatgcagcttctggggccggtgcttgctgcaggcctgaatagctggcaggtgggtcctggggacctgcatgtcagacccctggcccggccttggagtcagagtgctaactccagctcaacggccttggaccccagaggcacggggctggagggaggctgggtatgaggctctccttgcaagtgccctgaaaaccatggagaagtcatgcccaggtcactggtaacactgaatgcaggaggcctggaacgtcatagcgccagcaaactatgtgattggtcaaactgctccaggaatctggaatagacaggggagtgaggacagagccccagttgttgtggacacaggacaccggccaagccaggagcaattccactccttcctcaaactgttcccctggcccaaagcccagggcagggggctgcatgacccagcctggctgggaggcatgggagggaggaggtagcagtgcaaggaggtgactccagaatggatggggtggacaggtccgggagcaggtgggactcctgtcacccgaggccttacaggaaagcagggccttccgcttaccaagtgagaggcttcactaagctatcttcaggccctccagacctggggttctggaattttgtggtggccagtccctacaggggtgatggggcagaggcaggtaagaagagtccacgctttctgtgctgctggccctgctggggatgtggtctggggcgcagactgtgaagccgcccaggtggcggtgaggggagaaggcagccagaccctcctccctgagctcacgctgttacctttcccttccaggtgactctcaggctggccaggtgagtgcgtcctcccactagggggccgggcaagcatggcagagagcaggacctggtagcagctcaggccccagggcagtgtctcatgagggagggagagggagaaagatggagtatctgttagattttacttgaagagatgaccaagtgggaggattgatccaaagacccagttttaccctaaaggaagtgataacaacagctcttgtttatggagcagccattgtgcaagcattttcccatttgggatgggctggggccccttcagaaaggaagtaggaacatgtcctgttaggcctggctgtcactcaagctttaagcactgcagacgaggtgtggagctgcttccagttcattctgggtctggcactttctgcgctggtttagttgaacctccaggtccctctgggagtggtgtacagggaagtgtgggcacagctgtgaacaacctcaaaccacctcacggagaaaggtgcatccaactcccttccctgtgcccaagattcccctgggaaaacctgggtgtcgtcccaggaaaacattccagaagaggggatctgcttcttccctcatcagcctcagtccctactctgtcccctgcccctccagcctgcatacctgactgttcccaaatacagtttcttccgggtgccttgttctgtccctgggccaccatatgatgtccccccaggccaaagctctaactctggtccccacagacgcagccagcctccagggcctttttcaccctctgcccactcttctgctgttacatccccacctctcagcaaattctgtccactggctatgttgagggacaccaggtataacctgtggtcccagcttccccactctggccctgtggctccaggcactctagtgaacctccagagcttctgttactgtgttgagatgctagggttatagctgacaccaaattgctgattttctaccatggacccaacactgagctggcatagtatgtacatcagctcatttaatcatttcaacctcccatcataagatagttgagaaggttaatgaagtgagtgggtgtaaagtgcctggcagaatgcccagcatagagtaagaactcatcaatacctggaatgaatgaaaacatgaatgagctcctggtaggaagcccggaggtgggggtcagtgtggtggaaggtggcacatcacagggacggcagaggagccaaaagtgaccttctcctgtttctgtgcaggtcacgaccagtgtcacccatgcacctgcctgggtcacaggtgagtccctcttcctggcggctcctaggcaaaagagaagggagggaaagagcccttaatcaggagtggagttactatgtgtgagctggttcacgctcacacacacatcagaggagggtgagaaggacgtggcctgtgagtgctgtttctgggagctctctatacacctaaggtgctgtgaagtcagcgagagaccccatgacgcttcacagatagttttctagccacagaactctttgcaaatttcatggcaccacttagcacataaatcagaacaaagagacagcactagctgaaacaggtgtttggctgggtcgctagactctttcccccaagaggtcttgtcctgaaaccactacttgcctgtcactggtgttgggttcagacattggaaggctgagctcatgcttcttgtaaaacggtagaagacactgatgcctgtcttgcagactctcaaagcaaataagatgttggtatttgtggcagagctctgtaagctgtgaaatgctttgtaagcagaagtgaaagaatgttgaagtgggaattaggaaacccaggtgtcagctgtgcctccgacaagctgactggccttggacaagtgaccatttctgcaagcctcagtctcctggccctgacatggaggattagactggatgtgctccaacgcctgttagagctctcagattctctaagtggggccagatcaactttcaggagactggaaggcatgggagtgacccaccccaggcttcacccttcgttcttgggagtctgagcaccagggaagagggaagggccatggccagccaaggggccacaaccccacctcttcccctctctcctccacagggaatgccacaaccccaccaatgcctgaacaggggattgcagagatacaggaagaacaagtgaccccctccactgatgtgctggtgaccctgagcaccccaggtagctgcagccagacctttggggctccctgcaccctgccctgtgagctgtgtctgtccagagccaactccagggcaggggcatgaatggaatgccccctcacctttccaactaggtaaagtccccagcaggctcccagctgggctgtgcacccctggcctcatcttacaaagaacacagggtccctcttgtgaaaacaagagccctgcctggagcactgcccaagcccagaagggggaagagaagggacaccatgggagaaggaagccaggggtcttccaggagaatctgggggtccctctcaaggaaggggagcatggggagtgagggccactgggatcctggctcttccaggccactcccctgagtcagcagagtgcctggcagcgagcagctgcctgcccacggggagggctgattttcgggaaggaacatggttctatttctcaaggttgtttaaccaagcctgcattcctctccctctggtcagctacagtgatgggggcgaggggcgggtgtgggggcgatcctggcaaatccaccttgctctggaatgtgccctccttaaaggctcattgtctggggacttggtgcaggagaagcaaggcgggtgttgttgccgctgctccctgtacacgtgtgtgcccgctcctggggctcctgctctcttaaccttacgactgggtccagagacccagtcaccttgtgttgggggtgagggtggtcagggggttctggatttccttcagcaaagggaaagcccctgcgcctggtggaacagtccagagagtggggagtaggggtccagccttcccaggcacaccccactgacctctcctgggacctctctcctctgggctcaaagcgctgctccagggagcatccccttctggcctctgctcagcaggcagagtgtgcagaggagtgctgaatttctgacaaggaaaatggacctggaggaagggatgggaagcagggggcagggggcagggggcaggccaagctcagcagcagctcttggcatgtggatgagtgtccccaccgcaaccccagcctcagccttttgccctatcccccttctcctctgccattctgtaacctcacccctctgggcagacatttaggacccagctgagggcccccacaacccccaaggctgacacaaacttagagccaggcccggggagagggtagccttgggtgcacattcaattcagtacaatctggcagactgttaagccccactgtatacccacgtacagaccattccccaacccattcccttgggtcttcggcttctcccaagctatgggggcggggcagggacccctgagcatgtgggcttcaggcaaagacttcagggtggacacaaatgcagaagcatcattcattcatttatccatttggcatgttctaagtgccaggtacctttctagtattagggataccgttcagaaagctaaagtctctgctgtctacacagcctcaaccccgagtcccagtgagtctgcctccaaactatttctcaattctgtacctgtctccccacttctcaccccatcaccaccacccaaggcagaccctcatttaaattatttcaacaggttttaaggacccactatacctcccttaccagttcatccatcatctcgttgcctgagtggcctttctaggactgctctgacccacccccacctttcacaaaatccttgttacaggccagtctcaatgtggctttcaaggctctgctcagctgaccccagtccacccctcccattttcccctggcagttttccccaagcaccttactcaccaggtctgtctgtctgtccagggaaaactgggcaggagttgcagggagggatggcgctgggcactgggtaggagtcaggcccattttcggggtggggctaggatggaggggttttgctggaaatttgctggaaatatgggttatccattagatctcggtgagggggatgccctactatgacctccatcctgggtagggctcggggtgctgggcagaggtcccctagggtcttatgcaaggccaagctgtgcatgggtatgggagggagggcctggctaaggttggccttctgaggcccctagaccctggccactgactgtccccaccccgctccactgcctttgtccagcacccaccctgccataacctctgttttgctctgtctcccacaggcattgacagatgcgctgctggagccaccaacgtctgtggccctggaacctgcgtgaacctccccgatggatacagatgtgtctgcagccctggctaccagctgcaccccagccaggcctactgcacaggtattcacttgggtgccctgggcttacttggcggctggggtagatgggagcaggggctaggaggccgagttgagagtccaggaagaagcagaaggtccaagcagtgctgggtggttgatgagtttaggaggagcacagtccctgtggactaagctaactttaaccttcaggggaagaccagtctcggtgagccccatccgatgagtctccaggactccaggagcacagaagccagcccattgcatgcatcctggcctgtgcctggcagccctcttctctgagatcagcccacccctcaaactggccattttgctgcctggagagcacacccaggactgccccagttgcaaatgtctccaccagggtcatccgtagggggaggtctgaggctaagataaatcatcaagtgtggacctcattcctcctccccccaatattttcaaataagggagaaatatccattgtggtttcaaaggagaaaggaatcatgaggctactgggggaaggagtcgaggggcagataggaggggctggcagtcacgccaggcttctggtgcctgagtgggcccactgggctgactttatggcttccagccttagagattttcagcctcctccactccctcaccccttccttgccacacagcaccatcccctgcccagcccctagtgtgggcaggttgctggtaggtgcccaaagaacggcaccgctggcccccctgacctccctccctgccttcttctggtcagatgacaacgagtgtctgagggacccctgcaagggaaaagggcgctgcatcaaccgcgtggggtcctactcctgcttctgctaccctggctacactctggccacctcaggggcgacacaggagtgtcaaggtaagccaagcccgcccttgcccttggccaggccccacagtcttgagggggtggaagaggaaccaggggttcacacccccaaacaccgtgccgcagaatggggagtgggcagctgaaggagtgaaggaggagagaccagaactccagcctggatctgggaggaggctgattctatgccagtggcaaggaggggtagaaatccaaaaaccagcaatctctgcaaaggccctaaggaattgtgggtggaaccaagagtgtcacagggtcaggagacatggctggagatgaggattatgcagcaggcccccaaactccgagtgacaaggagctggtttcatgtcagggaaggagggagacccataaggatgccaggctgggactactggcagacctgggagtaggtgtgcctttgaacgaggagcacggctcctcagcagcttggaggcacttgtagggctttgcacttccctgggaagatgtggcccactgccaggggacccttgataaatacgctcccaacgcaaaccctttaatgatgcaaaacaccccacatacatttttttccacatacatttttatgattaagttcacaaataatataatgcagcactttctaagcaacaccttaagattcataatccagttgtaaatccttcacctcaagagggaccctgcctgtgcttggggctcacattgctggttctggccagacccccagggaggccagggaagctgtgtaccctcctgctgccaggatcccctcgggttccaatcccccaagggtccagtttacagaaaccaaagccatccaggtccaatcacttgattatggagggaagggaagtagaaggggcagacctcctaacttaacggaggagcgggagaatcacgggtagtgttcattatgctctcatgcgttggcaccacctatgtgccaggcactgtgccaagctctgaggatgctgagatgagtgaggtgtgaatggtgacactgtaggatccagatgaggagcaagttgttctgtatgagattattcgggtactcgagatggagcagaataaaaatagctaccattcattcattcattcattcattcattcatttatgatggagtctcgctctgtcacccaggctggagtgcagtggcacaatcttggctcactgtaacctctgcctcctgggttcacgccattctcctgcctcagcctcctgagtagctgggactacaggcgcctgccaccacgctcggctaatttttgtatttttagtagagacagggttttaccatattggccaggctggtctcgaactcctgatcttgtgatccacccgcctcggcctcccaaagtgctgggattacaggtgtgagccaccacacctgaccaagaatagctaccatttaatgagcacttaatatatgctggcaatgtcccaagcattttgttatatgaagctcatcatcccaactccatgttatggaaatccttagccccatttaatagtttagcaaactgaggctcagaggtgaattgaaatacccaggggcctcaaacctagtggtgacagagctagaaacagaatcaaatcactctagctccaaagcatggtttgcttccaaagacacactcccttacacacagggtgttggagcatgaataggaatggagcgtgaataggaattgagggagcagagggtattccaggtagagagaagcatctttgcagagacctgaatagtgaacgttccctggcatgctctgggaataatcatgaatgcagtatgactggagcagggctacctggaggaagaggccagtgtgggaaatgtcttgagtgccaggctgaagcgcttggacactgtctcacaggcatgggtagccagtagaagtctgtgagcagaacagtggtgactgggtcagctgacttccggggagctgacttaaggggcagggctcagaacaggctggaggagccaggagagaggctgagggaaggaggcttctctgggctccaatcgtctaggtgggtgttgtgggccagaggcactgctctttgcagacccagcctggggagctggcctgggataagcagcagctgctgcagagaatggtgtcaccaggactggtgcagacacaagtttctgccaccgtgccagcctgggtgtccaagatgtctctgccagccccagcagctggggaacgggggtggggttcaaggctggctctaagtacttctcccagtggggcttgggtaccactggaagaggccttgtccagaataacacccactttctgaagcttcccagtctcataaagtaatatctcattacctcaatgatttgatatttatatctatttatagattatttaaataatgtatatataattaatataaatcataatttatattatcaataagataaattatttacatattaaatatctaagtaaatgtttaccaataaatgtaagcatctcttcatacattagcctgtgggtttcctcatctgtaaactgctggctcccatttttgctcagttttccaatggtggttgctgctttttcctggggctctttaggagtccgttatatattctagattcttggccgggtttagaaattgcaatgctcccattttgtcctctatcctttaagcttatctacatttcttggaacagaaatccttaattttgatttactgaaattcaccattttgccttatttttgtgtgttttgggggctttgtttaagaaatccttccatatcctgaagtcataaagatattctcctataccttaattgagttctagttttcccttttatggtatgctttgattcatctggagtccatcttcatatggctgttaagaacctggtctttctctattcacgtctccatttttctccatggagtgagggagttttccagcaccatctatcagacagtcgtcctgacctcaggggataatgagttcttcatccagttcccacatacggctctgtctatgagttcccttctctcttccattggggttagagcttctcacagtgaacaccagttattccagaattgcctgaagagctataacagcgtgggttcctgggcccaccagtacagcaggatcagaatctctggctgtgggcctaggagtgtgcatttcccaccttctggcagagactttgctgtgcactggagttttatgaagtattgctcaagtgaagacactgtccttaaacaaatggttattattcaattccttcagtaagcacttattggggttctgtgctgggcactggagatgctgagataataaggcatgttcccattagtcagggagaagcaagtaaatgaacaggtacactgaaagctgggccctcaggggacgctgggttggagataagtgggaggcagtcacactggtgtgtaggaagctgttccaggcaaggggacagtgtgggcagaggctcaggaacaggtcctgaggttaggcgagggtaggagaggtgcgggcggcaggaaacagatgagaagcaggctggggccggtcatgcaagatctcacacgccaggcttgaggagctgggattttatggggtttaacactaggataataatagctaacatttctgcagtgcttaccttatgccaggtgggcacagtgctcaacccctcacctggattattgtatttaatctgcacaaggactctgtgaagtgtttgtatcagtcccagtttaagggggagagtgggaaggtgaggccttgattaatttgactgtggggacaggggatggggacccacaggacccaaaggtgatgcattaaaccagtccttgaaatgggggcagggatttgctggccatcgtgaggaaagagactccaggtggaagcatttgtgtgaacaaaggcttggagattggactgctgaaatctgcaatagctgaggctataccaagggacttgtgtgaattagcaaatacagcagagctgggccagctggcaaaggccttgtgagccaagctgcgaacagaactggaggtagcaggggtctctggtaggagtttaagcagtggaggggcgtgagtggggttgggctttagatgatgggacaccaatatactttggaaaagtgacagaaaccacaccctacagatccatggttacctaaaacgcaatccctcactggctgcttggttcctaacctttatgaaggtccttaggaaggactccaggaggccaggcgcagtggttcatgcttataatcccagcactttgggaggctgaggagtgtggatcacttgaggtcaggagttcaagaccagcctggtcaacatagtgaaacctcatctctactaaaaatacaaaaaaattagctgggtgtggtagcgggcacctgtaatcccagctacttgggaggctgaggcaggagaatcgcttgagccagggaggcagaggttgcagtgagccggaggttgcagtgagtcaagatggcgccatcgcactccagcctgggcaacaagagcgaaactccgtctcaataaataaataaaggaagaaaggaaggaaggactccaggagcagacccgaaggggatatagtggggccaggagcggggtgggagtccttttggcctctgcagtttatactgtatggactgctaccccacctccagatcagcccttgcatgagggtgaggaaacagttgtaaggatccccatgggtccccagagtagactcccctgagagaaaggaactcaggtttatcaggggcctgagctagatcatttcagacctggcccaggagcccctccaggcaattgtggctgcagccagcatgccttccctgcccaggcctcagcatggcatcctttgtccttggcctctagaaggaatgctccaggaccccgccccctccaccatcctccagggctggctgtgactcagggcttttctgtgtgttcacagatatcaatgagtgtgagcagccaggggtgtgcagcggggggcagtgcaccaacaccgagggctcgtaccactgcgagtgtgatcagggctacatcatggtcaggaaaggacactgccaaggtaaggaacgggaaggagggaagcgccctgccaccccaccacccacctgtccctccctacgcactgcccaccaccaacacgccttctggcttgtctctgccctggccccttgatgctgagcccacgtctatggacagagacacctatgagaattcctgagcccttccatcccctcagtgacattctggcatcctgtctgccacctgcagcaggggagcatgaacaactttatccacatgacaccttaggaacatctcctctgtaacctccgccctgttgccttgaaaaatgtgctcttctcatggggcagaggaagagtcggtgtgtctgggagtgtcagccttcttattaagcttgttagattgttagctcctgagggctgggccatatctttagatggcccatacatggacaactgataagcacccaataaatgctagaggaaggaaggaaggaagggagggagggagggattccagatccttctgtctttcccagacccagccagaaggcgctgtgacattgctaactggtctcctcacagacccttgcctgtctcgtgccagctctgaagacccctggcagctttgctgccaccacgtccctgtcaggctggggtgtcacaggcttgtaggaggcccagggcatttgctctcgagactggctgggacaggaagaaatgagggtaaatccaggcgcagtccaagaagaacctggccctgggtccgagcttaggctgagactcctcccagcctccaggtttccctggctgggacttgcctgctttcagaagggcctggaagtcagagaagagcttgtgtactttgtgaaaggacagcttcccttcccaataccactaccatggaagcgaagtccagagaagcaaaggggagaggttgcggcaggtgcaggacagacagctctgccttcagccccagtgtgtcacctcccaatgcctccctcttggtcctccccctttaaaactcaggcctacccatgaccaaagccggaacccacctgccttgtcctccttagcacgatggagataagacagcctggcatcttcaggagaatggagaatgatggcacccaccactgacaggtgcctcctgtgtcccaggtgtctgggttaggtcctcaatagattacctcatttaagcatcataatgacactgtgaatttgacattagactttatcaaaaagagaagtaaaatgagaggaaatgaatcaagaaaataccagaacattaaaaacatcaggtttaggctgggcgcggtggctcacatctgtaatcccagcactttgggaggccgaggcaggtgggtcactggagatcagcagttcaagactagcctggccaacgtggtgaaaccccgtctctactaaaaatacaaaaattagctgggcgtgatagcacatgcctgttatcctacctacttgcgaggctgaggcaggagaatcacttgaacccaggacgtggaagttgcagtgagccgagatcacgccactgcactccagcctgggcaatagagtgagactctgtctcaaaaaaaaaaaaaaaaaaatcagatttatattaaccagtctgtgtgaagggcacaggctctggtgcagacaggcttgggtttggcttttgacacgatgtctggaaattgaactgtaatgcccatctcagagatgtttgtgagcaccggataagctaatgtatacaaagtgctaggcaccgtctggcacatacagaccttgaataagtagagggaaatgttactgtcagagggtagttctttttcatgtccaggctcccccataccccagccctctccttcccttcccaaggaaaggttctagacacacacctcatctgggaggtcaggcagagttcctggcccagggcagacactccgagtctgttgaaagaaagaatgatgtagcccgcacacttctccaggtttccatcggtaaccacaagcccggcccatcaccctgggagcccagtcaatttcctctccctctttcttctttctccaactcagaaaccactctcgccactgaaactgaaagtctctggtgaaaggctgagtggtctggacagaggcccgtccagcagtctcaacggcatttccgtcgtaccgggactccaggttcccacggacaggggatagacttccctgcagactgccagggcctttggtgtcgcccagccataaccaaggtcacttgagcttctggcccctgcctgagtgccttccctacccccaccgcatgctctcacaaccaccagaagtgaatgcctttatatttcctcatccaaaggctgatctgtggttagagaagctccaggattctcccagcgaaccaacagaagcttggcaagctggtctctggattgattgttgccatgggccctttggggtctcttcagcagccttataccaaaaagatgaagggtgaagtttgaggcatactctcccactctttggttagcaaacatttgttgagcaccagctgtgtcggccatgggctgggaacacaggaagaagacagatggctcctggcttcaaagacagaatattaaaaccctccaaaacacaccgtaatctcagattaacattcataccctaggccaggcagaaaaactggaatatttctgcatccagtgactggttccagtccaggcaccaagatgctggtgggacagcctcagggtagctggtaatagaatctgcttcattcggaatcttcctctggctcctttggattggcttggctaatggttcagttatattcacttccaccaaggagagcccttccctggctcgggtggagaatgaggggctgctttcatcatctgccctccccctcccattcacgtgtgataatcactggctggggctctggtctgaggaaggaagccagcagtggcatgccaagatagacaaggttatgctgcgttaacaaacaacccctatcttattgacatagcagccaagtttgtttgtttgtttgtttgagacagagtctcgctctgtcacccaggctggagtgcagtggtgtgatcttggctcactgcaacctcctcccccaccgggttcaagcgattctcctgcctcagcctcccgagtggctgggactacaggtgcccaccaccacacccggctaatttttgtatttttagtagagatggggtttcaccattttggctaggctagtcttgaactcctgacctcagatgatccgcctatcttggcctcccaaagtgctgggattacaggcgcgagtcaccatgcccagcagcagccaagtttctatctcatcagtgccacatgtccatcaagggtcagctgggggctctgccccatgtttcctcattggagatgtaggctaaaggaatagccagtctctgtggaagaataaaagagcactctggagggttgcacaaattaaatggtttggtccataaattatccgtatcatacgcactcacagttcgttggccctcactagtctcatggctccacccaaccacaagagactaggaagcaccagattaccatggtgcagaaagtggagagctggaatgccacatgcatcctaaatgcccagcattaagacactacacacaccacctccaagagatgtgcccagcatgtttggggcaggacagacttcagggccctttgctcctggcaaaccttatctccttcccacgttgcctgatccctgcaggaaaggtccaaagacttcatttttcctggcatggatttaggaggagctttgcctcaatctcgttctcttcatcctggaagagatcatctggcatccctgaaacagggattgctgctcattctcagtggctttgcccatcctccttcaagtaccttggccaaggccaacaggtcatggcactggcctctgtctcttgggtggccaaagttagtcatcttagatccttcattttatccatctctgtctttacagaagcccttagaatagttaaggctggtgtcaccacaactcaagtaggggctggggctaccctcttgccagagatgcgccttatctcagtgtccccaagattatatgggagttgtgggactctccttgcagagacccacctgaaaaccacctgccctgtggcgatgtccccgtcttctggaccctcaggcagaagctttaggcttgagagggtcccagtcctctgggacagagggcttcgatgtgtcctgacttctggaagccaaacaacctcagagaggactcactttcaccctccactttaaggtccatgtcctctcctctccatgtccagcagcagtgacagctgctggctttagtccctctgcagaaagcctatgttcagaccctaggcctgcctcccacacttcctccataggtgctgagtaggtcctcctctcgggcagtagagcctctaaatatgcataagctggtggacttcctctagaagaatgacaattacccatttaggaagaagaacccctcctctttccttggccaatggacctgttgtgaagagtgggccagagccttgataccgggccagaggggcataatgtcctcctgcagtgctgactcagagttcagtccctgtgacaggacctccctcactcagtccaggtcccctgggtgccttgatgatgaagcccatgatatgccaggttacgtcggggaagagccctctcctcggctccggggagaactagctccctcctcttcctgttgccactctcccttcctgggtcctctcgtcccctgggtgtccatttggtgtccaggcttaacccttctggctgactttcctggatctcaccagagtgggtgccaggatccctacatgattcttggctggaagaaatgtctgacagctctccagcagagaagctttgccagctctaccctacagtctgcactctgcctcagagctggtcttggccatatccaagattgggggttcctccatggtcctcatttcctggtgcaaggaagcccaagttgccttcactgcccctccgatgatctattgtggagcctctggcaatccagttagctgctgtgccaagcacatcccagtaatggtcactgcttataaaggattaggaattcgccaggggagagatgaaagcccatccccaacagcccagctcacaaagtggagcctctgaccctcccacagctggtggtaaccatagcctactgcacccacccagggagtctccctttctaatttttaagttcttccatctccctcttttgtcccagacggtgggtgagaggtggagttgggaacacagggcagctctcattctttcctagtttccctctgtccatccctctccccaaccaaaggcagggacaaggatttgctgtgtcacagacctacccatttgctatgttcccagggatgaccaagggaggggctgctgttttgcagatatcaacgaatgccgtcaccccggtacctgccctgatgggagatgcgtcaattcccctggctcctacacttgtctggcctgtgaggagggctaccggggccagagtgggagctgtgtaggtgagggctgctggccaaggcactgagccagccattcggccttgggacctctggttgagcccacacacggaaagggaaagaggtgggcagagggaggtggcttggaggctgttgtcctccatgatctagctgggttcccagatgacgctgggcatgagtcgccagggctctgccctctgaatcagctagggtggggcccttttctcctctttggccatattcattctggagtgactgcccaaagtcccagcagcttctgtagctggatcctgtggtggagcgaggagcctaagggtcttaggatggggccaggcccttctgcagttcccagggaggaagggtctcctgctcttctgcatctcaaaagcagcgtctaaactgcacgcccaccgcacagcggggcgctcctccctcagaagggcagcaggtctgcagtaggaggcgtgtgctcttttcctgcagccccctcaggaagaaaggctcagggttcagaatgctgggagggactgagtgttgaatagacgctttgaggctctggagagggcagacgtttcccaggccctcagggctgccactcagccacctcggcatgactggcctctctccacgctgcccgcccacccgcagaagctgcttgttgggttgggatcgtgggttgtttggttggccggtaggaggtcatgtagggttcctggcacacacaatgagggaagtcaagggtcttggacacctcatttcaagtatcctcagatgagccaaaccagccccagggcggggagacctggccccctgcgtggatacatgcagagtgctctgagttactagatagggctgaagtgagcccgggggatgggacgccctgccctgcctaggtgggaggagggagcatggcctcatggcctccccaggtggcctgcggcccctctgaaggctggttccctggcctcataactgagatgcttggagcctgccagcgggggctgcaggatggggaggaggccagcccaccgtcttggacttctctcccacagatgtgaatgagtgtctgactcccggggtctgtgcccatggaaagtgcaccaacctagaaggctccttcagatgctcttgtgagcagggctatgaggtcacctcagatgagaagggctgccaaggtacagagatgctgaagcgccccttctccgcaggccgatccagcttgtggctccctcccctctgcacaccacccttggccccctgaatccacccctggccttgcatccctattcacactgacccaacacatccctgcccagacctgtccttcccccacccctgcctacctgccagtgtcctggcctgtctgtcctgcagagtcccacacagaatgcaatgccctatttcagatgtggatgagtgtgccagccgggcctcatgccccacaggcctctgcctcaacacggagggctccttcgcctgctctgcctgtgagaacgggtactgggtgaatgaagacggcactgcctgtgaaggtaaccctggggaggcagtggtggaaggggacagaatataggctgtcttacctcccaaagaacactcaatttgtccccagtttggggctgatgccgaggggctccaggctaggctagaagaccccataaatggacctggccccaacaagagcttctattgtcataatccccaagttcagagtgaggacaggaggaaaagccagtcccagagaagagggaagctgagggcagggctgtcctgggagcgttctagggagggggttttaggaaagccccaggggctcagagagggaagccacggtgaggttcctgcattgcctggggagtgggagccctcctaggtccccgggcgagcgctgtctgtctgcagacctagatgagtgtgccttcccgggagtctgcccctccggagtctgcaccaacacggctggctccttctcctgcaaggactgcgatgggggctaccggcccagccccctgggtgactcctgtgaaggtatgagcctctgtgtgggagaggatacaaatgggatgccccctctgtcagggccatggtgaagcccagcaggtggggggctgctgaggctggaggagctgccatcatcccgctccccaagagtcgctcacaagcttgtcccagctgtgctgcctcatgaggggatgatcccccgtgggtccagctctgcaggcaggtgacaggtcctctggagacttcccccttgactcctgtccttgggaggtgctgccatcggctgtcttcctcccctgtgtggccctgcagatgtggatgaatgtgaagacccccagagcagctgcctgggaggcgagtgcaagaacactgtgggctcctaccagtgcctctgtccccagggcttccagctggccaatggcaccgtgtgtgagggtgagtgacccaggtcaccctactgggggtggggggcatgagtgtgtggggaggcaggcacatccccagcagacacccactccccatcttttccctgcagatgtgaatgagtgcatgggggaggagcactgcgcaccccacggcgagtgcctcaacagccacgggtctttcttctgtctgtgcgcgcctggcttcgtcagcgcagaggggggcaccagctgccagggtgagaagccagcacagctacctctactggccaggagcatgggaagccagcacagctacctctactggtcaggagcatgggcgctacaggctaagactagagtggtgtcccttttaataccagtactgagagcaagtgctcacggccctgcccagggaggagaagatgggagcgaggagtgatgtgagggagcccggggctcagggagggagggactcagtctctcaccagggcctcttcacgacgttgacagcaggcatgcacccactccaaactccgagtgtcacttctcccctttacagagctccagtcccagggaccccacctcacccctcacccccaccccggtgcccacctcccacagcctggcctctggcttcgagccttttcctacataagccactccctgactctcctatgggctactcagggcccagaggaagctacacaggaccctaacagggaagggacccgtggctgggtctgctgacagccatctctactctagatgtggacgagtgtgccaccacagacccgtgtgtgggagggcactgtgtcaacaccgagggctccttcaactgtctatgtgagactggcttccagccctccccagagagtggagagtgtgtgggtaagggctctggggggagggcacagggctctgcccacatctgcccatctctacactgcctggtccttagctcccatggagcagagcactttccacagatgaagtgtccaacaaatagtgtatgtattgagactcagggctcaggggctgtccaaggatgacaaaatgaagacaatcatcatcttcgtgctggcagagcacacaatctagttttaaaggccaaattgattcaatagacattaaacacctgctatgctcaatgtcttttgctaggacaaatagacagttatggatgatcttgaaagcaagggagacagatatgaagacaactctctgtaatacactatgctgaaggcttcgtgtaaagagaagtacagtgctctgctggtagggataggagacagatgggggcagtggaggaaaaggagtgtcacagaagggcaggagctcactgcttcctaaatagcatacggttctcttcccagaggctcagccctgcagggtcaggggaaatcgtcctgaccttgatgtgctggggttgggatgagcacagtaatttggaatagatcaagaaccccagaggttgtggggcatgaccctgtgggaccacagcagtgacctggccacctctgtcctctctcatggcatggctctggggacagatattgacgagtgtgaggactatggagacccggtgtgtggcacctggaagtgtgaaaacagccctggctcctaccgctgtgttctgggctgccagcctggcttccacatggccccgaacggagactgcattggtgagtagggagggaggagagagaggagagagggctgagaaaacctatttttcacatattgagcgagacatgattttctcctgaggacacgattttttgcagctgattgtagcttgtatattttccatccagcagagcttatgaaagatgccacaggactgtgaatgttaggattttcttatcctgggttgagaggctgcttttcacaggtcttggtgctaataagccaaataagtattctcagcagagaacgagagagtgtgcatgcgtgtgagagagtgagcacacacgcgcgcgcacgcgcacacacacacacacacacacacacatcctctatcctggttcccactgtcccacagacatagacgagtgcgccaacgacaccatgtgtggcagccacggcttctgtgacaacactgatggctccttccgctgcctctgtgaccagggcttcgagatctctccctcaggctgggactgtgtgggtgaggagcctgtgggctacccaaggtctgggccagggaagggaaggccctggggtcctcctcctcaactggtcctggtcacgtggctccatcacgggtccccagagcatgggcaagggaggcttcaaagaagagggagacttcaactcctcgcccaggggcacatgggccgggcgggtaaggggaagcacagccgcgctctgccagcagggcagcaggtgtcctcaagcctcagagcctcaggaggcaggaggtttggagaatgtgcactgaggggtaacccttcctctttgtgcacttctgtgaccgtttgctgccactcctctccttttttcttctttcccatgccctctgtccattggttcctcctccctacaaatctatacttactcttgtttcttccccaaggcctagcctgcttcttttgggggcagtgggctgtagtcaggggcagggggcacgggctgcctcttttctgcccacgagcctgttctcacacctggcagatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtgaggcctgggagacacattatccatggtgactcagaggtttacagagagcgtgtccctctgcatccctctactagcctctagccgctgagggggacactgggccagggcctggggcagcatagggaggtgcaggcggggcctggtgcatggaggggtgaggaggctgagggccgcgcgcagcaaaaccaggagctacagggtggcgacgatcctagaggaggctcaggaaaccctgatgctgacttagggtggccccagggaccgcagattgagccttggagggaccctgaatccatctaatccctgggaaccttctggatgagagaggacttggagctgaactaaaccgggctctccctttcccacttcccactccacccgagagctcctgggttcagcctctcacgccaggctggactaggactcagctggtcttcactgccttgggggaaagtgagggagacgaggaagggtgggaggggctggggtacatgtgaagcagaatggaccagagggctgcccatatggcatgccaggcactgggggcagcccgtcccagggaggcaggcagcatggtataccgcaaagcgcaggggaggaggaactggggtcagatccctgctgcactgcttaatagcttaatcgcacagcagtggcgaggccccaagcctctctaagcctcaatttcttgagatgatgattaggccacttcttagggttgtggagagcctcagtgaggtaatacaggtaacagaattttttccactgtaaagtgctacacaaatgttaaatttaagaaataaagtcaaggactattgaccccccttagagggtcatgaacagacagtaatgagcatctgtcacgcacaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcaggtaagaccccaagggttccagatcctcgaagggtcagctctgcaaggtgacactgaaagaaggggagagaggaagggggcagggccctccccactctgagctgaaacgcctctctacatagctgaattcagcgagatctgccctagtggaaaaggctacattcctgtggaaggagcctggacgtttggacagaccatgtacacaggtaatctgctccatcctctgccccaaactccttcacctgagtgggccctagcctgctcctccacagggtccctggggaagttctgcatccagccctggcctcgcagattgcctccaccttttctgtcccagggctgactccctgcagagtgttagctggaagttctgactcaagctgctcttggagtgtccacatgagcctcacctcagtttccctgctctcccaagctgcacctccagaaacaaactatgatgccttgactaactctcacccacagccacatgtgggcacagggacagagtggagagcactgctctagaggccagaggctgcgctcatctccctggccgcactgatgaggccagaaactctggggaacacacactcacagtaggatggtccaggtactgcgcccctcagcaccctagtcctgaagctagtcttgagaaggaaatgatggagacagagattgcttttcttgggtgctggctacacgccgtgcacttttttgagcacctcacacatattaacaccttttcatccttacaacaactctaagagtatgtaggaaccggaggcaaggcgaacttaagcaacttgcccaaagccacctagtaagtggcagagctgggattcaaacccagcctggctttggattccctgctctaggtacccctcatactgcctctcaccttcctctcacctcagctctgccttccacagatgcggatgagtgtgtgatattcgggcctggtctctgcccgaacggccggtgcctcaacaccgtgcctggttatgtctgcctgtgcaatcccggcttccactacgatgcttcccacaagaagtgtgagggtaaggacacacatgatccctgcccccaccccaggcccacagctgaataatggcccacccagcccctgccagccagtcccattattgctgagagtcccccttcctagggaggccgcccactgcagcaggctggtcccaggtgaaggagctgtgggctgtcagagattgtccccaggaggggccttccaggctgggctgggttgaggggagggaggcagggcactaactcttcattatcagtgataggcaaacacccttccctgagggtggttggtggaaaggccaccttggcaatgccccaccctttcctgcctccccagatcacgatgagtgccaggacctggcctgtgagaatggcgagtgcgtcaacacggagggctccttccactgcttctgcagccccccgctcaccctggacctcagccagcagcgctgcatgaacagcaccagcagcacgggtgagtgggcctgagcgtgggggagcaggagaagggtacctgggctggggggctcatgtgcctccgtgccctgtgccaccagaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctggtgagggggagcaaaggggataccctgcagggctgggccaggccccagggagggggatgccctcaccttggaactggggatctagaaagaaggagcagagcaaaggccctgtcttccatccctgctgtttggggacaaagtagggcaggggagaggtggggagaggaatgttgccaggatctcccagagggtaccagtccttgcatgctcccagagacaaagccagccaggctttagctggcaggagctagaacccagctccttctctccctcctccctgacagaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccaggtctgtgttgctgcaaaactggggaagaggtgggcaccaaagctgtttcacttccatctcctccacctgctagtcatattgccagcagggtgaggactgggaaggggaaagacacaccaagccagaggtccccgttcacggctcgcttgagacaagtacatacgcccaggtccgaccctaacaactccgtcataaactatcacagggacacaaaaaggtacaggacactgcccctgtcccaacctacaagcttcctgtggggactgagagagagagagaaagctgttcactgcagtctttttctccctccacgccacctacaggctgcagaataacctgctctaaggacacccagcattcacacttgtgacctgaagtgtggattaaggttttctaaggactttaaaggcccaccgtgatgactcggtttgtgaatggtgcgatccaaacactcaggccttggagtctaatgaggaagtcaagcctagcactgtgccatgcacacggtacccaccacaggcaaagctaccacatcagactaaaaccatacctctgggtagggtgtggccttttccatggggtggaggggtgcttagggagtgaagagggttaggtagatctggtcaatgttttgctttgtgttgagtgaggcccctctgctaccaattgttccccacttcccaaaaacacgatgtgaaggtttaaacaaaacacctcaccccttccccacgcccaaacccaaaaactatgtagcaacacactcctcgaccacccaaaccccagcaggagccgggcattgtggaagcagcgagtctcagcctccctggagccctcatttgaagcccagagcacctctccccatctaaaatgacacatactttttttttcaagagtactgccttttgttctagcatctttccacaagaattttatgatcctctctgcccccacccccacagttccacaggggcaccctttgtccagaagggcgagggtcccagcattagggagagtctggacacagccctcagcctcctcctctctccgatttcctcctcccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtaggtaagtgcagaattctgatggaggagtcaggctggcccactgcccacagagacgcctgaactcaggaaggctggaagagccactgctgcctcctagtggggctgtctgcatcaggctggaagggaagaaagcgccaaaggaaggtttaattatgtgctttagaaagccccttccgtgcaggttcccagacaaaagacaaggacaagagagcacggtcttgggcatggtatgagcttgctgccccctgctttgtccttgagttgcttggttttgggaagtgacttcagcctctggctgtcacacttagggtttcactctagggcagtggccagggcttactaaccagagaggtggaggcagccagcagaggcacctgggctccctacagcactctcctttgtttcctcttagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaagattgcttaaatgctccttctctttatatatttatctgactataatttacaactaaagccaggtgctaattatgtcaaaattccttaatgcaaatttgtcaggcagccctgtggcatttttatgaagagtggaaaatacggattttaaaagaacgatcataaacatcaatgctagataggaagaaaaatagaagagattccttcctttcagacaaaacatgcagtgaacagtgttaggccctgcccaaagccagctgcacaacattagcttgggtccagatttcaagggagagctgtaccaccacgatcagtgctgcccacttccctataccaggttgatcctgccaaatgccacccctgcactctaatgctttataacaaacgacaaaacaacagagctcgattctcagaagtta

SEQ ID NO: 13119 - DNA, 17098 bp, Human
tagagcttttcttagcctttccacttggttcaaaatatgggaggatattttgataagtgtgtctaggggctcacatttttcttttgcttcaggctccaacatgattcccatattggtcattggtctggaccctagattccttacataacgtgcaaaacatgcattgaagcaggcagcatcttcaacaaaaccgcatattttggccaggtgtggtgggtcctgtctgtaactccagcactttgggaggctgaggcaagaggatcccttgagtccaggagtttgaggttgcagtgagccgtgatcacaccactgcactccagcctgggcaacagagcaagaccttgtctctacaaaaaaatgaaaaaattagcctgacatggtggtgcacacctgtcatcccacctacttgggaggctgaggtgggaggattgcttgagcccaggagtttgagggtacagtgagctatggttgcagctctgcactctagcctgggtgaaaaagtgagactgtctctaaaaaaactaagaagcagcagcagcagcagcagcaacaacaacaacaacaacaaacgaacaaaccgcagatccaccctaccattgcccctgcctctgttgagcatttttgccatgcgtaaataaatgcctgctcatccgcagtcagcagtctgaggaaattctgaaaccaaattacacataggctagtgctctatgccatcaatctgtaatgtatcttgttatttgatttttacgtcctttaatacatttcctaagaagtctgctttggaaaaatcaccaaaggaattagaagagagagaataagaaaacccagaaaaactaaaaggatttttcttccccccattttttattaaaatccaatcaacctgcacagtgcgagtgagtgagtgactgtctacgctttcactaacggaccatcagtttctctcaaccttctctccataaacggagaatatcaaatgagggtctgggggtgttagaaaagggttgggagcctcagctcaggttggtgggcccgctgtgccatggagcctttggggacctctgatttcacatccgtcttggccctaaatggccttctcaaaccttccccctgtctctcctggttcttgcctcattggactcaacctcttggtgggcagctctccagagggcacccccagcctaagaagcaggcctcctcccaagtccccagcctcacgaggatagtgggtaacagggtgggctcagggggccctgggagatctccagaggcctctggtgtgttcaccaatgtcccctgacaggtcttgcttggcacagggggttcctcttagagacgtgacagggcacttggactgtggcaaatgaaagaagcggaggggcaggaacagggacaccttgcgaagaagacaggccttagccttgtgccacccctatgaggtccctaagcagccctctctctcccaccttttcccagtcctcgctccccggtcctcctcagcacagccggctccaggagggatcaattcgtgggcccgggaggaggccaggcgagcaccggctgcctggagcactgggctggagcgcggggagcgcggcgggggggcgcgggcggggcggggctggtgcgcagagctgtccagcaccccgaggcggggcgtgcgcccccggcccgccccagccgcctccgcccgcccagccagcgccactgcggctcggcgggcgcgtcacgtggctggcgcagcgcgggcctccaggctccgggcgcgggcgaggggccgggcgggaggactgacagacccacggacgctctaccggcggcacccggccgggcgggctgggcgcagcgctggggcggcccggggacgccggggccgggcgggctgcgcgccgcggggcatgggcgcgccgggggtccccgggcccaggccggccgcggcggggctcccggggcgcgggggcagcggcgggcgggggtcttccctggcggccgccgctgagcccccgcagggcccgtgacgccgcggccgatgtggccgcgcgcgccctacgggcctgcaccgccaccgcacaaagacgcctcgggagccgccgcctgcacccgggccgcagcagccacgccagccggagcccgagccctagcccgagcccgagcccgagccgcagccagagccagagccggagccgcagccggaaccggagccggagccgcggggcaggaggcggcgcccgcgggcggccgggcccggcatggagaagcgcgcggccgcggggctggagggcgcgccgggcgcccgggcgcagctggccgtcgtctgtctgggtgagtgggccgcgcgggccgggcaggtccgggtcccccgcatggcagtccgcgccgcgccctgaccgacctcctctccggccgcggcatcccgagccccccaccgcggtggctcccgcgcggagacccagagaggggccagcaccgcttgcccgcctggccccgggcctgggagggcgactctggtggcgcagccccggctcccgccccgctcggagtagcgcccggagcccgggctgagcgctggcaggaggcccttcgtgcaggcggcagccttcaacccggcccgcccgcgctgagcctggagacgagggggccccgggagctggggacaaaggccaggccggctgtcccctgaagaagaaactgtttccggcccggagttggggtgggggctggtgtaagccgcagatggggactcggggtgcggggcagggctggaggagggtgccagtgtggaggcggcttccaggggactcctgttttccctttgtgtctctcagcccccaggcaggcctgttcagtttaggagggtgcttgggttgggccagggaccggtcaaggccaggcatggggtgggaggggctcccgccctgtccgggagtttttctgtccagctttccagcgctctgtgtaggcgagaggaggagttaaatccccaacccacatggctcctttatttactgtgatgaaggagggaggccattataagaactgggggtcattaggggacaccctgtgatgtcaccagtgagggctctgtaacctgacaggtttgctgaagccactgaaatgacaaagtaatcacccccaggcctcagggagctccgaggctctggcaggcccttgccccagctgtgtgagcctggctcagtgggaatgtgccattggggagcattgagggtgtaaccccagcgcgcccaccccaacctcggtgcggggtcatgtgtgctgggctctgagctgctgggtgctggcatccctggtgagcagagcagggggacaggcgctccatgcttaggagctttggcctggctctgtccagggggcctgggtgtcctgggtgggggcagcggttcctgcttcctggccaggcgggatctgacacacatcctgaaccccgggaagttgggtttccccccaccccccgactctgggcccgtaaccccccgggccagagcagaaggtgaaagtaagggccaaaccccacggaggtgggtgcttgaggggtggctggggagttctgctttcctcctcaaagtcagcttggcacgggggaagaggatggttccgtcactagctgcgtgccctgtaaatggggattatcagaactgcctcccctcctgcctctgctgctgctgggcgagcaaagccccttggtagggggaagcccttcaaagttgtaggagcaggccagggtgcggtggcaggtgcctgtaatcccagcactttgggagaccaaggcaagagaattgctggaggccaggagtttaagaccagcctgagcaacacagtgagacctcatctctacaaaaataaaaaataaaaaaataaccaggcatagtggtgcacacctgtagttccagctacttgggaggctcaggtgggaggattgcttgagctcgggagtttgaagctgcagtgagctatgcactccagcctggataacagaacatggaggcagggaggtgggggtgaggtggtagggaccctcttgatgggcagtcttgggctgcgctctgggccttgccctgtaagaggaaggggaccagcgggccagccttgggtttagctgtggtgtccctcatgggctgctgctggtccccagcaggtatgtgggacccctgaccctttctttgtatctcccacagtgaacatctttctcaccgggagactcagcagtgcggttcctgccttaggtaagtaagcactttctctccttcctccactccttcagtcccttttgggtgagtggtccctgaagacaggccttcagggtcctggcactaccccgagttcctgtgtgcatcttttctacatcacaaaggagctgtttggctttggacaggcttcaacttgtctgagcctcagtttcctcatctgtaaagtgggtgaaataacaaggtctactcaaaacctgtctcttagtattccatgagccagtgaggcaagctcttagtgtggtgcctggcacgtggtggctttataccaccggcaagctgccgagggtcccgtggaattgacatcttgtgcctcattgcaggccatgagcttcctaggatttaatttataggagtatgactgaggggtgacacagagaggcccatgccagggaaagaaggctttattaattttcttgaaaggaggggacatgctacgccatgcagggccacctgggaattactagatttggacaagcaggagcaggggtggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactccatctctacaaaaaaaatctgaaaattagctgggcacggtggcatgtgcctgtagtcttagctactcgggagactgaggcaggatgattgcttgagcccaggagtttgagattgtagtgggctatgacggctccactgtgctccagcctgggtgacagagcgagaccctgtctgtaaaaccaaaaccaaaacctgaggtcaaggtgcagcccgggagaacaatgggggcctctgacttgttcgttgcctgctgctctgctcggtggggcaggaggtgcctgggtttctagttctgtgcagggcccggcttgctggagaaaggacccggagctgtcaggcagcgggacccctgctgtggtcgaaggggaggcccagggtgcacagaagctgtgctcactggctcctctggcaggcttgggcctctttccctctctctctgccctgagctgtgctctcaggagcccggcctcctctgatgcttcgggctggctcaaggccgggccttgctcagcgctgacctagccccagccctgtctgctgtcctggtccacacaactgatggaggcccagtctcccatcccaatttccaggaaaaggctgactggcccagcctgggtcagatgtctgtggccatggtagagtcaggggaagggggaatgagggtgtcacagcttatgaatgtgagccccaggacaccctcctgctggtgggtgtgtcaccccaaatgtgtatatactccactttcagaaaagtgcttccctggggactagggccagtcatggagcttgggcgaggaggacactgtccaggtccttgcgtttggttgtccttagctgtcaagacctcaggccccagcagggtccacgttgccaaactccaacggctgctgttcacccctggtgccctctgtgatgggagctgcacgcccagcgcgcaaggccatgggtggtgatctgggaccctagctgtcctagagtccacttctgacacctccagcattactgaccacctgcaggtggcccaaggtacccacctcccaccacagctccatgactctgcatttccagagctttccctgggattcctgctgtgtgggaccctggattgggaaacattcccccagccccttctccaccctaactaggctcagttgctccagagggtctagcagggctacctggggacctcacaggtttttacccctcagcaaaccccatcctaagcccaggtatgttgggccctgactggtcagaacacctcctgcatccccccagcctctgggctcagccctgaagctactgtggctccaacggggagggcctgggcaggggcttcatgcagtttgcaggcagctggcagcttccccggcacgtctggggtgggactcccagctccccgtcgtcggattacaccaggcaggttggcgggggtattgatcaactttggaaattggatctgcaaattgtgctttctcaggccttgcagtgtcctctcaggaatatttgatgactctttggaccaggaaaggacactggcccgaaagtacctggtcattccttccctacttgtgtgggccaccatggctccgagggcccaggccatcttctgcctgagagaagtcaggtcacctccagctgaagctcagacagacctcttgacagcccccaacacctccgaacccctccctcttccccattatcccgcaaatcatgcagtcctcccatctgccctcactgcctgcccgctgctacacagcctgtcatgaacctcacctccatggagcattcctggagatccccctcctcattggcaacccctgaccctgtgccctaccacatgcacgtctgcctcaggtcaagcagggttcttgcctaggctgggcatggtggggcacacctgtagtctcagcactttgggaggctgaggtgggaggatcacttgagcctggaagttaaggctgcagtgagctgtgatcgcaccactgcactccagcctgggagacagagcaagatcttgtctcagaaaaaaaaaaaaaaaaggagtccctgcctagaacttgcagctccctgcacagagcccagcctccctcctgcctcccatcccctctgcatgaggctgggctgctgctgcacccaccatggtctctgccaacccgctttggagaagagcaaacagtttaaccaagtttccctgatgtggaaatttccggggggcccccaggggtgaggctgtttggaggcacccgttgtcagggttttgctgagaggcagggcagctggcagttgtcccttcctctgctcctgatgtggctggtggcctcccaacccctgatgaaggggtcagacataggtctatgagggagaagggttctggctgaagtgagtgggaagagagaaaggtggcaggtgacacctggcttttcccagaaagcgtgggtgagacacctggcccccaagggccccaaggagaggggcaggtctatgtctgtcccctaggggaggcctctggggctgagtaggaatggacagcgccttgccctgcccctggccttgtcctccaggacaggggacctcacaggtttttacccctcagcaaaaaggtgaacatgggaggttcccagccacgctgactcagaggctgacacttcagcttagcatgcgctttagagatgcaatgtgggggaccataccacttcagcctcactgggccttcccttctgtggaacctcctgttcggccccctccaatgggaaagatctcttcttttggatttccttcttttttttaaatttttttggagaaaaagtcttgctgtgtcacccaggctggagtgcagtggtgtgatcttggttcaccacaacatccgcctcctgggttcaagcgattctcctgcctcggcctcctgagtagctgggatcacagacgcccagtaccacgcctggctaatttttatacttttagtagagacagggttttgccatgttggtcaggctgatctcaaactcctgacctcaaattatccccccgccttggcctcccaaagtgctgagactgcaggtgtgagccactgcacccggtctcttttggatttcttcaccctacacctcccaaggaatcccagttcaggacctcagggctctgtgaggtcctcatggccagtagcctcacccggcaaagggaaccaggctggggccggggccactttgcatgtttgggtggctgcaccctgagactcctttctgatagtttatctcctgcccttcctggctgggagcagggtgtacagtgccctatttctggggcaggatcagaggctcattgtgggggctgcctcccagggccatgcatgagttccaggtggagaggtgctggcttgcacctcactgacctgggactgtcaagggtctgatggtgacgcagtggtggccagccttgctttaggaccaagagttctgttcttatccttgatgctctcacgagctgtccgtgggggttactggctccctatttgtcacagtcccgactcacctgggccttcatggtcctagtaggcccccaggggaaggggcttcagctctcagctcatggctccagctgcccagcaggtcctcagatggacccgtccactcagggacccacatctctggagcacctgccatgcattaggcactgtgcagggccctgggacatggcacggccctacctgcctgtgtgatgttcatccatcagtcccaacaacaaaagggaaatgctctgtggccgaggctggggggagggatggagggttggagctctgtgggggctatcccggagggcttccctgggaagggaccttggagctaggggtggaagctgaggagtccgtgaatgggataagaaggtggggatagcacccactagggaccaccagggcctccagggcaaagtcccctccaatgtgagagatcggagaggtccggggggctaggggttatgggagggatgaggcagagtgtggggcagggagggggctggcgctgctgtagtgaattgtggttttgtcctaagagcatgggaggcagccagagggctctccttcctttcctgcagctgggtgccagagagtcttgctgagaaccagagagaacttggcttgcaaggtcacggtgccaggggccagccatgggagagtgaggagagagtgtcactgggctcgggaaaggggtcgtccctcacctcagtttttccatctgcaaaatgggccctgccttcatctcaggctgttgtgagaatcagatggaccagcgtggggaagggtcagggtgctgtggggtgggaggtgtggtcaagtgcaggggccagccgcctggtcctgggagggtcagggcacagcggggcagggcaggctcaccacactgccctggatggtttagaagcagagagcatggagaatggatggattaaagcgaggcccatggggctgggcatggagggctcctcctttgagctggcgggcgtgatgctttgctcaacctgagcggtatacagttggcactccatgagtgcatgctggctcagtgctgcagcaagaagctgaggcccccagaggcctacagtgattcctgactctgcccctccctaactgtgtggccccaggcaagtcgctgaccctctctgagcctgtttcctcacctggttccgagatctacctttggcggctttgcacttgtactcaggataaaactcaaattctgcacaaggtgtgatcagatccaggtggcgtttccagccacagctggactttgccacctctcttcaggcctgttgtagtatcttcattccactgaggggttctgcgtaaagttcgtctgctcccacccccagcctatgagttccatagagcaggccttattcccaccttactcagtgtgcctaccatgcatgcttggcatgtagtaggtgctcagtaaatacttgttgagtgagcaaagcctcagggaaggcaggcagggggccatcgcaggatgggctatgccggctgggcaggcctaggggtgtgggattctccactgacccgaggccacgaggctacaccttggaggtgccggctggcaggacgggttgttggtgggttttctcccagctctgccagagatgcgggggacaggacctaggctgtagtccactgcatagggttgggggctacagctgcctcaagtctagggggccctccttggcctcccgtacacaccacctccatgaagtcacaagttgtggccttgcccttggccatggccacccttggctggactcgatcccaccatgggggaggcctgtgctgaagcccccttccccccactgcaacccgcatcccaaccaaagatgggccggcctttctcggcctcctctcccgacagcggcctgcagtgggaagctggagcagcacacggagcggcgtggggtcatctacagcccggcctggcccctcaactacccgccaggcaccaactgcagctggtacatccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggcgtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgcgcatgcatgtaagataacaggtgtaaccatgtgtgaaccgtaagcatgtatgtgcacatgtgaatgcatgcacgcaagtgtgtccagtgctctgggtctccacgggcctctgtggcgaggtgcccaagctggacctcttcctggtttgagcctcgttcatggggtgtggggggtctcagtcactcagctctgccaggaaggcagggccagcacacaggccactgggaacacagcctgggactggtgggcatggtctgatgtctctgaggtggcagaggtgtcctctctgtcctgcaggggtggctgggggccaggctggcactgagcccagagcatggtttctggagggggccttggggaggggagtgaatcaggcaaagcccgggtgcttgagctgcagggacatgcagagggaaagggggccaggcagtgagcggtggtcctggccaggggtggtcacagggacatttggctggggagtcactataggttccatctgccatagttttcctaaatgccagagcccaaaaagcgcaacccctgacttactccatagctgcaatgcgtgaggatgtgatgggcatgggcagggtctatcctagtctctgtgcctcagtttccccaagggccaggtggttcagggccagtgtatctccggagatgacaagctgtcaacctgctgcagccttagccagccccgtgggcagtctcaccctcacttcccatgcctgggactttgtgctgggcccatcccagtggtcccgaggtggagggttctgggcccttgggccactgcccttttggggagggtgtcggggcagggggctcttgacttcctgctccacttcggcttcgggctgggggtactgtgtgcactgatggagggaaggggagccgcagcagagctggaaatgacctgcgtggatgtcgcaattcttcatggagcctcccgtgcacacctggatggggacagtgtggggacagagtggctgggagtggaggaaccaggcagtctggaacatgaggagtgggggcagccggccgggacagggctggctgtcctggccgtggctccagcctgaccactccctgctggtcctcggccatggagatcccacctactgcctcatgtctgggtcctctccgcccccccgcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcaggacaccacggagcacaccgtgcatgcccacaggctcccggcccacaggggcggcaccctccacagggccccggctccctgtgggatgtcccctgaccgccctgtcaatctcaggacagtggcaggactgggcatgcggatgccttggacctctcaaggtcactggccccacttcccagtcttggctagtcctgggaactcacccctaaccccaggctcaggtcagggacagagcccaccctggtgttggaggggtctctgctgccacagtgatggggaaccacctgcccgcttttggccccaggccccctggccgaagggaggctcttctgtctcctgactgtcccctgctacgtctccaccccacagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacaggtgggcgctgtgcccgcagccaggggaccgggcttcttcatcacccaggcttgctgtccccgtagctgtgggtttgcaaacgggggcctggactagctacatggaggctgccctggtgcacactggggtccctatatcttggggtgtctgggtggagggtcgtcctggaatcctgttgttgttcctgctgcaggtcccgggcagcccagtcatgtcgccctccgcccactgcttctagggccttcgagacccagatgacgcgcctggaggctgagttcgtgcggcgggaggcacccccatcctatggtcagctcatcgcccagggcctcattccacccgtggaggactttcctgtctacagtgcgtcccaggtgagcccccggagggcgtgaggcccctccggggccacttgggacagtgtgcggaggaggctggtccaggggtcacaggagcaggaggcaaggcctgcgcagggtgacctgagggcccatggccaggtggggggggtggacaaggtggtctctcgggtctcaggtcccttgggggtgtgctgtctcctgcccctgagcagcctgtctgccccctcagccgcatccccccgcccctaccctgctccaccccacaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggggcggggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccgtctgtgcccatcagggactccccatagcacgagcgaacagccagccctgtttatttataggccttttcaggaagagctagcagggcagtgctaagacaggaaacccagtccacattttagggcttccttaaaacaggcttctgagagtcgtatcttttttcttttttttccagaaaaaaacaaaacaaaacttttttgccaaaacacctcctcaataaacaacatgtaaacagaaacaactgcttcagtctctacaaaaatctcattgtggcttcgagggcttgtctgtggcaggcagcagggagggtgggcaggggccattctcctcctcttcgggggcgtcctgggggtagaccacgaaacacagctcctggccccagtgtgtcatggactctgaggacagacagatggaccttggggcctgacctctcgggataggggtgacccccagctccggacacctccccttgggcaggggtcttcagggagttgctccgtcggtacccgtggttctggaaactttgggtacatcttgggaagagacatttggtggcggctgggccctgtgttcccacctcagctgctaggacaccctgctctggggtgagcctctaagagggaggtctggtctccaggccccggccccctgtgctgggtgacctgcagctgcccggctcacctgtgagtctgtgcacacactttggtttgcttctccagaacactcccagaaagaaaatgggcacccccgtaaggatgatgatgacgccgaccccacagaccataggctctgagatgaagctgaagaccagcaggaaggcccagaagaccaagtacgccacggggatgagaaggttcacctggggaagggggagcagaaacaccgatggtgcagggcctccagctgtctgtacccccgacccctgggggtctggggaattttcctcccttccctgggagctgaggcctgaagggcaattgcacccactacaccccctcttggcgaca

SEQ ID NO: 13120 - DNA, 76986 bp, Human
atattcaaaatcaagtctcagaagaagagggctgttttattaatgggttatcattctcatcagtgaagttgtgaccactggtaaaagtctaactgctttctacaataaattcccagagaacatttaaaattattttctccaaataattgcactttaaacaatcaagaattgtgataggccaggcgcggtggctcacacctgtaatcccagcactttcggaggccaaggcaggcagatcatttgaggtcaggagttcgaaaccaggctggctaacatggtgaaaccccgactctactaaaaatacaaaaatgagccgggcatggtggcaggtgcctgtaatcccacctactcgggaggctgaggcaggagaatcgctggaacccgggaggcagaggtcgcggtgagccgagatcgcgccattgcactccagcctgggcgacagagcgagactccatctcaaaaaaaaaaaaaagaaagaaagaaagaattgttataacaacatttaaataagcgttacagggagaaaacaagctattgaaaggtaggcatttcattatctttgaaagttgcttttgtgagcctgagatgctgtcaatcaaagacagcttggcctctgttcatcttaagttcaacgtttcttccccagcggttctctaggcctttgctcggcccctcttttccttctcccctatccctcccaagtcgtccttcggctcctcagcacccattttccctgctgcacaccctcctgacaactcctgccctgaagccctgggcccgggtcacggcgggaaggtgagtgctcacaggcgcgagctcacgttaccaagttgggtcagcgtgcagagaaaagggaattgggaattggagggctgtaaaatgtaaatgtgctttaaattttacatttcctggcgtggccaggacaggctgaccttccgattacaatccgcgtcatcccgtcgcttctgcccccagcctggcgaggtcgggaaccgtttcccgcaggactttcattgggagttacgagggcgccctgtgcctggaggtggcgcgggctggagccctcccggaggagaccggcgcctggcagggggtcgtcgcggccgcagcctggacggtgtggaccccgggttctgcgacgccagatcggccccagcggcccgcacccgcaccctgcaagctcgttctcccctgcgggccgccgcaccgggccaaggggggctgtgtgcacgcagctgcgtcgtcctggaagtcggcccttctcgggatgccgcgttagtggggtgcccggccggcaggtgcagcggtgctggggcctaggcttccgcgtccaggaagctcagcgtggcctgagggtgatggatgtgggggagccgggaactcataccctcgcccagccccgggcaggtccccccccggaggggaccccctcttcgggtcgacccctactgggcgcggcatcctccccggagcgcccgcttcccacggcccctgcgggtggagctgcggccggagcctgaggggtcttttcctccaggtcctctttccggcgggggccggaggggtggtgatggacagcccgggaggggcggggcaggaccaggaagatccttccgagacggagcgcggggggcggggcggggctcgcgttaagggagcgcggaagggcgggacaggccgtggggcggggcctgggtggggcggagccggtgggggtggggaaaggggcgtaaccgggagggaccctccgaggcggagcggcgcaggggggcggggaaggcgggtcatggggcgggggcggtggggcgagtcatggggcggggacggggcggggcgtagccgggagggcccctccgaggcggaactgcgtggggggcggggcgggccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggtaagaggaaagcgcttccgaaactttctttcgtgactgcggcggggtttcaggggcttccagctcgttccgaggtcaatggcaggcgcaggtgcccgggaggcgtggggtgggctctggcgggaccccagcgcggtgggagcgggcgcagtgggcgcgggtccgtgagtggcccggcgagcggcgtccctcatgcgctaggaagcacgctttattgtgggacgccacctccaaggacgaaaaggcacatggtctctccccgcccgaggtgatgggctgcagacaggctctgaccaggtctgcgcctggcctggagtcacagggagctgctagtttgctattttacaaaatacagcatcaaggaccgggtggccagagccggtgccctcacccgctgttggaaccaccggggagcggctggggtgctttggagcactcaacccgctcagcacctggggaccacctccgccgaggactccagacgccaaatccactttggctagtctcccgggtccgcccagcgcggacaggatcctgcctctaggattttgccgttgtccagctcaatatgcagtcgtggggctacggctgtagtttggcattaaaattgggcaggggatgaggcggagagggtttgcaaatacacattttcatgcagcttgtggttgaacatgaatgggaataaaagtgaaagggtgcactttggaaaagaaatataaaaccctagctttccacttaatcaggtgttcgtgggatcttggtaaaagtatgagccccaaacaatcactctttcatcaggtagaaattaatcatctactgggtgtgtgtgtaagatttaagatgaatcagactgccttgaccttgggagagcttattaggaaatgccagagagaggtgtagaagtagagtctgatgaactcatactgaaaagccagttctttgcttgtcagatggttgctgttttttaaatgtccattttagtgtggtttttctgtgacttcgtttaaaactctggcagtgggccagccctctggagccggtttttaccccttcaactaattagttcctaggggcctgggaagagagacccttgaatcaccatcagggaagggttcttgaaagaaggaagggtgggaatgtggttgagcggtgccagtgttctgaggagcagcctgggacaccatagatggcaggaggaggatggaggtgaagagctgcctgctggacttagagtccttggagaagggaagagtaaacattgagaacaggatgtgaggaaactagggacaggctaatcagaggagtaggtagaggcacacctggagcagctaaggcactggctacagggtctattacttaaggctgggagcctcctgggcgggtctgggttcagatgacttcgagatgctgccgggaggaagggagaggaaagtctggactgtgtccaactgagtagttatgtgatcagcccaggcccactgtccctcacccccagttccagaacccaataagctttgaagaccggaaggtttgtgttttgttttgtttttataagtttgtggcagaattttggcagtgagacttgccctgtccaatggggggctagttttggtcttcactgatccctctgagtgtgaattttcttacgtttctctgcagtcttgttgatgtctttgattaagggctgctactctgggttgtaccagaatatatggtgtatgcatcttactacgtttctaatgtccaaaaatgctgaattctgaatcatggccccaagggttttcagagagaagttgtgaacctgtaggagcttttcttggtaaatggtagcaaaaactgtatcagagtgagacatggtgaacaaaagcaaaatgcagttcctgttaagaggctaatgttcaggtagggaaggaaatgtgctgagtggtgatgggaattgggggtcatcatgggtggggggtagggcgtcacccagcggctgccctgggccatgggctgggtataggcacaggaaagtggttgtgggtgtttcacactggtttgtgccagttcttgctctgcattgtgtccgtgggttcagggatgggtctcctgcggaaaggagggactgggggccgcacccatgcagaggagagccgggttggtcagaggaagtagatttggcaagctccacctcaactagaagacaaaagcaggatctgagtgggagcctgggcttcttcagcaagtgggcaccagccctggagctgtaggagagggtccgatgcggacagtggagacactgtgcatttctgcagcttttgtaacttccctgtgtttgcgatggcttgtgtcaccccgctctctttccacatactgattagcattcagcccttctaaatgaccagcactgtcccaagaaagggctgttaggggagagcgtggacacacagtctcccaagtcccatctcattataggtacctgggccagggtccccaggtgtgggagagtggagtcttgaccaatatggggatgaatcagttggcacgaggcgggctggccctgctctagctcagtctgagatggtggagcgtggaatcatatggtgtgtgttttaggcatgtcatttccccgggcaggtaagacataaatatagtaaggtaggtcttttctagtagtattgagagtgtcctactggggcaaagatggagactaaatttccctttttctttaagagtcagtttctgttcagcctgagttaatatcccacagcggaagcctccttagcaaatttcaaaaaaccctgcagtctcaactgccacttatgctgagcacaggaaatcaagttatttatagttgcagaacggtgtttcagcgaagttgattggagagttacctgattatagtgagattcttatccaatccctacagaattgtgagactaaatgttggtgcagcatgtttggtcctcaaaaggcaatgtccaagaggaacttcttatccccgaaaaatcaggctgtgtgactcagcaaaggaattgtttatgactggttactcatatgccagtgcttccagaatatctgctcgtatttaaaggagtgatcttgaagccccagaggccataatgtttagattaccaacctcttcaccaatcagtaagtccattacatctcactacgtgttagacatgggacaggagaagaggatttttattacctcactgttattactggaggccgcccaaatttgttttttgttttttttttttaaataaagaagcttgttttcatggaatggacttactagaacttttattattcagactacctagataaaattaagtaaattcgtttctttctcccaaattaaatattttgactacatgcaagatttaatcattcaaaattgccatgtatttgattatagaccagtagtataatccccctgccccaggccagattccaaaacaataaaccaaaacacacacacacctggcaacagaaattatatgtattccgagactcattcattcattttggaaagggccagtgtttccagtggtttctccttgggattgtaactttacaactttaaaactaggtaagtagttttcccttgaatctaaagtataactactttgtagtagagaagtaatttatcttaaatcactataatgaagatttactcttaattttaaccaaaatgtttcatttatttgtgtaatgaagatgatcaaagcaacgccacctgtgatccttctgtcttttttactgtatgtggcacgtggctgtgtgattttcctagggaaaggagtgggctttccctgtgggttgagaacctctgtccccctcctctgaagtttccccagtttttcctgcttctctgctaggtgggtgccttagcatgcttgtcttctcatcgtgcttctaaacttctctgaaccggatttatactcttaggtcagtagctgtcaaagaagacactaagtagtgaaagtagctaatatttaccaaacccctgctgcgcccacctggtgttttatgtgaaggtcttctctaacccttgctgtaacctcatggggagcagatcgttttctctcagtttttcagataaagaggaaactgaggctcagaaaggtcagggactttccaagccctcacagctagtcagcagtggagccagttcagacccaggcctgctgactcggaactggtactgataactgtcaccactgtatgcaatgctgcaggcaggggctggcaggtagtaaatgtgcaagatatagctgtggctgccacggctgctgctgctgcttttgtcgctgttgtcagcttttcttggcagccctgctgtctcataccccagtattggggctgaaggatttctttttaccaaagctgcctcttaggacagaagtccttgtcttgaatgcatactgggaagtcttcactctgtcaaacttttctgttctctgcctggtaatttccagacagaagagaacattcaaagaacgaacttactttccttctttttttttattgagacagtcgtgcttgattgcccaggctggaatgcaatggcacaatctcagctcactgcaacctccgtttcccaggtgcaaccgattctcctgcctcagacctctgaagcagctgggactacaggtgcctgccacctcacccggctaatttttgtatttttagtagagatggggtttcaccacattggccggggtggtctcaaactcctgacctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgctgtttcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaaacctgtcacctggagaggaaacggcacaggggaggcccagccgccctcgcctctcagtcccgcacgtctctgttagtggtagtcatggttcttgtatttccatcatgttgaggcaattgaaggaaatatgaagattcattcatctcaggaaaagcaagaaatgtattaacagcaagagtagaagttcacttgcatggaagatactgtatagcgtatttatttcttagcgccagtgggagtagctgctaagcccaagattgtgttgtgaggtttgaataggtcaatgtgtgagtcatcaataaagtaacatcaatcattttgttcccgattaatacgtttgctattttaggatgcgaaggactttaaagaagcttattattctgaaaagcaaagcctggagatttccagtagcaaaacagacacagtctgtggacaatctcagtgtacaaataattcacctctggcatgaacccaaagaatttcagaggggaaggaagctcttaaagattacgtcccctcctacttctttaatgagggctggggttcaaaaaccgagtaacttatccaggctcacataactgtaggtgacagagcccaagctggaggctgtggctgggtcttcagactcctttcttgacagtctgcacctgcataaactcagacctttactgagaacagtgcagccatagctgagagaagcagtcggcacccagcatttcttggacttgtctgccaggtcccccgagtgcagaggacagtgtgctggctcctggggcctgtgggcccggccaggagcagccttgtaagctaaagccttctttgaaggtggccgtcttaccgtaaactttcatggtaatttcagtctactccataatttgtctgagttaattttgatggaaacatagtgttttaagtaatcagttaggctttgatctctaactttatgccatccaaatcttcatgatggcctgagcaccaggcacccagacctgtgctctgaattgtgccggggctggttcatacagtgtgatggagagacgagagatccacactggagttctgaagctgtggttctcaaccctgtctttttacaagttccttaacttccttactagcctgaaatgaaatgcataggtgagaaagtcaaccagcgcacataatttcgagtcaatataacatttccttaaaaaataaaatacaggtagtttatagtaacataataagaattttgatatagaaatactcaagaccaagtacaccagcagttgaatgcagtgatgagacctgcacacacctgtgcctggcgtcacagggaggctgacacaggtgtgttgcactgagacccacacaccacccctcatgttgctgtctatgacgtgacattctacaaagttgactaactctcaggaaagttctgaacaaagccaagtatcatcatcttccttcaatttccatgtcgattgcattcctggaatagttcatgtatatttgaactgtgtaaaacatattttgagtttatatgtaagttgcaatcagtttgtaaatccaaaaattaaaaatagtggtttttcttttcttttttttttttttctttttttttgagatggaatttcactctgtcgcccaggctggagtgcaatggtgagatctcggctcactacaacctccgcctcccgggttcaagtgattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaagggaaaagttcttcccatcgcaggcgtgtctgaatgcgggatggttggccgacctggccctgcccccccgccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggaaccgaggtgagcctcccttgcgttgcggaggtgctagccttgtgccgtccgttcttgtccatgtctgtgcaggagaacatcacccggcccacttggttgctgtgaatagcaaactttagaggccactgcatctgagggttggggggtttgcagagaaaacaaaagttggtggctgtggctacttcctatagcaaagtggctcaggaaagggatcccgtgtcacagcctgggtacaccacggcccctccaggagcttgattccttcttagctcaggggaagaatcgcacaaggaccgaggcccctgcttgtctgtgaacaaactggcctttgtggccacttcaggcttcggctgcatcatattcctgtcacattcacgtgagtgaacttgaattacatccttaacacttttccaaaaaggttataaactagactggtgatgtatcatggggcctagaaaaataatgctgctgctttttcacttctctgcttgacgctaaaacctggaggcgaaaatgaatgtgtgtaattaataggagaacttcctcctgtttgcagagtgctttacagctggcaaacggcttctctccctgaacagccccgtggggcgtcatttccatctgacatctgaggagagctgctgttcatggtccagtcctctgtccattggcccactgggtgtccctaatatgcgctaacaggctcctggcaaacggcgggcatggcagccacgaatctgcacatgagctgtatgccctgggtctcccctgggctctgcggggggaggtgggagccgcctctggttcacatgcggtgctttccaggctgcagggccttctcagcctgggtggaaggagtgacgtcagagtatttctcaggaactgcctgccctaaagttgtggctcataaaccccttccagcttctgtgtagaattctggacccctagggtatcaccacagattttaaaagcagagtaagaacatttcctgtgactgtagggtgagaggccctgggatctgtaattctacactaggctggaatcccagaaaagcttcaatgctcaggaaatgtatgagcagtgccaggatcccctgaaggagtgtggggcttttgaagcaagctgcccagcgagcctcccgcagcacctgctgtccctttgccagcagtcagggcccctgccccaccagtgttggttgtgtttctgttctttgaggagaccacatgatgatcttctggtaggagccacaagaaggatacaaatgccattagagctgctagagccccagacgtcactggaattggggttcagggtgttgggctgtccccacccttaggcagtactcccactgcctacaacacctccagcgcaggctgaggccatgcgaggatggaagcacatgtgggctaggccaggagggcgtgcgggagggctctccactctgcgctccgctggggtttctccttgtgtcctggtcaataacttcttctctctctggttctccttggcctgagcccccagcctgagccgggctgtccctgagttccctgacccggaagaagggacggccattatctttgggtgactgtcttcttatagctgggaatctctggggctctgagcgggaggcccatggggagccctggaagaacaggcatgggttagactgtttacctcactgccctgtgtgccctgccccggtagaagccgtttctgctgtgtggttctgtctagaactagagcccctcagggccctctgcatgccgtggggtccctttgcaaagcacctcctaacatgtgcttttatctgtggctcgggatggggatggtgacttcttcacgcagtcttctgcaggcctctccagcctggctcccgagatgtcacgcatgggtccatgcagcccagaaaagaccctgcagggggagaagggtcactttggtgcctatctccccagctggcctgtgggctgggtgcctggcagatggggctcccagggaggtgcccccatagacttgggctccacagcaggctgtggggctggcattaatgtggctgggagagcctggctgtctttttagccatttgtttcggaggccctgggggtcatacttgtgcttcctcgtgtatttttagatctcttatcaccgtacacaccacctccctatcagagggctgtcatattcacatatggtaaaataagacgcaacaatagaactcgagtcgtggttcggctttctaggattaggacaaggaggcaactttgatagtaaatggaatctttttttcccagccatccccaccctcaaagagtatcttgctgtaagacctagttcctgtaaaactctgtctgtggggtccctggccaggatgggtgggatcccagggaaagggccaggctgtgtgttctgaacaggaatggttctggaccaaccattgtgggcattcctgagaagccagggagcctggatcttgtcagaggagctcctccctctgctccatcctaaccccgcgggcagcagcaggaactgagagaggacacggtgggggcagcgctgcaaaacccagcagcgggccaccttccagcagcagaaagcatgagttttggttttggggctcttccatttccttccttcttttctttctttttaaatttttgctctttgttatgaaacagcagccagaccgagctatgcatgtcctgctgcacggcaggggcccttatcttgaacgactccacatactgggcaaggaggtggcagggggaggggcttgtgggaacccagatctgggatgggactcagccaacagtttaaagagccctgtgcccccactacccagcctcaacaattgttagcttatagccgtttacaccccacccaggttatttgaagacaagtcagagggagataatttcactgtactcctaaatgttttagtatctcagcaaagattgtatgggcagagaaaggaggcttcagggtgtaggaccccaggagcaggcaagggcttgctctttccctgttggctcctgtagggtggggacagaccagcccccatgaaccctagcgagggccatgccaagaagccgctgttctaatctaatcagtggaggatccagcaagctcggatgggagggaaagaatgactcaacctgcaggccgtctggggtatgcacagtctcgtctcctgagttctctgaagccctttgcagtttttgctttgtatcctaaactccacaggcccgaaccctggcactgagcttgatccgctgcagcccagcccgttcctgtccccatgctggaagcagcctgtcaactcacttccttggtttcctgttgctcttcccaccccatacctgctccccacatttctatcagagccctgtttctaaaacaaaagtcagattccgctgtgttcttaaaacccttcagtggttctgaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccacatttcagaaatccctcccactgtctcaagcagtgctgagacagcatggcacgttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgtctgccatctgccgtgccctgtcaggctgctgtgccattcttcgcagtgtctctggggaagaattttgtcgaaactctgcagatgttcttttttttttttttttttcaaggcagagtctcgctctgttgcccaggctggagtgcagtggtgcaatcttggctcaccgcaacctccacctcccaggttcacgtaattcttctgcctcagcctcccgagtagctgggattacaggtgcccaccaccacgcccagctaattttttgtatttttagtagagacagggtttcaccatgttggccaggctggtctcaatctcccgacctcaggtgatccgcccacctcagtcccccaaagtgctgggattacaggtgtgaaccaccgcgcctggccaactctacggattttctctcaggcatcttaagcaagtggcaagagttattctgtggctaagtgtgtagttttgtgttcgtgaagatggtcatgcataggttttgtgccagtttaaatgctggctcatatatttgttggtgttgagttaggcagattccaagaattgcctgtaagctaagttgccacttccggtattgccagcactttgttttccacatatgagtcatgtgaggatcgtaaggggggtagatgttctagaaggcaggggctgcaaggatttggaattgtattcagtgacaaatggacttctttctgaattctaatgtaaggtggagatcgccatagttgacctgtcttggaggtgggcttgcgtgtgtccccatgaggaattgatgccctaacatgattcatccatggggttcctttatcagcccaagcccatgtgcctcccagcaaaggtcattgttttttagtctttaaatgtcattatccccaagtgagggacagggtaaacctgttaggctgaaggtgggccatgatgggaaccttttcctgggtggagggcagacccccgagagcagcggggtctgacagggcattgttttggaggcctgcaagtctggagcaggtgcaatactgcacgctcaggcaggcgagctctgcaaggacctttggccagacccgagcagagctaagctggaatagggtggggtactgagcaggcaggcggggaagtgggtgggcgtgcaggtgcctgggacccccctcagctcacagagatactcgccctgtgagagcaggagtcacctcagacctcctctccttctgttatctgctagtgtgtaataaatatccacaattcagcggcttagaataacacacagttatgatctcacagtttctgtggtcaggagtctgggcacattggccaagcgcagtggctcatgctggtaatcccagcactttgggaggctgaggcaggtgagtggcatgaacccaggagttcgagaccagcctgggcaacacggcaaaaccctgtctgtacaaaaaaatacaaaaattagctgggtgtggtggcacctgccctgtagtgccagctacttgggaggccgaggtgggagaatcacttgaacctgggaggcagaggttacaatgagctgtgatcacgccactgcactccagcctgggcgacagagggagaccctgtctccaaaaaaaaaaaaagagcctggactcagcctctctgggtcctgtgctcaggtctcacaaggctgcaaccaaggtgtcggccagtctggggtctttctggagttcaggcccctcttctgagccacgtgtttgttggaagaattcagttccttgtggttgtaggactgtggtcactgttcctgctggcgtcagtcagccaggggctgctctcagctcatcgaggccccctcccactgggcagcttgctttctcaaagccagcaaggacactgacttctagaccctcttttaaagggcttgcctgattagggcaggcccataggataatctgtcttttgagcaaggcagtcaactgacgaaggattttaattatttttttaatactttttgccatgtaatacagcctaattacagtggtgtcatccattatgtccatggtcccacgcactcagtgggagaggggtatgcagggcaggtacactagtggtgggagtcttggggaccaacccagaattccacgttcccacacagtgggagaggggtatgcagggcgtgtacaccagagtcttggggaccaacccagaatttggccgactgcagttgtctctccctctgttcccttctggtggcccttctttcccccaaccctttcctctttcttacatctcacccctctgctcctcttcttcttcttgcatggcctcccttctcttttcccggcccctcctctctgttcctctgccccccaacccccaagctggtgggctatggctgctatgaaacctcgtacctgctctgtactggcttagaaactgagccaatggcacagagccacctgccttaccaggaagggctgcacttggcgtggccttggtcactttgctggcccattggtagggccgtaggacgtcactctaatgcctttccttctctgtctcctccctctttgcttttgtgtagacccaagagtcctttcttttgtttgagacagggtctcactctgtcacccaggctggagtgcagtggcacaatcacagctcactacagcctcaacttcccaggctccagtgatcctcccacctcagcctcccaagtagctgggaccacaggtgtgtgctaccacacctggctagtttttgtattgttggtagacacagggttttaccatgttacccaggctggtctcgaactcttgacctcaagagatcctacctgccaccgccttccaaagtgctgggattccaggcctgagccaccatgcctagcctggccccaagaggcccttcacaccatgtaatatggtcttggaaattgaaaatggcaacaaggtatcaaaatcctgatgcagttgtgatttttgacaccccttgatttgaaagacatggggtgggttgataaaggagccaagcgaatagaacaaattcctcatgaggacacaaccaggcaacctcaagacgacagatcaagtgtggccagtttgcaacttagattaaaactgagaaagaaggtacatttgtaatatagtgtaagtctaggatgggagagagggacgtccctgtcaggaccacccccatgccaggagcttgctggccacctcggaagtcccattttaatattatctaggagccggttgtggtggtgcaaacctgtagtcccagctactcaggaggctgaggcaggagggttgctagagctcaggagttcctggctgcagtgagctgtgatcacacctgtgaatacacacacacactgcacttcagcctgggcaacagaacaagacctcatccccaaaggaaaaagaaaaaaaaaaaaaaggaagaaaaaaaggaaaagattatgtaagacgtctgaaaactgtttatagaaccattgttggaaggattacagacgtattctcaaaaaacacttcagtagaaagagggtggggtttgtttgataccagaaaacctgcactcagtaacacttatgccatcgagcttacggggctgtggtatcacatgaagcagtgaatacgcatgcagtttttaaaatgacttgtaagttgtttgtagaaacagttcagatgccaggctcgatagcatcatgtccattcctgctcaagcatttgaaacgttctcacggagcagaatgtggcagaacagctacaagctgaaaaatacttatatggaggctgatttttttagtgcaaggaaggactccaacagctagaaccgttctgctatgatcttcattgtgttgggaaaaggtggactcccagcacggctgtgttttaaggggaagctgagggtgcgtgtgtgctgagaagtgactggacagcagttcgctgggattacagtcccagctccacgccagccagccctatggcctcagatgggtctggcagcctctccaggccttcactttctgctctgtaaagcgaggggttgaactggaaacctggagtagcatccagctgttaacactctgctccatgcatctgtcagagctccagaaggaggctgactgcccagccctgccacctacaggctgtgtgaccttaggcaagttacttaccctctctgtgccttcgttccctcatatttaaactggggatggtaacagtctcggcctaatgaggctgttgcaaggaatacatggcatcatatccataaagctcttagaatattcctgcctagcatgtggtaaggacttgataaatggtagcagttcttataactatttctattgctcctgaccacccttttactctatgaatctggaatttattgctgtatatctgttaaactctgaacaagattttctttccgcatcatcactgctgaccctgtactgggaaggtgcccgctgctctgtcctctaataagatgccctgtccgtttcaggcggaagcccggctcgctgcaaaacgggcggcccgcgcggaggctcgcgagatccgcatgaaggagctggagcggcagcagaaggaggtaacgcttggggctccttgttgggtcttttcacagtgatttgcgtgctgggcccagggtgcaagtgcaggcacctgttgctgcagacgcacctggctgtctcacgttgctcacggtcagagtgcgtttgcgcctgtgacttctgcccaaggtcaggccaggagtgcgcatagcacggataccaggcgtgcctgctcagacctgctggctcctgagaggggcttagaagcctcttgcctgcgcagatcgtcgtttctagctgcgaggagccaaaatgttcagggtctgagctttaaggtctaactgttgtactagaatctagatcctctggattaaagtggaaaagaagaacggattaatgagtttttaaactggccaaattgttttatttaaaaatatgtcccccgtggtttgtacagtgttgatcacacacgggctccaggtttcaggatatctagagcccgtgtgtgatagagagacgggaatgaacacatggatgaaacagccaggaagaaattcctccctgggaaaatggctagcaatgtgttgacacacctgctcaagccatttgcaagttattttcatcatcttgagctggagctaggagtcatttctgacagcataagggttctttaactcacagttatggtgtgactttttctgtgacctcagagacatagaagctgagacccccactcagtccatgttctcccgtgggccatgccctgtggggccaagggaccatccacactgagcccacccccaagagcttttcttcttaagaagatgtgaatttattttgttagacagaagtaaccagctgccttccccagggttgattttaatacacaggttgttgtttggcttacatagccaaatttaaaaaggcgagccagtgtttaaaaccagtgagatttcggataaaaatctgaatttccagattctcttatggtggttgtagattccgccacattcccagcaaagaccaagctggccacataccctgcagggtcagggccctgccacaggtctaatgtgctcattgccctccgctgctaggagtttgccgctccatgtagaaacctgcatgcagaggctaggcagtgtcaccaagccctggaaccatcctgcacactcaagctctggtatccatagtggtgccagaggccactagaaggaatagtgcttttattctgaactggtttttaaatatgtatatgtataatttttttttttttttgagatcaagtcttgctctatcgcccaggctggagtacagtgacatgatctctactcactgcaacctccacctcccagattcaagcgattatcatgcctcagcctcccaagtagctgggattataggtgcgcaccaccatgcctggctaatttttgtatttttaatagagacggggtttcaccatgttggccagactggtctgaaactcctgatctcaagtgatcctcccgccttgacctcctggcctcccaaagtgctaggattacaggcatcagccaccacacctggcttaaatatatgtattttaaatgacaaaatctcaggtgctttttcacactgcccagtatcagtgtctctgtagaatgtgtctgttcatacagacacatttagataaaaacgtattgattgtatccttttttttttctttttttgagacagaatcttgctttgtcgcccaggctggagtgcagtggcatgatcttggctcactgcaacctccctctcctgggttcaagcgattctcctgcctcagcctcctgagtagctgggactacaggtacccgccaccatgcccggctaatttttttgtcatttttagtagagatggggtttcaccgtgttagccaggatggtctccaactcctgacctcgggtgattcccccgtttcagcctcccaaagtgttgggactacaggtgttagccatcacaccggccccatattagaattgatttaaatatatacatattgatataagatataaccaattagaattgatttaaacatatacatattgatataagcagcttgttacaaagttgttgggcaaaagttcttgatttaaaaataactaagatgaattaaggcaagcagtcatcgatttgaatggccccctttaaaagcaaagcatccctttattcctttgattgaaaggaagcccttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaacataatgagacccctatctctttcaaaaagtaaaaaaataaaaagtagttgctactccagatgggaaaccaagtcttgggcatttaattttagtatcatgaaaaaggggtgcagggcagccctcactgatgcttctgatgagcacaggccttgcggagaacatctgatgaaatcgggaagtctcacgtaaaacgccatggtttgccttcttcagcatgagtacagatgtcatttgcttagtagatggcattcacattttgaaattcttctccctacagcatggttttatcataaagatatttcaggggtcacaggggtcaagatatctcgccctgttgcaaattcggcggaacatccgccactgagagcggtggttttggtctgtgctctcaccagcagggaccggaggagggggtggtgtcccttgcaggcagcacctttggccaacgtcaccttttgcacggtcctctgtggatctgcagtctcggcttcctcatcaccgatgcctgcacttcttccctcacgaccgtggcttgcggctgtgacacagggcgggcgtcgtgggcgcggctgtggactcctgcctggggttggtcacggaccaggagccagagccacccaaatttaccaggttgtggaatgagagcctgggaaggtgggggacatgtcaggaggggcagagaaatgaacgtggccaagatggtgagtgaggacaccgagtgaagcagctctaccggggggtggggaagccactccttgtggcagcagaggatggacatggcagacaggaagctgccctgggagacgagagccagacgaggaagggccagcccagtcagcccagcgcagcacgcgttcctaacggcggcaacggtgccttcatgaatttcgggtctttgcaaggcggcagcattcctgtttaaagtttatgtctgcttcttcaaaagagggatcgaaagatcttaaataagatagatgtgtatttcgtgactagtcagagaagcctggggcggggggacatcccagagctcctgccgtgtggcagagctgggcttggtgctgtcacctaccactggtgacgggcatcttcccaaactttacaggtgaggaaaacaggccttagggagatacacagttttccccaaatccaagaaaatagccaagccaagattcaaatcagatttgaccagatacaaagcctgtggtcttcctagctcacccctctgtctcaaaatcagttctgtaccaacaataaaaacaagagtggaggagggagtgaatccgtgggccatggggttgaagttcacattgaggacgctggcacgcacagcaaagggggaaacagaatgatccacataatcctagtcactttccaagtggaagcatgccttgaaaaataaagttctccttggtgtggaatttgaggcacaggaatatgaaacataaaatatacaattttcttagaattttctataaatacagaatgagtagctttcacctagctgtgcttttatgtgacccaaagggtggggcagaggccaggaggaatgtactcgtgtgtgcgcacgcattcgtgtgtgtgcgtgtgcatgtgtgtgtgcatgtgtgtgcatgtgcgctcacacacgtgagcatctgtgtatgcatccagagggaagagtgagtcgagctagtggggtctgagcttgcacgtcttcgggccatgcctggaggatttgggaaggtgcactgacgacacctccctcacgctcttctttgcatatcacatctctgggcctggctattattagaaccagctaacataatttgaggttatacaatctggtagcttggggcactggcattttaagttgttgattaaggggaaatgaatacgttttggaagaccagtgtttaaagggtagggttgatactttggtgtaaaaattgagaaacctgatccctgttttcatcggggtcacaagccatcccacctgcatgcaggcgtttctgagcaggctcagggttttcttgagggggccgctctgagaacaccgagaagggcaggaagctgaccggggttggtatcccccaaggaaagcatggagcgtgtacggagaggggaggtggcgaggagacaccagtgtcgggggcagccctgtccccacagcattatcagactccaggccagctctagcccaccctgagctctctttcttgaatggttcttttcagcacacagacggcgagaacccactacagcttactctagctgcgttccggggtctgtttaaaaggatatgagctcttttttaatggatttgttaggggagaataatgtacatattcttgggaaattcaagtgaaccttgaacttcttagggagaacctacactgatagaagaaaatggtgatcatttctcttttcttgctgctgacttgataaacattttggttagagatgctttgtttcttacagtcatattgttggatgtagtcacatgtgttcccccatataagactagaaatgccaacttcttggtctcgcagttttggcagtgccttcaataatgcctgatatgacaaatgtcttaatgaatgaatgaatgaatgaatgaaaatgagtagctatctcagttttatctagtgattactacaaaattaaaagaaacctctgaagcaaacgaatatgtcaatgtatgataataacctcttttaggaatatttctgttatattctaatgatcactccatttagctggaattttcctgttattctgtgtgtgtctgtgtgaatcagaacatcaaagcctctttcttcattatttgtgaatttgaccagttaactttccaattaagtttctgtactttttgattaaacttttattaccgcaaaaagaaattctgaattaaagatgaaggaagtactttttctcattgatggcaataggttatacagacttctgtattagaataatagcagtatttttggtaagattcgtgtggctatgcccctatttccccaatgtatctaaaatgaaatgtaaagtaagtgataaaattacaaactcttgtcagtgggacctcacctgttttcttattcacattttactgtattcgttgtgacttgattcatatgtctagttacttacagaacctttcattctgatgttactgcttctttaattggattttacatttcttttttcttctgtccttctctatagatctatcaggtccaaaaggtaggctcttctttctttattttctaacttgcatgtactgttttttccttgccaagggcctggtcacctttcagaaataacaccttgcactgaagatacatagaagttcttactgtttattttactactttgtgtatgaatttgtttgaacaagaatgcctagatcctcatcttgccccactcaaagcaacagtcagacacatttctgtgtactgaatgcttttgtcatctgcattttcctcaagaaatgtaaaaattgtttctttgagaagaaaagtaattctaaggcaaaattatatttcagaatgtggatagccttctgaaattatgtatggaaagaaaaagatgattttattagaaaacttaaaaaattccatacaaattaccacacattgagagattattagatattgagttaaaaatctgagtaaaaggacagtgatgatataaaatgaacctgccattcatccctaatgctcagagatcataaaatgacgtgcctctctgtttcctagtattttgtagaagcagctgaggtttagaagtaaatacactgggcaggccagatacagaaaataaagacaagcaagtcagtgattcaagatctagcaaaaatgaagtcagaagtgagcgagttccttgagaatttatagaatttgtatacacgggagtctttcccataaatgaatttagtttgatacttaaaacatctgtgatagtttccttttataaatttagtttctagacaacaactgtatttttctcttagagcagatgagaaaatcagaataagatcacttaatttcggaggttagagcacacaggcctcggaatgcacgggcagtaaatttaagagcctgttgtgttggattcctgtgctggccatgatgacgaatcgccttccctgctggagccctgcactctgcatagctgctgtcccgaagagtgcaaagaaatttgttaagtagatgccagaatctcttgtgcttgactagtgtttccagggcccaagtgtagaaatggatattgcagctggagttcctggtcgtcctcagagagcctcgggaagaactggacaggtgcaaggccaggcggggagccctccctgtaactgacagcaggacgctctcatccaaaacctggaagaggggctctatctggtcgtttccacttgcattcatgcctttcttgtgctaggtcacattattttctttttactaacgtgccagggatacattgtgagaactttgtcagaatgtgaatttgtgtagaatgtgaagctagaaggagccccggaaacctgcagtggaggagcagaggcacagttttgtagtaaaggtgtgcccagggaagggaaggctttcctcattgctgagatgtctggggaggagaggaggcggcgattgcgcctccggcccagccagctgctttgcggaacagtttctctggaatcaaagctatttctgaaagtagcgcggctcctgcttccctccgcatggcttccggatcatggtagtgattgacgtttgaaatgtttgcccttcctggactttgctgtgctagtgctgctggctaacccaggaactactagttaattgcacttgctgttactaggggcgttctctccccaggaatgacatggaaatgcagttacagtagccacttataagaccacccatgaacgaggtgaaagattttcagaactggtcctttgtcatgaaaagagcaagttagagtgtgcagatataatgggcaaaaagaaatctatgaaaacagaaaaactgacagtacagattcttttggaatttaaataattttattgtgaatttatatagcccccatccttctaaaaacatattttgcttccctctttctagttaagccaaaaaataagggaggagtgatggcatcatattttacttgtgaaaaatctggaacttggcaggtgctaacattaattgaatgcaaaatagctttaagctgatgcatttccctgacattgaagttaaaacatgactttgggatgtttgtttttatttcctttctgaatttatattccaagggaataacctacagaaaaagatatggctcatgtcctttttgtcttttttgtcctttttgtactcatgtcctttttgtattattgaatttttaaaagtattgttaaattctccctcctaatttctgctcttccaattttctacttactgtcacctctaagagaaagagataagaccgtctgaaaactgcttatttttaaatctggccgcccttcgaaatgaaacaaaaccaaacatagcaacagcatgtttttggttattgtaaaacaatttcaaaaatggtcttgtatttctagcacctgattttttctcttgattataagattttaatgtatgaagagaaaactcacatctgtgttataatgatacggaagtttgcttagttgtttcttgattttcttactggaaattaaataaaaaggagagaagcaaaaccccattatttgggcccatgacctggcttcccacctacctttgggattccctgattgagtggcagcagtagccgttctgaatctgcttttctcattttaacttggaccactgaacaggataaaaacatggaagtataagctaaagcaagcttgtccaacctgcgggccacatgcagcccagaatggctatgaatgcagctgaacacaaatcgtaaactcttttaaaacattatgaaattttttttgcaattttttttttttagcttatcagctatcgttagtgtagtttatgtgtggcccaagacacttcttccagtgtggtccaaggaagccaaaagattggacacccctgagctaatgtcacctccagacatacataacttgtgggtctgcatatttttcttctgtacaaagacctcttctgtaggtggcagtcatctctccatccctgctacaaagacagcaaagtctatgaattctcacaggcctagactcagcatagacatcaggcagctagaacaagcgtcagcacgcagtttctccccttctcctctcagtttccctgaggtcccaacaccggaatggctctgagcttctgcttctcttcgatggtgttttattccttcatcgcgtttgctttgaaggcatgagcagcctgttggagggggcgtgaaggctgctgggccggctttactgtcctgctctcccccgaggcccttcacctggggaagcttcgtcctgggctctcttgctttgccgggatggggtgggctgggaggatctctcttcacagctcacagcctgcatgactgcacgggtggcggtccctgtggagaagccaggcctggtgccgactgctttgccttggcgtgttaccttcaccacacggctggatggcggtttggaaatgcatgtcagaacagtgccttagacaactgcctttttaagaaatttcacttcttgcctaattttctttcccttctgtctatagaaatattatgggctggatacaaaatggggtgacatcgagcagtggatggtaggccttgaatataattttgtttttactcttccctccccacttgaatacagtgttgagacttaaatggtttataatgtaattcttacgcagtttaactatgtagatagattcctattgcaccataatttaatactgagagattttcttccggggatttctgcatctggtctctgtttacatccccaaacgcagcctgcttagaaacagtcctggtcttgcctgtttggtagccactgactgctgatgtctcctggccagcagtttggggaggtctccactaccacagccgccctgatctcctcgagcacagggctctccaccaggactcgggctgggcatgcgcccctggcttgagaactttccagagaacattcccattggcttcgcagctcaccaggctgtggttggaacctgagaggtacattatgctccatttccttcactcatgattacgaccagctgccccatcgccctcatttagactttatctgcatttgctgttgggttctctcttcatcttgtccgctgtgcctgccgaaaccactggtctttggtaagaaaactcctttaccttctccacctgcttcctagaacagcccctctgccttcctgtggatggagagctagcctgcccctgatgatactcctgtccttctggctttctcaggaagcagcggcacccacatagggaggctgcggaaggggcacaatctgtgtgctttccactggtcccgagagagagtggcctggcccttctcgttagttcctctacccgagtccttctacctcttcctgtcccttttgctttattgcctggcctcgtggacttcatcacatgcttttagcatttgagaacctggccaggatggaaatgtcctattaaatgttccttatacataaaatgatctgaggaaaatccaaaattatttcctaacatcttacgtactgggtataaaagaggttcgctcttcagatatacagagcacacacttactgtattgaaaatatgattacattcagcctaggcaaaccatcattttaggcttacatgacataaatgtatttttgttaaatcttaagacatttctgtccacaggcatggtgatataagaaagagaaaaaaagaaaagaaatatttaaaaaatctttacacattctttgaagttgtatcattgttttatataccactgagaaagaaaaaatgctaattataactgagcaacttggattataagatacatccccagcttcagagatgtccaagtgtgaaaaaccgtgtgtgtcttagaatccacaatacatagtagaaagagtgacatccttttcggatattgtgtggaaatgatttatcttctgattcccgaagagagtgaggttctgaaagtaaggggaaaagtagattgatttaaatggatcagatgatagaggttagaaaaaaattaagacccagcttctgccccaaacactgtttttacaacaaaaatgaagtatgcaaattatttttgtgcttaagaacctcccaccccagaaaaaaacatttttacccactggtttaattaaagcctttaaatgaaggcaaagaaaatatttatgtgacatttagatcagaactgctgtattatggtgcagtgggactacctaagcttttttaaagcacttttcctgtgtccatctgtctctaaccttttcatgctgtttcttcattgttaggaagacagtgagcgctactctcgtagatccagaagaaacacatcggttagtaccgtgttcattcattacttgggcaatttgattgaattctaatttatgcttgcagtggctgaagtatatataatatattcaatctcttaatgatgatatcatctcttaaagaaattaactaatactattaatgatagaatactgatattattacctaaataaagactatgaacttagcttttagcattttgacctaaatttgataaggagagtgtgtttgagaaatttttcagtattaatatattcatgacagctgtagtgctttttgtgccattgaatacccataaataatctgcatagtaatatacaccaatgctgtgtatttatattacccgtgagataaagaatactacttggatgaaattactttttttttttttttttttttttttgagacagagtctcgctttgtcacccaggctagaatgcagtggtgcggttttggctcactgcaacctccacctcccaggttcaacaattctcgtgtctcagcctcccaagtagctgggactacaggcgcctgccgccacacctgactaatttttgtatttttggtagagacggagtttccctatgttgcccaatccggtctcgaactcctgggctcaagtgatctgcccacctcggcctcccaaagtgctgggattacaggcatgagccaccgtgcctggccctgaaattactttttttttgagatggtgtcttgctctattgcccaggctggagtgtagtggtgcagtcttggctcactgcaatgtctgcctcgtgggtccaagtgattctcatgcctcagcctcctgagtacctgggattacaggcacgtgccatgacacccggctaatttttgtattttttgtagagacagagtgtttcgccttgttggccaggctggtctcaaactcctgacctcaagtgatctgcctgcctcggcctcccaaaatgctgggattacaggcatgacaccacacctggccctgaaattactttaaatccatattgcccataagcagacagagatccacaaagcccatgctgtggaggacctagactggtgtcccctgagatgtccaggggtggctggccccctcactgctgtgggttggggtcagttcccagcatccccctgaaacttgggcactggttcttcatgtatgttgtatgattccttcacggttgttctcgtcctttcttttaataggcttctgatgaagacgagcgcatgtcagtgggtagtcgtggaagcctgagggtcagtaaccagaatgatggagtttgcatggcacagtttctggtccaagccctttactttctcatccccgcattctgatttcttcttcattatccccgtggtctgatagtcaatatttaaccgatgagatgcttacttaaaatcaaatcaatgggggatgtttctttgttgctgtagagagatgatttatatgcataggcacgttggttgtttctttctcccgagatgaagtcatctttttttcaatacttatccacatcacaaagctcccaagccttgattagcacagttgtctcagcacattggtgttccacaggaatgcaaaggcgcgtctgccctttagtaagtctgtatccactgacacccatgctcctggtaaaatcggaacctctattaaagtagctgtaagttaattattattgagcaatgttttggcatagccactatagactgcctgctgaaaacctggaccaggactggatccgtaaggtctgccttcagccgcttttccttgtatcagttataattagatctctttaccactgataggcttaatggttaatcaacacaaatatggacttttccttaaacattccagaaaccttaataattatacttgaaaaaagtgtgagtttggggggaagtaaaatagaaaaactatgttttgctcagtgctttaaatcagtgaattaacctgagcatgtcagtttcttttactgcaggattgaaattacatctcaccgctagtaataaataaatctcaaagcagccactcgctttattaatccttagggaccacatagagctgaaggcttgtttctcttcactgtggcaattaaatcctattactccttgacttcttatacatgcactgagtgtgcatgtaatttggcccttcccaatgataaaatgcagaggtgaaacacggttgctgtgctgtgaagccactctgtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgctgttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggaggaaactcagacttagcggtatagaggatgtcagtcactttggcaggagaacttttaacggaaatattgagggcaaaacctggttaatatgggttcaagagagaataggaggagagaggcacagaatcccaaactgtctctctcaaaatgcatcattttcagagccacaccctcctgaaattgtaggcacaatttcagatgtaagatgtgtgcacttacattttcctgggaaaagaatgttcagtttcttcagattctcagagggtctcctgaccctgaagagttgaaaaccattgcaatatgaacgagtattacggtgttatgtaacagcattcatttcattttcaatgatttttaaccagaaataagttgcatctttctgctggacaccactctttgccgagatatcaagtatatttgttttaagagctgaaatttcctataggatgttcaccattaggacagtacataagatggggaggaagtggatgggattttcattttcagccacatgacactttcccatcaggtacttgatctgaagaaatatattcctcagaacttaagaacttggatcctggagatgagagtcaaacctcctaatgtttataggcaccaaacaagcccagagtggtgaagaggcctgcgtggggtcacagttcttaggaacaaggccagtgcctgctgctcagggccctggtgggctgtgtgtcctccgtgcgctgggttccctgggctctatgcttgcccctttgtaccaccgaacagggcactccccagagtgaggactggcatctcgctctatttctatgcggggccagtttctactgtttttatgtattttaatattatgaactttttacatttttgattgtaagatcgtatcttttatttattgactctgaaaacacaggccttcttcatttagctagaaaaaatgataaaccctaaaaaaggtggggaggtgatttatactactctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggattatgtagaagaggaaataagatttatcaaactgtttcagactttgtgaattatagcagcctttgccatggaagtttattgaatgctactggattctgtggtagctaccattctgacataattctttttgtaaatacatattagatcctagaaattatggaaaaatgcatttttgttaagattttaaagattgcttgtatttatgttttacttagcttttaaatttacttttggcaactctctttgctgttgttttttttttctgccatctttcttctgacagtcgcagcctgacttggagtatgggggtccttacgcctgggtgagatggtcggatatactttgctgtgtgaccttaactgtgtggtgtgaccataataacctgtggtatttccacgaatctcatgggtgctttgtctccagtttttgcctggggggctatgaggccaggagggcaggcttaccctgcagagtgagcagtcttcctcctggggcctccagggtgcagccctgatcctgccggaggggaggagcccaggcatctgtgcatgaacactccctcaccagatggcctttgagcaccagctgtttgccacgccttgtgttagcagctgtgcataccaagatgaaaaagatagtgtctgccttcaaggaactcaaatcagatcaagaattcccaaggcctctacatttgctttaaaagattaaatgtaaagccattttacctaatgaaaaatccattattttccagtctatatccattcaaattaaatgtacaatctgacttttttttttttttttgccagaaagtattctttgagaaaactcctaacttccagtaacaaaaactaaggctttagacataaactcagaattacttcttatatgtctctgacagtttctgtgccttatgctttctaaaagtctgtcagtgttatacttcaaggaagaaaaagttctcagaaagcacagctcagcattaaagtgattcgatactgaagttattgtagcatattatgtactatttcacctgaaggactttacctaaaagcagtttgtgcttcatttgctccagtgcatttcaaaattatttagtaaattcttgttttaaaaatgtatttttgtgtttgcaattatagtgaatcaatagtagcatacatctgcatagcatatttggtgccctgagcctcctgtgggacggctgttctgctcttaacagatacaagagcagaggctggagtgagtagctcgggagtcaggacaggggaaagcacaaagacagggcgttagattcagaaagcgctcttcacagagtatctgttacttacctacagagcactgcaagtcgctctggcaggtgagggcatttctgtgacactgtaactccagcaactctcctgttctttaaggaattcaatgtgttagcaacatatttctagattattactctttttatgttaaattcaaagtaaattttgtttaagagctagcccccagtgggataaatgtatatgttagcaatggtcaggaacacattttggattttttttttcggtcttaattcttttttaaaattcaatagaatgcatcagggatcgaactccagagttttgacgtcaccttccttgtttccttttccatctctaatgccctttacatgtgctctgtcttttgactcatgtagaaaagacatctaacattattcatccaaaaagttggcagtggacttttgcgtggtcccatgggaaggtcacagacgctttgataacactgcgtggtagccattagcattcggactagtcacaagttaccgttttcatagggcatttacccttgtatcttatttatcctgtattagaacatactaacttatgtgtgtcctctttattttattctctcttatggcagtgtttctggagagcttgttagagtgcctgttcctgagccctttctgtaggtatcctgattccctaggcagtggcccatgcttgtgggaagcatgccaggtgtccaggaagcaggtgtgagacccagcctgggagcatggaaccagcaaagtgaacaagcctgtgtaccacttaaagctacacagtacaatagagcgaagcttgttgaacatcagagacccaacttaagatgaagttaatatgctgcctatggacttttgttctaatattgttcagttaactgtcaatgccccttgccctcttatgccacgtaaaaacagccccacccatctaaatacaacacaaaaaaacaccatccaagaggagaaagttagcagtgttctttaagaaggtcaaagtacttctccctatggaggtatagtcaacaagatcctatagatttgggaatacattctaggaacatagcccaggaataggttccttatgatagaattccattaccacagacctggtcatggaaattgctttgcaggctttcctgcaaagtaacagtttttcccaggttttcgtagaaggctgtaagtggaaaggtgacaaatgagaggatactgtcatgcttccagcttgcccagccttctgctccgtcgctgcaggctgagctggagaactacagtgcaaaggacagggttccgccacagagctatgtatttcataagcagcagtggagagccagaggccttgcttatgtcatacatttctcttcctcatttgttagtaaagtcaaagtcatctaaaagtgattaacattagccttcattattttattaatttcttctggaatctagtttctgaagacataacaagggattgagatctaaaatttgcaagtccttgacatgcattttcatgtcaaataatcttgttgctgaagacatgaaaggaaattagtctgagtaaaactcttgccaatctccaaagatttttactattaaatttatttcagaaatgttttaatgttactcatagagttctcaaatttaatatggaaggatttctacactccttttgtttcagaacttcaaattgatttcttgatttgttttgagttacagcaaagataaatatatagtttgatagtcaaagttttatgaatctggatttataatctgtctggaaattcaatttttttttctactttaatgtcatggctgcaaaatatgtgctatacagcacccgtcccccggataaggaaccatgtttagcacctcccatatgccaggccccttccatgtggattcatgtatccacccagtcagctggtgattcatgagggcactgttctaggtgcttgagatactcattttcatctcatttaatcctcacgatggctttgtaatgtatttattattatgcacattttcacggctgagaaaacagatgttcaagtgcattaaataattacttaaggtcacatgacggagcttctttgtggaatttggactcatgcccaggacctgatggcgtctccttccatttttaccagttgtgtagactgctcctcctttttctgtcccgagagctggttttgtctctgatgcttgacagctctattttgaatcagcagaaatttccttatagatgaattaagggacatttagaaagcccatgctttgacttaagggaacctgggctgggaactgagaagagagggatgataggcatgcacttagtagaatcattctcctttattctggaggacacattatgaaattattaaatatgtgttcaaatttcattttgaaaaataaagtaggagggctggatgaataaaaaactagtatagaggatataccccacgatgaacttttgcgtttaactatagattgactagaaataatttctgaggccgggcgcgatggctcacgcctgtaatcccagcactttgggaggccaaggcgggcggatcacgaggtcaggagttcgagaccagcctgaccaacatgatgaaaccccgtctctactaaaaatgcaaaaattagccgggcgtggtgacgcacgcctgtaatcccagctactcaggaggctgaggcaggagaatcacttgaaccagggaggcagaggttgcagtgagctgagctcacactactgcattctagcctgggcgacagagcgagactctgtctcaaaaaaaaaaaaaaaaaagaaatgatctctgaatcttctgaattatggcccatagcatcacaatgtgccataattttcaaagaccctgaaccaggaactgaaaactcattgactcaggctgaatcactacccatcggcctggcatgtggcttcttgcaagcagaatgtccacagagccaccataaaaccagaaacagcctgacaaggaaatggccacaccaagcccaaatgttccaccccgtggagggacttggtgccactttaaaactaagagtggcatgtgacatgaagcctactgacttggttagcttgactgctgttccctcctgagctgcgggggagcagacggcggcagggatgcagtttgggagctgccaggacttgtactgtcctggactggtcattcatccgctccacaagaaaggtcaccttatacctggctggttggtccctgctgatttgtacctgtgaattcatttgtgtactgatgtcagtttttctcttttcttcattgaaacagacaaatggttatgatggagaattgtatggatcacagtccctgaatagaagatctggcagggttagtatagtaaatttgcatggctcaaaattcaaataggttgtttcaaagcttctagaactaaaaactaattgctaaatttaaatttagcttctttgctgtttttaaattttaaaatcggtctgtcttttttttcctagcacatgatggaatgaaagataatgtttttcaactagcaaacattctgagaatgttagccctccaacattctgattgttagtataaggggtagatattgataagaatctcaagttttaaaagatctgaaattaaagattaactctttcattactgtattcccctgggtgtatgtatataatgtgtgtattaagtatattcagctttcaaagatactaaatccaacattttcgcagtctccacatctgtcatttgtaattttaatgtttaccttaaaggcatgtgtacaagcacctgtgtttttctggagaggaaaaggagaataaaacaatgcagatgcttggaaggctcccagttaaggggtgggaggcaggaaggagctggtggaaggaaagggtgctgctctagggggagagagagggagtggtgccagtggcaggggcattagggagaccgggcgggggtggggagggctttggattaatcaaggacaggaggtcattggggattttagaaggttacactggatacatttccattaagcttcacgatatcccacaggtccattctgtgtgaaatggtctaaaaatttcctgttctcatgcttcatttttttcttttagtaatattcctaattgtgtaaaatagtatttcttttcatttatcttaattatgttatattaagatatcatgtgtatgcttaaattatacttttgggcttcaaatgagtgaccccacccagaccttcttccctctccccgaccaaagccgtctttagctttctgaaaccagctgatcaagttgtttttacttgctcattcctatttacctatttagcattgcatgcactttaattatttattttttgagacaaagtctcgtgccctcacccaggctggagtgcagtggtgctatctcagctcactgcaacctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaagaatctctgctgtactgtttgtgcctcgcgtctttagataaactagcgttcctgggctcctagtgttggctcggttgtgctgttccatgttcgccttttgaatgggatgggggtgcttttggagtcgtaaggaagtgcttgtcacttaaacgtgttttcttctttggtgctcagaattccagctacagcggtgacagcagattctctactttgtcatcatccagggaggagaagttggttggtttccatttaaatctttcacattctcttcagaaaccgcagattttgtagcatgcaatcttgtgtgtgtggattcagctctacttttctctttcggtgtctgtttgacggatttttgtttgggtagctgtgttattgacgtgaaaagcagcagttaacatgagctccttcattcagatgtactccagtgtgctgcgtttgaccacaccagctcgaatgtgaattgtggcattcagctggctgcaatgaaaggacgtgtttttgtgtatattttctaattagaattaatcaaaaggaaaaaaataattagaagaatgctcttgaattcttgagagtttctgaaaacagaactactttgaagagtacatgcaaactttgtggtggtttcttgggcatggactagacttggaaggaaaatccagagtctcatccaaatccacatgtttacacaacagagttccttcccattctctacaaacatgcatcggtcttgataaacataatttctaaattgtttaagagccctaaaattgctaaggcttgttggtgtttgtttaggttcacatttactcagcaaaattgggactagtttaggtaggaaaatcaagcaggccctgggatcacaaagctaagcagaggaggtgggtgctctccaggcactgacatctagaacagaagccaccggcaccggagaccagtacaggagtgaacagatgagtagatagaatgggagggagacactggttttgccaggaaaaaagatgtgagctgaaccttaataaataggaagggccaggtgtggtggctcacacctataaatcccagcacttcgggaggccgaggtgggcagaccatgaggtcaggagatagagaccatcctggctaacacgatgaaaccccgtctctactaaaaatataaaaaattagctaggtgcggtggcacatgcctgtagtcccagctactcggggggctgaggcaggagaatcgcttgaacccaggaagcagaggttgcagtgagccaagattgcaccactgcactccagcctgggcgacagagtgagattccatctcagacaaacaaacaaacaaacaaacaaacaaatagaacaaatgaaaagaataggaactaaccaggtagagcctagaggggaagctcttcaaggtaagtagccatttgagcagagcagaggccgcgcagaatgggcagaacccaggagaggtgccatgtggctgagcacagggtgctgttggagctgttccgtgaacctggtgactccagtagcagctcccacgctgaaatcagaaaatgaaatctatgcaattcctctgcgatttcctttagccactcccatgtatcattgacctcattaaaatgcttctagaagaaatagctctgacccttccccgccctgtccccaatttccagcccctattctcgtttccctcccggggggttggggggtatctttttcttgccagggcacttcttcctcacctcttcaccccttgtccaaccccttcatgtccagggagactgcagaaggtgctggcagctccatggcgcccactgcttgccacctttctcaacccttcccatagtcccccagtctgtaataaatccccccactgtaagctgatggcccttctgtcccccaatacgtgaattttgactcagtatatgatcagctgtgaacaccaaagcatcggtgggtttaacaccttgaaaaaggctttgggcattttcttaattcaagagattttgctgttgcagagggcacttagtcattaagaaaacttcatttccaactcattttcgataagctgagttacttgctctaaaataaaagatggcaataaatatctcatctttggatatgaacgattcacccaagttcagcctgcatctgactcacttcagtccatttaagagaaataacccacatccaaagggttaaacatcagaatgagagctgactcattcaaacagggccacatgtgaactcgccctgagccctgtgtgcccgtgatttgctgcccgagggctcttgtactcacccaccctcagaaccttcctggaaattgtgctctgtagacatctattgctgcccagtacgtggtgcgtttaattttatttaaatataataatggaaaggtatcagtgtagaatgtagtattgatgactcttcctaatatcaattaaaatttatttcaatatttaatatcaactaaaattaaatatttttttctgtgcgtgaactcaaaagtcctaatttggccccatctcctagttttgtcagttgcctggcccagccgtctttatttccttctgaccctcgttctctccctcccccgtgagtgcatgcctgttactgttttggttgtataaggtaatcgtctctgaactcactggactgatgtacctttgcgatgccgtgagggtgtgagcctctctctcctctctgctgcccatttgctctgattacagggactctccggctccagccttgggcttgccggtggtggcctggctcccacacccctgtctgccccaaatggaagctgggtctgtctccttttcacatcactttgtcgctccttccctttccttctgtgcatcactttaattgctgattacatttagtggatagttcagcctcctctacacaaagtcacaagagcaaagcttagcaactgttttaattggcttgactagtttgctaagacttttgtcaatcttttagaaaaaccatgtcaaataagttagaacctatatagaaaaggagacttaaggaaaaggagggttttattaaatgcatattttcaaaaactcgagtccaaaaaattggtctcttgggtctctcctccttttccagcaattgttccccatttggggtttcatttgtttttttaaaaatattttttctcttgtaaatgtgtccaggaagcaatttggaaggtttttgtgcctaatctgcctccttggtccctgagaagtggacagaacagtgttattcctttggctgggtctccccgctgtttcctgtttttacaaggtcaggttcaggtccggccctgaggtgcttggcctgttagctataggtatcgagtcttattctaatccaaggaagtcggtgtcagaggtgaaagtacacgtcctatttggaggttgaactgtccctctcccttgcatgtcgactggagctgctgagtgatcaccgcctggccgtgcaccttgcctgacttgctcagtgtgccctggaaatgagtccagattctgtcccgtggcacagtctctggacactgggagctgcccttgtgtcccagcctgtcccttcaccagcactgcctccccctgacgtgtgtgctaggcaggattctcctttgacagggctagaccgcggctcctctgggggtgcctcccacaccagctgaggcagccttgcagtgactccctttgtgtcttgaagactgtcgctgggcccctggcatagaaataaagactcttcctgctcctgtcttcatgtgtggacatctgcgtattgaatactgccaagtgtgtcgttaaccttggatttgagctgtgggttttgttgctgttgttgtgttgaccttgtcaccattctgtctcatcccctgaccctttcttccaggaatgcctgaaatgactagaaatgatcgtgttttaaagatgctgggaagtttactgttttaaagttaaaaatcatctcagttatctttcttgtaaattttggatttgcatctatcaaatttgcagaaaacacggtgcctcgatcggtttgtttctgtttaaccactgtacagcagttggctatggtgaatgctgaaactatcgtgatggccttttgctgtcatttgttgctgttttttcaaggcttttaaaacctgccatttgctttcatcctccagccctcctgtctgtacagcgctgcccggccttcggggagttaccgggtgcgtgtgctgcccaccctgctgccccgcaccccctcccactgtgcatgcaccgcccccaccaagcccagagccggggatgtgcctgttcccagccccctgggggaagttgcaccttcacgtggagcttacatgtgccagtggggaatgtctgtcccctttggccagatctgggttttctctcccccgattgttgactgtagctgccacactgctctgtctccaggaagccttgtgtttgctgggatcgttaggcaggaatggaacaacagcaatgtttactttacctattggcagaaagaatggtggctttttaatgctttggtaacctggacagatactaatccatgttactatattactttggaaatttccagttttaaatataagtacttatgctatgcaagaaacgtaaagtaaatactcaaagtagctatattgtcttgttaataaccttttttttttttttttttttttttggagacagaatctccctctgtcacccaggctggagtgcaagggcacgatctcggctcagtgcaacctacgcctcccaggttcaagtgagtctcctgcctcagcctcctgggtagctgggattacaggcacgtgtcaccacacccagttactttttgtgttttcagtagagacgggtttcaccacgttggccaggctggtctcaaactcccgacctcaggtgatctgcctgcctcggcctcccagagtgctaggattacaggcatgagccaccacacccagccattaataactttctgaatttccatcagattgcatacttatgtgtttgatatattaataaatggctgagcaaactagtatgtcctcaagggaaaatagggaaattaaagttcctttataccgggcaaagtttgacatcaccatttgtggcagtgtaagctcctgtttacccacgttgattaattaagtagcattttccagttaaccaattactctttcttctacttagcaacttttaaagggttataaaatatttaacattaaaactataattaacataatttgatattttatcccaaagtcacttcacataagagtaattttctaagcatcaagtatgagaatgccatgacaaaattcaggatgttcgaattatctgctcattttaacctggattaacaagttttcacttaggcctgggatgttttccaaagtaatagatttaaatggtctgttggagattacattgcacacctcctgacaacgactaaaaccggtctctcctcatttccttgtcgcactctgcaaccctttgaagagctggaaaggtggttctcagcctcccctgcatgctttttcaggtcatgctcctggcacgtgtcagtttttcacagctcacgttttcagcactttctgggcactcttggagaaaggaagagcgcccatcctgacagtctcttttggtcgcaggcgtctgtgttggatgaaggcagcttcggtgggacccgacggggcagcacctccggctcccgtgctgtaaggcgctttcggtgatacctcctttcccccgtgcctgctgcatggcctggggatgctcgctgggcagggtccagccgtggggggtgactggccattctcaggaggaagcgccgagtcaccgggctaaccgccaccttccattgtaatgaaggtcacaaataatgtgaatcaggaaacctctggttgttggtttcatgtcctcactcatcagggagagtaacttgcactgagtttcatctgctctctctgcagcacgccaaccatactaacaggtggtgaaaccgtcttcggttaataaaaacgggaaaaggacaacttgacagaccacacatcattctcgtccctggatagttgaggaagaggaacaaattttaaaacttggaatgttacgcatatttcattccctgtttgtattttgttgtctctctacctctttcttcaatttgaaatgataggctcagctatgagggtaaagatgtaataggtgcaccataaacatttgtgaatgaatgcgtgagaaaagcaacaaggtagaaaaatgagatggaacccgtggaagtggggagacgaatttgcgtgtcccagggacctgtggaaacggagcgttcagtgctaaccggtgctccctggcggtggatctcctgtattcagaggctcctccccaatcctataaaaatgtcttcaagccctccaggaaatagaaaggtttactaagaaatacttgaaatgcttttataattttgcttttgaagtttatcagctacttacttgactaaatccagttttatgacttactatgctatttgtccagccatcatggatattcatgaattcttatggtgtaagccagtctaacctacagttttctttaaaatgtaatttatgaatattaaatccagtagttgacatagcattcgtttttgtcgacaactgattacacatttatcaacttttatattacataagttgttcagtattttgcagcccactatataacatatttttcccagttggtaaacattttcataggccattagaaagctcataaaccatgcatgaagaatgaaatagccctgcctatgatgtgatggataaagcacaactaatgattttcttttgtcagaaaagagggagaatactaattcaagagaaatttcccccaagcaccaggtggttttctggtggcttcagtagagagtctaagatctggcaggacggagggctcctgatgctctccagatgctactgtgtcacgtctgagatgggcttcgggagtcgtcagccctagatccttggccttcattgctcttctgcgagcagtgatttctgtgcttttagcccccacaagaattgcctgggagtgatggccttagagagttaagaaaacaggaggtcatcttgtcctgacagcacagctgcctaaaatagggatggtcagctctgctgtgagcaggaaattagcaccatgaggaagacggaagggacaaagaagttcctgacctcccaacctctgccatcgtttccctggaaccctcacagttcccctccaagtggatactccgttccttatgtttacaggagggccttgggagagagccacccctgctctcggtccagcgtgtagggaggttatggcccaggacggtgtccagagcggccccggcgcccaggcctgaggtcccagccccaagtggtcgtgacctcagggtccaggcttcccccaggcctgcacagacagccctggtcctgctgtggaggatttgccctgcccctggaggaccaggaattgcccccgcgcagctcctgagtgtgaagtgactttcttcggtgttgtgacaaagctgggacgtagtcatcaccagtggcattgtctgatccaggagccgaggaagttgtttctggcagaaagtggaaataagaagcccaacatgtaccccctttcctagtcctcagctcctccatttggcccacgtccttacttccatgtcacagatgccgggctaaggaacttccacagccacgtggccaacaagagatggagccatgattcagacttaaagctttctgacttctgcacattagccacataactcctaaacataaggtgcacgtggaccgtggcgatatagactttcactttgttcttttctgcgtgattaggtccagttggaaggtttgagagctgcttttgcttagggaagctggggtgggcagtaagctctattcacaacagttcactgtgtctttgcaccataaaccagggcatgaatggcataggatggagaaggatttgctgcaggatgaagttttcctctctcttacatcaggaaaccctcaggcaaaattcttctgctttaaagtgttgacattaagtgttttccttattttcaacaagaatgccaaaaagtgaggctagtaatactggtgattttcttgtatatctcaaatgtggcattgatgctttacatgtgctgtgtacacagcagtattaatctgtgaatctgaaacaacgtcttgcccctgagtgtaagtgtatagtaaacatttatcaaataaaatagaggtggatgggtctggggaacttgcccatcttgtccacagccctgtacatttaatgctttcaattgacatttgatggttattttagtctacagttgaaatcattcgttcattcaacaagtatttcttgagtttgccaggcctcatctggtcactagccctggtgaggaaacaaactaagagatggtatttgacatgagatcatgagcacccctgaagatctatatgagatcacaagcacccctgaagatctggatgagatcatgagcacccctgaagatctggatgagatctggagcacccatgaagatctggatgagatcttgagcacccctgaagatctggatgagatcttgagcacccgtgaagatctggatgagatcatgagcacccctgaagatatgggcttccttataattcgcaagcagggcacttcggcaggtccccagcagagcctgtgaggccagcagagggttctgtgcccagcacagtgcagggtgtccaggggctggaatggaggggccttcagcagtggcgaggcttgctatatggtgctgcgtgggtctctcttgaagatgctcctcaggacatgtcgggatcctaaatagtgttcaaatcctgcccccgccccaccatgccttgctcaggaagaatatgagaatgtttataataacgtgaaaatgtatctaagactagcagatgtgaacataaatcaaagttacaagggcgtagcttccagataatcgagttgctggtattttcctttaccagaagtgagaaagttcaggtaaatggatagacagatgtgtacatagcaaccacccaggtagaaggtaatctggcaatttaaaaagccatacataattttgtattaaccctaactctcattttgcttccacttggaaagatagtggagaagcaaaatttttgttcccttgctaaagcgccaagcgccctgtgcaagtcttcagtttctgtgccggaaggcagcttaagttctcaaaacagtcatttccacatccacggggtgactttctgtgtctacactaggtgtgactgcacacccaattgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctcaccacttactgcagcatgttttctgtcggcctctattctccttgctcctttgctgaccctgttcctttgtttctggctgcgtgtcctggcggtggctgtgtgggcagccctcggagtacagcggccacctcaactccagctcccgcgcctcctccagggccagctcggcccgggccagccctgtggtaagtcggcctcctggccttgctcctactcagtgtcaccctccctcccccttcccttatcctcctcttccaacgtctccaaatttagaatattactctgcggtgatattattaggattacattgctcaacttttcaaggaccgtaaaagaaattgttagctgtgcttagagatggggatcttagaggaggcaaactttatacaaagggagaaaataatatagccatgtgcacggatgtgtggttttctttttatgatttaaaaatttgaagtattgactgttaatgctttgcttgaagtgttacctgtgatcagaccccgacagtgtttaaggtaaagcgtggcctgtagatcccgggacgctcccagtttggccccaatcattcgttaccctcctggttctcagatccttcgaaatgtgcagatttgcagccctgcatcctgcttgtcactcagcgtggcccaagttttgtttcagaaaataggagccctattaggtcatccccagcttgttaagtctcattattgtgtgttttcccctgggttgttggaatttgacacagttttacctgatgtgatgcttgaaggcgaccctatgactctttttaaaggaagagtttgcaggacggttttggactggggcttgtgggaatggaggaggggaggtgggcacatggccggggaaacagctccaggctgcacgaccagaccagcgttcccaccctcaagagccagtgagaaaccttggggagaaaaagcaaagatgggcaaggcttccctgttcgtctccactcatatcaaaatttccagcctgagctgggtgtggtggctcacatctgtaatcccagcgtcatgggaggctgaggcaagaggatttcttgaagccaggagttggagatcagtttggccaacatagcaagaccccccatctctaaacagtaaaaaaaaaaaaaaaaattagccaggtgtggaggcacgcatctgtagtcgcagctactcaggaggttgaggtgggaggattgcttgagcccaggagttcgaggttgcaatgagctatgagtgccactgcatttcagcctggacaacagagtgagaccctgcctctagaaaacaaaaacaaaaacaaaaacttctcccagccatcgagaagttaaaatgtggctcttaagttagttactgaacaccatacttcagcgtgctgatccctacaatttctgtaacgttcctagtaatcaaccaagaagtcgcagcgctgagacctcctgcttgcgtggatgtaccttttttggcgggcttttcctattgtggtgctggtggtttgtttgtgttttaaattagatgcagtcttttaaaactgtgaggtttcctacctcgcacctgatacctgcattcaggtatcagcaaatgcaggtatcagcttctttgggggaagaaaacccaggatctctggccacttgactctgaggctgccttgcagaactgcacagcctccaccccacccactattttcgtgaccccgaggccacggcccaggtgccattcatcactgtgcagcatggctttcctgtgctagaggaatgtttatctcctccatccagccatggagagcaggaaaatagagttcaatatgggtgggcattgcaacgccagcgcctctttctctgggggaagactctcccctctgtataagttgcagacacccactcttgtcacacatttggctctgcccacctggcctcacaggcatttgagtttgtgttccacccctccccatcccagagcccagcagtcagcagtgagagaagccaaatgtgtgcagggagtgcgaggcggcagctaccatgcaaactccaggggcacaccgccccccagtaatctctccccagagtgcatcaggcaataacaggaagatactcagctgttcattatgacatgatttcccattttcaaacctgacaagttggtcttgatgctgttattcaaataactgaaagtaaatggttgtgaacaaggaatttcagatcacagactcagtaagcctggccagcccccaaggctgtgtcttccttaaagttgggatctctgtattatctcatactctatagtagagcaataaacataagctgacttatgtgatcacttaaaactaccaggaagaaacattttccgtaataaatttagtgtaggattgctttgtcttctcacactcacttttcagaaaagaaaatgtaagtattgccaggcgcggtggctcacacctgtaatcccagcactttgggaggctgaggcaggtggatcacttgaggtcaggagttggagaccagcctggccaacatggagaaatcccatctctactaaaaatacaaaaattagccgggtgtagtggcgcatgcctgtaatcccagctacttgggaggctgaggctgaagaatcacttgaatacaggaggtggaggttgcagtgagctgagatcgcaccactgcactccagcctgggcaacaaggcaaggctccgtctaaaaaaaaaagaaaaaagaaaaaaaagaaagaaaagaaaatataagtatttacaattgacagaagaatgttgtggctttactttcagtgaatcccaaacacgcttaatgccctctgtaccctctgcctggttccagtgagacatgacaattggattttgttaagcattgtctttattcaagcatatgatgaagtctcaaaataacagggctcaatatagtcacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccgcagtgagggacaaggctgtcccccatctcatcctgggtgccttacatctgatgaaacctcccgtatgtggttcttagaatgcagagaggtctctgtagagtgcagggcagttccctcgcggatgtgttacggtatcccttgattgatcgtgtcgagaatagaaagacggtgagcacaggcagcatccctggtatctgaagagagcctgggagacagaactaagctagctcatttccataatttccaaaactcatggtcctcttatactaaattgactccatttctgttttctgtcttgggacatttacaccattgctggtatattttggatctcctgggacaacagaaagtgctagtggttgtgtttggccttgttgatgggaagaagccaggagagcctggataggactccccggtccttctgcctgggagggaggagcaacaggtcttgggcagggcctggtgtaagcgtggtggcaaaggtgaatgaccctccagtctggccttccttgaggtcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacatatggttactttatttctccttggctggggttagccagggatgggatacagttgttgtagcgagagctcatgggaaatgctcccaggccggggacttcgtcagggacacgtatccagggccagtatgagtgaggacagaggacaagaaaaatatgaagtcagggtcagccctgcaggctctgtagggagtcccgccctgggtttgggagatacaggtgcacaggtgagtgtgtcacacccatcagaggggagggagggagggtggtgctgttaaagggcagtagtaaccagaatgaaggaagtgactgcttgtcccacttcgagaaaatgaaaatgcttcagtgtccagagaccaccaccagggacaagacttcaagttttctccacccacttggtcctcccagggtccttgggaaagcagagagggcatcagccccatctcaagacaggcatagaatactgttcacctcattctcatcttctcccatgctgtggatgagctgtgttttcttcctctccagcacgaccaggatcttctccttgaggaagttatttcactcattcattcagtgtttattgagcacctagaatgttccagaaacagggccgttgtatgagcaaatgcagacttgccccagccctcatgggacgcacagacaggggcagacggatgcttgttgggtgatcacacgttgtgaagcccagcagcgggggtgtgaggggaggcaaaggtgcctcgagagagctgggatccagaggtttgacggccagagcttgggccacacccaagcagagtgactccacctagtgaagccaacagatctgggtcatccaggccccaaaatctcactgggaacctggtgaagccatcacgtttctgaaacatccatcaggaatgtcccaagggcagcctgggtccatatcttccctcgtgtactcagagaagacaggagcaatgaactcagatctctgcccatttggactagaaaaacaacactattttgactcatgttttttgttgcacaaagaggcaggggcagggaccaggtggaaaaacgggtcttgaattacaaacaccagagttcaaagataagtcattcaggctaaagtaaatattattggatttaaaaccaaaaaccgtcaccctagtggtggactgtgctatcatttaaatgtgaaggaaaattacccttaaaatgggtgttttctgagcagtgtttgctgtttgtttgtgtctcaagaaggacctcgcaaggatgttgcttcggtgatccctttttccatccaagtctggtgttgcctggctgggtgttgaggacaggttccttttgtacctgggcccttgagtagggtctctctgggtacgtgaacaggtgccacatattctttctttaggaaaatggcaggcagctggaacatggaaaacttagcgttttagcctcaccaggcatcgtgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgacgttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcattttagggaggaagtgctgtgctttatgtcaagatgaaacacaacatctgattccttacctggctctgctagggcttaggaaagggggcttggttaaggtggactctgctgcctgcggcttctgtccgggcccggcccctgcagctgtgacacactgccatctggtggacacgagtggggctgcgtggctttccacggggctgaatagccttcctgtgtttgaggaaagctgacaaatcctttttcattcggaagacacacaaaatgaaatttactctactatgtaaaatagagataggttagacgttcatttgccatcacctttcaacaagagcttaatttttagtttttctctgcatggtctctacttaaaaatatgcccagattttattttgagtccgttgtgttcttcggagcaaggacttttttaaaatgataaaaacagcaaactatggtttttggggttttttcccttatttgatattttacaaattataaaaacaaatgatgtagacggttacaagcaaaaccatgcagaacaaagatgtgttaaagccctgcccccccaaaatcaaggtttgtggaccccgtgtgttttctttctcagctttcttgcaagaaataccagaaagaaaaaagggcttgggtgggcccttcttttacggtctcagatatctttgtaggtaaacgaatgcattcctggagcttcatttatttctccacagtatttatccattgctgaccagcagccagaaaacatacgttttacaccgtggagcaaacatgccacaggcttttcagtggtagtttggcagtctattaaactggattttcatatcccaccaagagttaaactagcctctttattttcatcttattaatatttgttcagcaaactaacttactctaaggaataaaaggctttgggcccaggagatttaatgaatttattctccagcacgctaagtgctagatagatagttcacatttccttgttctttgaaattttatttattttattttatttattttttttttttttgagacagagttacactctgtcgcccaggctggattgcagtggcatgatctcagctcactgcaacctctacctcctgggttcaagagattctcctgcctcaacctcctgagtagctgggattacaggtgcatgtcaccacacacagctaatttttgtaattttaatagagacagggtttcgccgtgttggccaggttggtctcgaactcctgacctcaaatgatctgcccacctcggcctcccaaagtactgggattacagacaggagctaccgcgcctggccttgaaattttgatttgaaaaatatttcaggaatatttttctttccatgtgaagttgagaaccacacttgaattgctccaatcatcctcacaactcaacatggctgcagggcttctggggctctgccaaatgagatggtgcccatctgatcagagtctgccttcgtatctgtcccatcggagtctgccttggtactcatcttatcggagtctgccttggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcaggtgggtccttagcagctgtggctaagtgggcagagggaccaccccaccaccaccctgcccaaagggcttatttagcaaagaggggagagaggccagcctgcccctgactgcatcccactggcctgagggatgtggcctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgttgctccaggtgtcgttggaggagaagttgaaggtacaaggagtttgcaggagggaaggtggcagttaatgagccttcctggtgggaccggatggtgagggcaggggcatctggcccagcgtggactcgggccatagatgggaagtggtcatttggaggtcaccatctctctgacaccctgaccatagcacctgcacccctgtgctgagctgcaggtccccggcaccagcgtctgtgcagctcaggtgttgctgagccgtggcctccgcagctctccatcaggatttctcaagcttcattatgaattatctctgtgtgagctcacaacggtgactgcagagtcccaggtcatctctcagatcttctgaatcaaacatatggtctgcagttgccgcgcatgtctttggccgattttctgacaatcaaagtgaagaagttctgagctacgggaagttgggttgaaggcatgatggggaaaacatgattagttgacagcttttcccagagagtttttagacaaactcaaccttggtaaccttctcagtgggcttatgataagaaccttcaatgtgccaaaaaataaaaaaagcagcactccaggtagttaatctttgtttaaaaaacccttccccccacccagtcctgcaaacaaacaaacaaacaaaaaaaggagaaaaaaagaaacctgtcttttgttggatgctgagccgagaaagaagtaacaccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtgaaaagctaaatttggagtgtcccatttttctgcttctaaattacaaaggaagcaaatgttttgttttgttttgtttatcattcatagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcgcatctgtgttagtccgttctcacactgccataaagaacttccctgagactgggtaatttacaaagaaaagagctttaattgactcacagttccgcatggctggggagacctcaggaaacttacaatcatggtgaaaagggaagcaggcaccttcttcacaaggcgacaggagagagaacatgtgaaggaggaactgtcaaacacaaagccatcagatctcctgggagcccactcactatcacgagaacagcatgggggaaactgcccccgtgatccagtctcctcccaccagggccgtccctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctgaaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttctttttttttttttttttttttttttggagacaagagttttgcttttgtcacccatgctggagttcaatggcacgatctcggctcactgcaacctccacctcccaggttcaagtgattctccagcctcagcctcctgagtagctgggattacaggcgcccgccaccatgcccggctaacttttgtatttttagtggagacggggtttcgccatgttggccaggctggtcttgaactcctgacctcaggtgatccacccactcggcctcccaaagtgctgggattccaggcgtgagccgctgcgcctggcctgttgtttccgtttctacagcagagcagcagagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtagaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgagtcaggagaatcacttgaacccggcaggtggaggctgcagtgagccgagatcgtgccactgcactccagcctgggtgacagagcgagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaaaaaaaaaaaagggaatggtagggtgtgtgtgtgtgtgtgtgtatgtatgtatgtatgtgtggatatatcgtgtgtatgtatgtatatataatgtataatttacattatgtatttttatatttttaaacaatggctctccgcttatccaggaaatccaaacatctgagaataaaagtaccatactctttgccaagtgacttgaaatattgatacgtataatttcaacatgtaaactggagacagtttttctaggagaacatctaagctaaaagcaaaaccatgaaaaaacatacctatgaaagagccaccatgctcagataaggtgcgatcagatgcttcaagattttcctattcatatgtattttctgatttttattttgttctctctcaacaccatagggaaatagttatgagtatcaaagattttaagaaaattatattattttctgctgattgggaaaagacacagttactctacttaagaattaaatatatcaccaagctcagagagagagatagtcttatctgagctttcattaggaaccactggaactagtttgttaatagctgagatcagatataatttctattgagagtctcaagcatgagtcatgtgttaagataagtaatgacagcggactgattccacgaaggctgggcttggatgttctttagatagaaagcaaggaatacttttttcatacttttaggaattgtccaatttttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaaagggaaaaacacgcccacagtatactgcaatttcagtttgctgaagtcaaggaggccctgaagcaaagagaggaaatgctcgaggtaggtagcattctcctgcttttcttttccttttttccctttggagcattttgtcaggccatgactatcttagcttaggctgcagtaataaaataccatacacagcatggcttaaacaacagaaattaattttcttacaattctggaggctgggagtccaagatcaaggttgggttcaggtgaggcctctcttcctggcctgcagacagccaccttcttgctatatccttcctccaacggtggagaaaaagcaatgtctctgatgtctcttcatataaggacactaatcctatttgatcaggaccccactcttatgacctcatttaaccttaattacttcgtaaaaaccctatctccaaatacagtcacattgggcattagggcttcaacagatgaatttagagggacacaattcattccatggcaattactaaagttttcagttttcttaaatctgagagtttaggctaactctccatccctagatttacgaaacagtccctctcattggtgaacattcctattctttggtgatcttgtatttgtttggggaggtgtggtagacagaataatggtcccccgaagttgcctacatccagatccctggaaactgtaaatatgatgccttacatggttaaagggcccctgcagttgtgatgagagaccttgagagaagggattatcctggattatttgatggaacaagcatccttctaagaggaaggcaactcaaaggcagaagtagaagatgtgacacaggaagctgaggttggagcgatgcgagagaggggccatgagccaaggaaagcagctcagtcttagaagctgaaaaaggcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacaatgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggctgggccgggccggtggttgttgaaacagctggagtgaggaggacactctgaggaggtctgatgtgtgcaagtccagacgtcttgggattatctgcctggtggtgctttgagaaaaaaaatctaagcaccaccaggcagatatccccactttgaaatcttccccagggaaggtctccacatacccttctccctccacaagaagaaaagaggcagttctacacttagaattgaaggatagggggaacagaaccccacaaagtagttgtcatgattggtaacaacaaatggtttccccaaaatggtgattcctacacatagctctaataaagacgtcgagatacctgcacaaaccatcggcacgttgactcaagccacactgtgtttccactgtcacgctcatcagcacttaggagtgtgtgtgtgtgtgtgtgtgtctgcatgcacgcacactttaggaccacttcatttatctgagatgatggataccaagaatcagtgtataaaaatagtctaaatggctacaacagccgtcctgggaggtgcttaagcaatcccttttctttactgacccctcattcaagtggagactttgcgtaactctaacgcagctgtgaacacgcagacaaagctagaaagtgatgcaaatatagtaacctctggggccccgtgctgtgtccgtgtgcttcaagatgcgcatgtctttcatggagtatgaacagtaacatttcttggattatatatactaagcgaaaagcttaatacttggattttgttagtatctttaggcagagtctctttaatgtctagagtccactagtgttttagatggtagaagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaaggtatgaagccaaactacagttttatttaaaaaaaaagaaaaaaaatccaggtgacaacagcaaattttgggatgctgtgaatatgtgtgtacataattcattttatgtcatttagttctgttaataattcatatattgggttaactgacagcgatgagatgtaaaataaatgtaggttcagtgggtggtgcccaaggccttttgatgttaataaacatagccaatcttgaatgcaagaattttttgatacattatctaaatttttctcatactcactagtaaattctccaggatattactcagacttagagaattaatttgcctctttatattaaaacccccaatttaaggacttctctagaggaacagtgacttgggtaagtggtttgggcaaggatcccgctaattagactttgagacctactagattacaggtggaagacggttccctgtccttggtgggccacgccaaggcgtcttcagccgctgcttgacacaggtgaagcgccagtggcagcactctgggtgggggggttcctgaaccgtcaccatctgctgcttggcctccagggtcaaagccagagcagtgagccagccagctacaggcttagagctaagattcgtaattctgctccttgaagaggcgatcagttcaggggagttcctcacacacaagggagagagagccacaggcggcaggagggcatgggtgagtgatgtctgcagttgggaagtgctgctgttttcagtgaattctgtttcttttgaatatactgaacattctagccacctctgaattccttctttaacataagtttcgtgtgtctctttcagaacatgtatatatttctttctttatctggtttctctttttaaagaatgcaatcagggttttgaaatgaaaggtcacttggcagtgacttgcttactgctccacttgggggcagcccacaggccactacctgtagttaaaaaggatgcctggtggaagtagcttgtcaccagcaaatgaaagcatggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagcaagactgtgaaggcaaaaggaaaacagtctcaaaattaagtaacaatgtggagagtactatttggttttcctcagacacatatatatctgtacctataaagtgtggctttttaaaccgattctatgacagaattatcaaaagatcagaatggttgaggccgtcaagtcagttggccatatttgcaagccaacatcgacatcctgggcagcattcagcgctttgagggtacggggtgcctgtggacagcaggtccgtctgtgttgcctttttcaagccaccgctcgaggtgggcaggcggccgtggtagtgggtgtggcggtgctgagagtctgagtatgcccacctttgtcagaggggatcctcctttgtatgccacgtgtttgcttctgaaagaatataaaactggggaatccagtagatcagaggaatattttataccattttcaatgatctgatttgtcataatttgtcataagagttggctttgggagaaaccttcagattctggcgtgcagcctgaagttgcagcgtgcaagtgaggcctcatctgtcactggtcaccctctgcgttccagtgttttacaaagaggctggaataaggtcagggtccgtgacttttcattttaatgtagaagctttcatcttatttctttttatttatggaaatgtagacacctccaggccccatcttctcaggcctcgcattccagggaggtacctcattcattatctttatgactattaaagaaacacagctcttttcaattgtgtaaaaaaagttgtggcctagtgcagtggctcacacttctaatcccagcgctgcgggtggccaaggctggaggatcacttaagaccaggaattccaggccagcctggcaacctagcaagattccgtctctagataggtatgtagtatctatataccgttgttgagaaaagataaattaatcaatttccatcatacctttatatgagctacccgaacagctaggaatctgattacgctgctcttactcaaatacacattttataaatctttgataaccattgtgaaatgttgtaagaaccagaaatgtcagttttgaaagtggccttcaaatgacttttgatcacatattccttcagcaaagaattgtaggatccaatatgtatgtttattttaaatctacatatgtatactatttcattaatataaaatgtacgttataaaatatatgcaaagatatgcaaagaagttttagagtaaaactctaaatagaattcctaatatttcccccattttccctgggatatgggcaccccaccatggagatcactgggctataaaattatctagctttgactttcagtaacatagtaccatatctaatctgctggggttttgtttggagagtccaaaaattccaaaacagtttgatgttctttagacgatgaataatttatcatttaatttagtggtcatcttgatcttgaacatttgcctcctgctggtcctctctccctagtcccttagggaatggagcagaggtatcagggcatggacacagggtgttttctcaggaaaacaatagttgagtggcagaagatagatttcctttcatatgagctatttcaaaagcatcttccttgagactgaccttgaggctgcatttctaaaagtgcactgaatattctttttaaaaattacttgaaagctgcttttagggctgtgtgacatggagtgcagtttgacagctgcaaaagtacaagttgtcaagttgttcattgagaagtgagagtggggaattgaaccttcagtctgttcctaaacccatcattgtggattgtttggctgcctgatccagagttctttctatttgttgaaacttaacgtcacctttaaaaatctgtccacacaagatggcaccagcagccactctggcctttgatgtggtggcagtggccctcactgacccaaaatttactaatgcaactgctgctttgccgcacagaactggcaaaggcttgtttctcatgactctttgatgactctgtctttaggaataggggtgggtgggatttggaacgtgtgtttacattctaatgtagattatgtggccgccacatcatggggtcccttcaattttctcaatggtcttttaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaagcctgtggttccactctttgggctgcttgaagtctgagtctgactactgttgtatgtaataccacctttgagtaatatctgcttgggggttgctgattcctattggggttccgtggaagacccacgcctgatgccctccctcagtaaggaatgcacttccctcctggcatcgagcctggggctagcatgggcattactgggagaactgagacgattgtcacgcaccatcccctgtgatctgtggttctgatgtgcagcctcagctgaaaacggtcttcacctgtggctgtgcttacctgcgccactacttacagtgttttgaagagcaggatgaaaacggcaaaaaccttgactgtttctgctcaagtgtcctgaagtagaggatggtggggatgataaatgcttgctaggaaataagtccaagggctctataggacttcacagggttttagtttatgtctctaactttagcaaagctgcattcctattggaatgcatactggaaacagctctcattcctacctttaaagggctcttggaaagcagtgtgacaaccaaggtcactaaatggtgagatcatcaagccattttaagttctttctcatgttattcaccagcaccctgcaggacgttgggcacacatcacatccctcagctcagccatccagccgtctcagtgattcaccactcatttgcttaattaatagacaggtttgatcactttgtacatggaaggcactgtgccagtgaacaagcagttggacccagccctccagtagggaatggacagctgaaaatccatgagcaagaaagaaggaaaaagaaagagttctgagcagccaaaccatttctcgatgatttcagagccttcattctgagcatcagttatatgctctccagtgtaatgactttatagccaagcacagtaattgatattactgtgaaggcccttaacttatcaagaaatggttgaggccgggcacattggctcatgcctataatcccagcacgtgggaggccgaggcaggcagatcacttaagcccaggagttcaagcccagcctgggcaacatgatgaaagcccatctctacaaaaaaaatatacaaacaattagccaggcatggtggcatgtgcatgtagtcccatgtagtcccagctacttaggaggcagaaacacctgagcctgggaggtcgaggctgcagtgaattgtgctcacaccactgcattccagcctgggtgatggagtgaaaccctgtctcaaaaaaaaagaaagaaaagaaaaagaaagttgacttagctatactccatataagaaggtatagaaatatatagagcaatttagaaagat

SEQ ID NO: 13121 - DNA, 17514 bp, Human
tggcgtggtcggatcttcctggtgtccgggggagctgaccgaggtccccagcaaggccccctcccctaactttatttcccctcaccggcagagccaccaggcctgtcccctcttgtattgccataaaccccattttttctgatagggtctcgctccgtcgcccacgctggagtgcaggggcgcgatcacggctcactgcaacctcgaaatccggggctcaagcgagccttccgccttggcctccccaagtgctgggattacaggtgtgagccaccacacacggcctccatttcaaacttagtttccacccggacctcaactcgaaatcccccatcagccgggcagaaaggtcctggagcacttttggggcgtccgccgcgtttctcacgacgctagcttcgcttttatttcttttcccccctttggcgatatcgtcacttgccaatagcttcgctaaggtgttcccccccacaccctgcgcgggcagccccataatgttaaatgccgtaggacgggatcccgggttaatccccgtttgaccccgctgcctgcgcgtgataactggggcgcgctcctctccaccccccaggctccgccagttgggcttcgccggagtctggagataccctccgacattctcttggtgcagtgcgggtggtcttaccccgcccttgaggaagaaaggcccgacgcaggcacagatcacaagaacgcctcccctgtgcagggggcttgcactgtgccaggtgctgtactgggcgcttggtaggtggccaccctctccagggtcggggccaggacctcctgtggtgctcagaggggtcgagctgtcaggtgaaaaccactggcccgagttatggctttgaagggaatcctgggggtctgggatggcagggacctgttaatttagatcgcacggacaagatgacttggcccttagctcctgcaggaggggtagtggactattgcaggtggaagggactgcacgggcacacatggagagtgcgcggaagagccttctcccaagggaaactgaaaggggttgcggctgaatttagaactggacagggtccgaagacagtcggcagcagcgagtggttttctactgaggaaaaggctcagatttgggattttaacaattcctcctagaggtagaaatgaacacggtatagtgatggcgacagagataccctgggagttcctgtcaatcttggtctagccttccggcgcacacacagcggtcgctccataagggggccccgcctctgggcggtgcctgaaagcgtatttgcgcatgcgttctcgccttcgctcgtttcgtatactgcaccaaagagcgcctaccctggggcggggctcaccatttcatccaatcagagcgtatcaacagtcctaccatctggtgagagggtgcgctccactctccattgaccaatcagtggagacgcagaagaatgggcatctgtaaccaccactggagagagaccaaaaaagggcggggcttccttgtctccttgcgaagtggcgcgggaaggtcgtcattgtgactggtgctgacggattagcgaggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggtgaggccagggccctaggcgctgggaaggccgggaactgggggacaatttcccagcttgagggcattttattttttgaggggggcctctgcgcacgcgcccaggccatcgcgtcgttgacggtgtgggggaggggcggccgttgggcaaacggcggggtttgcgcgaggacaggcgcctgcgcgtgcgcggggtccggagcggggtgtgggggagcgcagaggaagtagctcgtgaggcgaatggcccagtgcgcaggcgccgcgggctggcgtgtgggggccgggcacgcggcccggccggtttttttcccctttatcattttcttcgctggctccatgcgcaggcgcagtgttcccgcccggcctcgtgggcggttaggggagcgcctggtgagcgggaacgggtgggcggcggccttgttctctagagtggggaattccgtctgatggcagcttaatctctaaggcccagccttgtgtctatacagaaatggatgtgtttgagcctagatgctctcatttttgtaggcattgaaaatgggaagaggacttgtgaaatgcacttttagccttttaggagttgagcgaagccttgaaaccatcacaagtttgcttacagtttccggggattcactgggtaccgaggatttgataaaccaaactatttcctggccatgttggaagcatttcgaccccctgtaatcagtccctccgaaaacaccagtcgttgcttttggagtggggcccagtccccactctttccaaaatcttgaagtcttacagggccgcctatttgcagggttttccagggtttaggggttacgagttgctagcgttttaatcttggccttgtcccacacattttaaagacatcttaattgaaaatccttaacgcttcctgaggttgggggagatactgggattcccgatttacaaaggaggaaatgggccaggagagagatgagatgaggtgaattactgtaggtggcacagctagtgaggggcagggctggagttagaactcccatttgtgggagctgctaacctggcgggagtgcctcaccctgtggttcgcgtggatcgctcctgaaatagaatccaattctacccaccttccacgcacttctgcccagtgattctcagacagggggccggccccagagcccaggagaggcggaagagagttaatctttctcctgatgaccagaggcttttgtcggtgggtgtaagatacttctcttaggaaggagcagtcggttcttaatggtatgggttggagtctctggtctttctaaaagactttccatccgggagtgggggctcatgcctataatcccagcactttgggaggctgaggcaggcagattacctgaggtcaggagttcgagaacagcctggtcaacatggcaaaactccgtctctactaaaaatacaaaaaaattagccaggtgtggtggcgagggcctgtaattgcagctactcgggaggctgaggcaggagaatcgcttgaacctgggaggcggaggttgcagtggactaagatcacgccatagcactccagcctgggtgacagagtgagactccatctcaaaaaataaataaaagacttttcttgtctggtttttcttagtctgacctaggcagtaatttccaaagcagattttggtgggagggtgattcaagactagaaggggtcaagactggcctggctgccccagtttctggggcatgtgttgttttttgccctgactgaacctgggtgtgagtggtggggaacaggtgtgcttagctagatgatggtggctcagccagttaaagggcaaggaatttggggcacatgcaaaggggatgtcctcattcaaactgtagcagatagctgttagagcccttgctgccagtgtatctccttttccagctactcttttcccatgtttccttggtcgagtggaccagtgggaagagaggggggtccctggaagaacgtaagatttgggacttgtgtggccctccctccgttataccttcctcagaagctacagcaagagccagtgggcaagtgatcacccactcaggaccactgttctgctgacccagaatccttctgggctgattggcttcaattgctgcccctagtctttcctgtgcatccttcacggatgacctccaactgttttatctgactgggtctacaacagcacagaggccagtggggcgtcatcttgtacagcaagaaaataattcttgtttttgcttcctttctcaggagaactacgatgacccgcacaaaacccctgcctccccagttgtccacatcaggggcctgattgacggtgtggtggaagcagaccttgtggaggccttgcaggagtttggacccatcaggtactgggctcagaggccaggtgttgggcttccaaagttgactcctgggtgtccttgtgtgtccacgatttctggttggaaatagtgattttgttgccatcctggtctagattctgtggccgctctgcttttgggttggccattgtactttgtgtcagattacagcaagttccatgaccctttttccttccttcgtttttcctctgccttgtagtttctagtcagtgttctctttttcagacagagcaaggtctcgctttgtggcccaggctggagtgtagtggtgcagtctcacccaggctcaggcagtccttctgcctcggcctgctgagtagctgggactataggcatgcgccaccatgcccggctaatttttacatatatatattttttgtttgtttgtttgttttgagacagtctcttgctctgtcgcccaggctggagtgcagtgacaatctcagctcactgcaagctttgtctcgtgggttcacgccattctcctgcctcagcctctcgagtagctgggaccacaggcgctggccaccccacccggctaattttttgtatttttagtagagatggggtttcgctgtgttagccaggatggtctcaatctcctgacctcgtgatctgcccgcctcggcctcccaaagtgctaggattacaggcgtgagccactgcgcccggcctaatttttatattgttctgtagaggtgaggttttgccatgttggccaggctggtctcaaactcctaggcccaagcagtctgcccacctagccctcccaagttttagggttacaggcatgagctactactgctcctggccagtgttctttcattcagcaagtagttactgaatatttggtgcatgctatatactgcaaatacagtagtgagctgtatctggatgcttctcttagaaagttgccctcctagagtgatttgcactgtcatagtgtaagctcaagaagccgtctgtgggtggcatctgacagtctggtgaggagaggtcaggaaggcttcccagagggacatgatggctcagctagacctctttggcttttggtactacttgtggcacagggtgttcaggtcggggaaccatgatagggttgcagaggagttcagaggccatggaggagtcagttctcaaaaaatcaaatgataccctcctcctgtctacattttcctgagaggattgaaacctgtgttctctctgccagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggtacgtgccagcaggcatttcttgtgaggtctcccttccttttctccccttattccctcccccaagccagactgatctgccagtgccccttcatcttgcctgtgtttgcttttgcaggatgttctttacactatctgtaatccttgtggccctgtccagagaattgtcattttcaggaagaatggagttcaggcgatggtggaatatcctttgctggaaaacaggtgttccttagggtagggactcttgcagggcttgacagtggccattctttgagccagcatgtgtctgctgaccacgggagtggctgccatgtgccagatgccttcacagagcccagtgactgagtagggaggcagttaaaggaccaggcatatcgtgtggacgtgcagatcttaggggagagagcagtgtgttgggagatacaaaggaatttatttttctttttgttttctttctgttatttacttatttatttattgagatggagtttagcccttgttgcctgggctggagtgcagtggtgcgatctcagctcactgcaacctctgcctcctgggttcaagcaattctcctgcctcagccttcctagtaggattataggcgcctgctaattttttttatttttagtagagatctggtttcgaactcctgacctcaggcaatccacttgcctcagcctcccagattacaggtgtgagccaccgcgcctggctaggaatttatttttaaagatgtttattctaagttcaaatatgagtgacaaagatttggggaacatagtctcaagaggtcctgagaaaatgtgcccctgggaaaaggaatttatttaaaaggggatatggggccgggcacagtggctcatgcctgcaatcccagcactttcggaggccgaggtggacagatacctgaggtcaggagttcgagaccagcctagccaacgtggtgaaaccctgtcgctaataatacaaaaaatagccaggcatggtggtgaacgcctgtaatcccagctactctggaggctgaggcaggagaatcgcttgagcctgggaggcggagattgcagtgagccgagactgtgccactgtattccatcctgggcaacacagcgagactccatatccaaaaaaaaaaaaaaaaggtggggcatgtgtgaaggttgctgaggaggtgatgtcctatgagcaaataggagcttatactcaaggtggaggaaacagcctctgcaaaggttgtaaagtcagaaggagcttgtgttggatggagaaattgaaagacctgaggattgcaaagtggctggcaagcagacgggtttggaatagacattggaagaagcttttagggcatcctagacagcgttgcgatgcttggggcaggggcaggaaaaagccactgatggactttcagggcagagctgtaatcgagttgatgtttcagatttagtcgaagggtgtgagagggctgagacggagaaagtggtgtggcagaagaggttgctggtggccatgggtcggggtgcagattatgagagaactctggccagtgactgctcacccggggcagcgttgagtccatcaacaccgttttggtctcttaacctgaggctagtggctgggcagtgagctaatcccaaagcttccgtctgtaccacagtcttggggtgctaccttgtccttatcacactctggggtaacttgaagcccttctcaaagatctcctgtgatgggactttccttaacttgactcacatttgactcagttcaaagtgcccagcgggccaaggcctctctcaatggggctgatatctattctggctgttgcactctgaagatcgaatacgcaaaggtacatctgggaggtgactgactgccccttgtcagcttccaggtgagctggggcatggctgacctcaagtcttgtcttgtcctgtccttgcagcctacacgcttgaatgtgttcaagaatgatcaggatacttgggactacacaaaccccaatctcagtggacaaggtaatcttgacgaccactttgttctaaacatacccgccttgctttcactcgactagtgcacttaataggcctgggctcagggttatgtaatgccattgggccccccatggacatgggagggccttggggtcagcacttggacaccctagtgggatgggggagtgagaggcctccatgggtcttcactgctgcttggggccctccgatgctgctcaggatacagaggcaaggcagaagcctggatgggcggggagcagggcctcactgaggatgaggcgtgggggcggccttagaaaccagcagtggctcctttgagagtctggtgagggtcactcactccattcttgctggaccaggaattgtcctcttgttctgcgctgttgagagggtctgatttgggggagtgacagtgttggggggcgatgaggtctcctgggctcttgcagtgagccttgtgagcaagctgaccctgtggaggtgagacactctggattggaccagggcggacatgcctcacatcatttgtagaggggacgcaacatctctgcaggtggcccaaatggacaactcccttcctagtgtctgtcaagaatggtttgcctttggtagcagggagaggtggaggattgcctatgagaaacagcggcagccccccaacaagaccatccatctcggtgtctgtcttggtctgatacgtcggaccaggccatgggctgagggaggaggctcgatgctgacatcgcacaggccctgagaggccagagccccccattcctaggcaggcctgtcttgctcgcccttgcatctgggaagcagtgggcagggtgggctagactcttccccaggatcctcacagtgggccctgtgggcctggctgctccctccaaaggtcagaggcaaattggtgaccaagtgaatgtaccagagcgggcaatggcattacatgactgctaacagaaacatggcaacaaccatttcttctccaaggaacataaatagaagatgtgcagaccggcaggggctagtggcagggggctggctgtgcattggttttgatgcctctcagctttggcagccccaaggctggggcccaaaaaaaaacgagggctgatgaggtgacctggagtgagggcggtgcttcgccacccctcaggaaccatacttcagcggctctgcctctgcacattgctcaccaacacacagggtagaaaaccactagctcttcctggagagaacagaacatgcagcctccaccacgtccccagaaacagccgcagacttgagctcactacatcaagaacaccacaccgcgctccaaggaacagctacaagcacagagacagaggcatacagagacaaagagagaaagagacgcaacatggcagcagacactgctttttttattaaacattaaaaaaaaggtcaaaatccaagcaaacttgaacccgagaatgtacacagaagtaggaaacacagagaacagagctgtcccagccagccagcgagcgatgctcttttcggagaacgtttcatagacggaagtagattccatgggcctccaagacaataggatcctctctccattcctcgccatatgggttttgttttttaagtcatttggtttggggagggccttgttttttttctgttttgatatttttattttttctgcagtcaccggctgccaacataatctgcaccaactggagatcagaaaccaaaaaaaaaaaaaaaaattttaaccacaacaaaaaaaaaatcaaaaaaaccaaaacagacctaaaaccagacagccaaacagctcagaggcacacagttacctgctgccgggtaaccaggcgcgctcccaaggccaaaagcgcgagcgtagtggggccactggcacacctcataccaggagacacgcacacggagcgctacacagccagaagcaccgcaccaccgcactgcagcacatatgtgaggaggtgacaacatggagggacactacccacttcatacacctttatttccacttttctgatatcttctgaggacagaacatctgtgagccatttttgatttaatcaaaatattgacttttaaaacaattctttaaaaaaattgtagcggatgtgtaccgtgacttgtatttatgactgtaaaaccatgtgatgcagggtcgcagtgtatgtttgatgggacgccatctttcagaactgtgctaactcactgttgaagcgtccaatggtaagagaaaatacagatttgttttttgtgacaaatggacattgtactctgtacttctgctgtaagtagtccttttccattttgtaatgactggtaacaaaacccaggccgggtggcaggaaagggcagtggtttcgagccctgggttttggagtcagccagacctgggttcaaatatggctcagccactgtcttgctttgtgactttgggccaaagtgtcttttaactgctcagttaaaagttaacaactcagtcttcttatctgtaaaatggggctgaaatatcagaacctacctcatagggttgttgtgaggaatttcagaagctgtgatgtctgtaaagcgcttagcccagtgcctgccacttaagcgctaagttaaaggcagtgattacgaactgctggggtcggggtggatctgcgccattgctgggtgtgggaatgtcgatgccttgtacatgattgcttatttgaactgattctgctgttgccctgcttgtcagctacagtcagtccctcttgggctggcgggactgggagggaggggggactgggattaagaaagaagggatctaacagagacagtctggagctcctagaactttgggggctttgggggtcaaacttgcttgcttccctctggggttattttcctcttaatctactctcccttcattgggagtcactttagaaagctgcttttggcccgccataatatatcagcttctgtagcagctgcacattccccagagggcctgggagctgggctttctcccagggccagggtaggtgagagcacagaatctggccttgtccttcacagaacaaggccagccctttggtatgagcaggggaaggagagtgggcaccagctttgaggctcgggcttcatgcccgccgtaggtcagatcacaaaaggaggccccacagccctcgaggaagggagggcttgcagtttgcaggagctgggggctcagatcagcctgtgcagtcaggagggagggagagaccccaatttctgagtgagactcctaactgttttctctctccacaggtgaccctggcagcaaccccaacaaacgccagaggcagccccctctcctgggagatcaccccgcagaatatggtgagggcagggggttcccctccgtggactcccgtggctcatgtgcccctgcccgccgcccgccgtgcaaattctcacccgtcctccctctctttccttcccaccccccaggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgagctgctgccgggccccctgggttcctcgctgagcctcgtatcttgccagtcagcacgggaaagaaccaggggggagcctggtgtggcgctgggcgggcagacgccaatgagtgactcagtgagctcaggcagcctgcttgcagacgggttttgtttggtcctcactgtatgtgggtgttgtgtttttgaattaccaatgtttaaaaaaaagattttatcacataaaagtactaataccagtacatgaacatagagatttataaaacataaaaatgaatccattatagtgaaacaccatcgtttaaggatttcctcctgaaaacttaagacctggcaacaccgggccttctgccttcccatgggacagttgactggggctagcggtggctgagtgtctacctgagaccaggcggcattttgcttaacattaaacccgtctgggtcttgggggcctttgtgcagctcatgacttggcccattacttagagtagttcgtaacacaggtgaagtgttgttagttaccaggcactgttaaagatgctttacatgtagtgacctgtgtaatttctcacattaatccttaatgagatggacaggggaagtggaggacggggcttaaataacgcgcccaggttcacatagcctttatgtgaagcaggactcagagccagactgcctggctccagagccggcactgctctgttgtaacccagctgaaggagtattttaccttgtgactgtagacacagccatccatagatcacacacgtctgtgtgtaacagacaaaatggtgaaaatggctgatttgatttctgattcctgtacagttttctgtcatgcttcactaaatgatttactggtgggttatgtcccacagttaaaaacatggcccaggctctgcttctcactatgggttgagcacttggtgtgggccaggcatgtttttctagtggtcccgattaactgtgaggacatgggaggccagagcaggggttattatcactaacttgggaggggcaggagaggggaccctggcagctggacagaggtgctgactgcagctactctccccaaggtgaaattcatgaaaagcaagccgggggccgccatggtggagatggctgatggctacgctgtagaccgggccattacccacctcaacaacaacttcatgtttgggcagaagctgaatgtctggtaggtgctcaggctcgggagggcagcagaggtacaggggagagaaaaggaggggaatggggcccagcagaggagcacagtgaggccgaggtgttgactcacacagaaatgggatgtggcaggtgtgttcccagacgtgtctctgacaccacaggagaaagtgagtcagccttgcctcaggtgtagagcaatgccccaaggcacacagggcaagctaagcctctggaggccacaggggaaagcttcagggacaactttgggtatgacaaaggctcccctttcttccttgctgcagtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgaggtgtgtgccgtggagctgcgcaggcagtcgggtccttgccacggccgtctgagtaggccattcatttcagtcttttctgcaaatagctgttgaactcctgtcctgcctggccctgggttgagtgctagggacacagcagaggccaggacagataggaatctgtgctctcaaactggacagggtgagaatggcaccaagtttctagcaacaccatttgccgcgttccttccttttacatttttggcaagcagggcaactgctcgtttgctgggaaagctgcttcacaggcccagtgatgagggcccaatttcacaagaaccgcattggcgtaggcttcgggtgccatcaccctgataccatcagaaggtggggccctgtaaagctcagtcagggggaactgaggcagcggaagggaggaggaactcaagtggatctggctgtggtctgaaatgttgaccttgcattcagcaaacagtgttcagcaaacagccgggtgcagatatccacatagctgttgaagttgggaacgaaaaagcagcttcccagtctcaggcaacttaataattaaagagcattgttgctggcctttttatgacacagggatgccttagggtatgtgataaaatctacaagccttttctcctgaaaacttcaagtactgagtcatgcagggcctggtctgcttgaatcctgtgtggcggcccttttgtttcagagttcatttactacctgttttcttttgcagatctgcgatgagctgggagtgaagcggccatcttctgtgaaagtattctcaggcaaaagtgagtcgagtgtgcccacctccttgccctaattgcatggtggttggtgggcagctgcctagttcctattgggtgagtctaaaacctttacttttccccttggtttgcaatcaggtgagcgcagctcctctggactgctggagtgggaatccaagagcgatgccctggagactctgggcttcctgaaccattaccagatgaaaaacccaagtgagtatctgtgtgtcctgcaggcatcaacctggtgacctaatgggttggctggcttcaggccagggatgtccttcctgcccttgagataggaccccgggatcttcgcactgttggtgacacaggcaggtgggacctgctcatcaggagagcagcctgtgctcctcatgggagagccagcctgactgcctgctgccactcactctgccagcttgggagttgctcaggcttgtcctccagggaggtggcattctcttctttgcatcagagactggcttaggtaggaaagccactctgttacctaggaaagaggcaacactatccagcaggtaaaacttgcccacccagttgctgggagaggcccattgccttgggctggcgaaggagataggaatgggattctctatgggaatgaaggaagagaaggagaaacgccgtgcataattggtaattggctcatcttgaagcctcacgttgggcagtcactccttagacccctgccgttgacctgcagaaaatgggagatgggtacaaacttgaggggacctgggtttggggagcctccaaagacgggaaccaaccaaacttgtctctcctttgcagatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagcacttgctgggattccaggatgtctgcttttctccctctctgtcctgaagacacaggcaggcctgagcacagtcacaggccctctggaggcatacagagacccaagaggagcagggtgggctgcagactgagaatggtgctagcaattgagtctttgaggaaaatccatcaggcttagtggcattcttactgggccctgcccgagcaagctctatcaggcgcagtgggtcatcacacctataattccagcaatctggggaggccaaggtggggcagatactttgagctcaggagttgaagaccagcctgggcagcatggtgaaacgtcactacaaaaaggtgggtttggtggaacacctgtagtcccagctactcgggaggctgaggcaggtgggtcagttgagcctaggaggttaacagtgcagtgatcacatcactgcactccaacctgggtgacagtgagaccctatctcaaaaaaaaaaggtttccagccttgccatcatggtgaaaccctgtctctactaaaaatacaaaaatcagccgggcatggtggcgcatgccagtagtcccagctacctagcaggctgaggtggatcaccccaaccctggagggtgatgctgcagtgaactgtgatggggtcattgcaccccagcctgggcaacagggtgtcaaaaaaacccaaaacctttgtgttctgtatcatttcagagtgacttgtctttacccttgcagtatcattgtgtggatgtgtcatgatttaacctggtcccaaagggtagtttccaggtctatttttgctattgcaaacagcgctgtaacacgtatctacacaagtatcttggccagcttccctgatactgatcaggagataaattcctgccagtggaattgctgggttaaaggatatatatagctggatgtagtggcccatgcctgtaatcccagcactttgggaagccaaggcaggcagatcacttaaggccgggagttttgagacctgggcaacatggcaaaaccctgtctacaaaaaataagaaagtgggccgggcatggtggctcacgcctgtaatcccagcactttgggaggccgaggtgagcggaacacttacggtcaggagttcgagaccagcctggccaacatggtgaaaccctgtctctactaaaaaaataaaaattagccgggcatggtggcacgttcctgtagtcacagctactcaggaggctgaggcaggagaatcgctggaacccaggaggcagaggttgcagtgagccgagattgtgccattgcactccagcctgagtgacgagagtgaaactccgtctcgagaaaaaaatatatagaaaaatgatgtgggcatggtggcacacactgtgcctatagtcccagctactcatgggggctgaagcaggaggatcacttgagctgtgagctgtgatggcaccactatactccatcctgggcgaaagggcgagaccatgtctcaaaacttaaaggatctatataattgcatcatacggtagatagcttcccacttgcagatgcaaatctgtgaagatgccttgcggtggcgggtaccacccggaaggatcctggtttaaggattttgactcctactggagggaagaggtgacctgcagaggagcaggtcacaaaccttgaagtttatgcatgtgtgcttgagaatagcccactctggggaatttactgtgaataaaattttcttttttgagatggagtcttgctctgtcacccaggctggagtgcaatggcataatcttggctcactgcaacctctgcctcctggttcaagcaattctcctgcctcagcctcccaagtagctgggattacaggcatgtgccaccatgcctggctgatttttgtatttttagtagagatggggtttcaccatattggctaggctggtctcgaactcctgagatccactggcctcggcctcccaaagtagctatgatacaggcatgagccactgcgcccggc

SEQ ID NO: 13122 - DNA, 15265 bp, Human
tcgggaggctgaggcaggagaatccttgaacccaggaggtgagtttgcagtgagctgagatcatgctgctgcagtccagcctgggtgacagagtgagactctgtctcaaaaaaagaaaaaacaaaacaaaaaaggactttggggtttctggccgggtgcagtggctcatgcctgtaattccagcactttgggaggttgaggcaggtggatcacttgaggtcaggagtttgagaccagcctggccaacatggcaaaacctggtctctactaaaaatacaaaaattagccaggcgtggagtaagcctgtaatcccagctattcagaaggctgaggcaggagaatcccttgaacctgggaggtggaggttgcagtgagctgagatggtgccactgcactgcagcctgggtgatagagcaagactctgtctcaaaaatgagcaaacaaaactttgggattttttatccatatatcatcccaatcttccggatttatgtttggaatgactgcaagagaccaagcattaagttaatgacttctatatgctatgtcctgttctgagcatttattatcttaatgatcaaggactctatgaagttgatactattatgattattattattatgactattattgttgctatttttagagacggactcttagtctgtcacccaggctggagtgcagtggcatgatcatagctcactgtaaccttaactcctgggttcaagcgatcctcctgcctcagcctctgagtagctaggaatacagatgtgtgctaccatgcccagctaatttttattttatttttgtagagatgggggtctcactatgttgcccaggctggtcttgaactcctgggctcaagcagtcctcctgcttcagcttcccaaattgctgggattgtaggcacaagccaccacacccagcctaaggttgatactactcttttctttatttatttatttttctgagtggcagttggacccacagctagaacttatttggcagattaataacatacaggcattactggatcacaaattcatttttaaaatattttgatagctattcaatacttgtttcctctcttatgaattcctttttttttttttttttttgaaacagagtctccatctgtcatccaagctggagtgcagtggcgtgaccttggctcactgcactctcctccactcaggttcaagtgattctcctgcctcagcctccaagtagatgggattataggcacccaccaccatgcctggctaatttttgtatttttagtagagactgggattttgccaggctggtctcgaactcctgccctcaggtgatccatccacctcggccagtcaaagtgctgggattacaggcatgagccactgcacccagccgatactactatatccccattttacagatgagcacatgggcaaattgagggtaaggcactgacccatgatcatacagctgagaagtggcaaaggcaggatttgaacctagaacctctggctccacacactagtaatctaaaccactctccctacaatacaacatacgtggtaaagatgtgtggtgggcacgcaatcaacgtaggtcccttcacagttgctgggagaggcaggaatttgcagttcctccgcgttctcctcctccgctgcccacctgtcctgggtcattcctgcagcctgccctgccctgcctggtctcaccctccctctgccaacagaagtctgggcagggttttatgggctctgataaggccctggcagggccgaagttcatgagcacttcctctttgcaggagggcgtaggggaggggacccaggtgatttgggtcctggctggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacaggaccagccactagcgcagcctcgagcgatggcctatgtccccgcaccgggctaccagcccacctacaacccggtgagatgccagctcaggccccactccgcccgcagctccgtccataagccctcacaccaattttccccactctgatcctggggggccccatctgactctgtggtctgatttacccaaagctgaccccgaccctcgatttactcctaccctgacctcaggctgtctgtgtccacgtctaactgttggccctcgtcatcttcaacctggtcctcccccatggtttcctctctcctgcttaagggactggggggcttttctgggaggggtaaaggctgcaacaggcagatggcttgtgagtcccctcaccaggcctcttctccagacgctgccttactaccagcccatcccgggcgggctcaacgtgggaatgtctgtttacatccaaggagtggccagcgagcacatgaagcggtaagaccctccccaagccaggccgggctggcaggggacttccaactgggtgctctgggcctggctgttgggggctttctgcccttaccccaccctggtggagaggggactctttttctgccccacccaatagccagagatgaatctggggcagatcaggagtggggacgtgggggccagaaggttcagggagggctcaccgtgagaggcagtccctgagttggacattagactgaagctgatgggtgcaatggcaggaattcagatcacaggctcagagccgggtccccgagttaaaatcccagctctgccactccccagctctgtgttggtgaaagagtgaaagtgactatacctctctgtgcttcattttcttttcttttctgtttttgttttttttgtttttttttttgttttgagatggagttttgctcttgtcgcccaggctggagtgcaatggcatgatcttggctcactgcaacctctgtctcccaggttcaagcgattctcctgcctcagcctcttgagtagctgggattacaggcatgtgccagcacactggctaatttttgtatttttagtagagatggggtttcaccatgttggtcaggctggtctcgaactcctgacctcaagtgatcctcccatctcggcctcccaaagtgctgggattacaggcgtgagccactgcgcctggcccagtcttagctttttaaaaagggccttaacacgttgataatgattggcctcataggactttttttttccttagagatagggtcttgctctgttgcccaagctggagtgcagtggcacaatattatagctcacttcggcctccaactcctgggctaaagtgatcctcctacctcatctttccaagcagatgggactacagacatgtgccaccatgcccaactaatttaatttttaatttttatttattattattatttgttttgtagagacaaagtcttgttatgttgcccaggctggtcttgaactcctgtgctcaagcgatcctctagcctcggcctcctaaagtgctgggaggatcaggcactggtatgagccactctgcccagcctgttgtttatttatttattgtttacttcttcactgagtgcctattctgtgtcctggcactagggatggaggagtgaacaggacagagacccctgccctcgtggagctgatgtcctagtaggggaaacataaaaaataagtccaggccgggcgcggtagctcaggcctgtaatcccagcactttaggaggcctaggcaggcagatcacctgagatcgggagttcaagaccagcctgaccaaaatggagaaaccctgtctctactaaaaatacaaaattaccagggcgtggtggcgcatgcctgtaatcccagctactcaggaggctgaggcaggagaatcacttgaacctgggaagtggaggtttcggtgagccgagatcgtgccattgcactacagcctgggcaacaagagtgagactctgtctcaaaaaaaaaaaaaaaaaaagtcaaatatgtaagatgtcagatgatattaagtgctatgaagaaaatgaggagggaagggagatggggagtgtatgtgcggacagaggttccctttaaattgtccccttaaatagggtggcctggccgggcatggtggcttacgcctgtaatcccagcactttgggtggctaagccaggcagatcacctgaggtcaggagctcgagactagcctggccaaaatggcaaaatcgcatctggctgggcgtggtggctcacgtctgtaatcccagcactttgggaggcagagacgggcggatcacgaggtcaggagatcgagaccatcctggctaacacagtgaaaccccgtctctactaaaaatacaaaaaattagctgggcatggtggcgggtgcctgtagtcccagctactcgggaggctgaggcaggagaatggcgtgaaaccaggaggcggagcttgcagtgagccaagattgcgccactgcactccagcctgggcgaaagagcgagactccatctcaaaaaaaaaaaaaaaaaaaaaaaaaaggcgaaatctcatctctgctgaaaatacaaaattagccaggcatggtgacaggtgcctgtaatcccagctacttgagagcctgatgtgggagaatcacttgaatcctgaaggcagagtttgcagtgagctgagatcgcatcactgcactccagcctaggtgacaaagggagactgtctcaaaaaaattaaaaaggtggccagagaaggcctgcctgggaagggaacatatcagcaaagaacagaaggaacggagagagggatccccagggacagctgagggaagggccttccaggcagagggaacagccagtgcaaaggccctgagacaggcctgtcctggggagtaatttcaaggatgctggtgtgcccaggggtgcggaatatgatgcgtcatgggtgtacacagggaccctctggctgcatgagggaaatgatcttcagggccaggaggggagcagggagacccaaagtgcataggacagggcctggcccgtggcagacttgtaacagtcataactggaagttgggaagagggtggaggaggtggtctaagaaggcaaggtgggctgggtacagcaactcacacctgtaatcccagcactctgagaggccgaggtggtaggattgcttgagcccgggagtttgagaccagcctgggcaacatagtgagaccccatctctacaaaaaaaaaaaaaaaaaaaaaaaagccaggcatagtggcatgcacctgtagtcccagctactagggaggctgaggcaggagaatcagttgacccaggaggttgaggctgcagtgagccaccatcgtggccactgtactccagcctgggggacagggtgagaacacaagaccctgtctcaagaaaaaaaatgtcaggcacggtgtctcacacctgtaatcccagcactttgggaagccgaggcaggtggatcacctgaggtcaggagtttgagatcagcctggccaacatggtgaaaccctgtctctactaaaaatacaaaaattagccggacgtggtggtgcacgcctgtaatcccagctacttgggaggctgaggcaggagaatcactggaatccaggaggcggaggttgcagtgagctgagatcgcggcactccaactccagcctgggcaacagagcaagactccatctcaaaaaaaaaaaaaaaaaaaagaaggaaaggctgtgagcgaaggtgtggtggtgggaatctgcccccctcagaactcaggtcctctccacgctgtggcccacagtgccaaggttgcccctcagagctggtgctgaggtccgggccagggaggccgaggacagggcggcagggagagggcttcctggaggaggcccccaggccccgggaggtggcaccaggggaatgagccctttgtgtcccgccaggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtctgcatgctttctctcttgcttcccaagctggagtgcagtggcgccatcttggctgcttccttccttcccgccttccttccttttctttctttctttcttttttttttttttttttttgagatggagtttcactctgttgcccaggctggagtgcagtggcatgatctcagcttactgcaacctctgcctgctgggttcaagagcttctcctgcctcagcctcccgagtagctgggattataggcgcgtgccaccacgctcagctaatttctgtattttgagtagagatggggtttcaccatgttgcccaggctggcctcgaactcccgacctcaggtgttctgccctccttggcctcccaaagtgctggaattacaggcgtgagccaccacgcccagccccttccttctttttcctctttttccttcctctttctctgttctctcctctttcctcccctccttccttcccccttccctcctctcttcttccttctctctccttccctccttcatttatttcctttttccatccccactttttatgtcaacttctttcttttcttttccttctttcctgcctattttattttattttattatttatttatttatttatttttatttattgatcattcttgggtgtttctcagagagggggatgtggcagggtcataggataatagtggagagaaggtcagcagataaacacgtgaacaaaggtctctggttttcctaggcagagggccctgcggccttccacagtgtttgtgtccctgggtacttgagattagggagtggtgatgactcttaaggagcatgctgccttcaagcctctgtttaacaaagcacatcctgcacagcccttaatccatttaaccctgagttgacacaccacatgtctcagggaacacagggtaaggttacagattaacagcaactcaaggcagaagaatttttcttagtacggaacaaaatggagtcttctatgtctacttctttctacacagacacagtaacaatctgatctctctttcttttccccacatttcccccttttcttttcgacaaaaccgccatcgtcatcatggcccattcttgatggtcgctgtctcttcggagctgttgggtacacttcccagacagggcggcctggcagaggcgctcctcacttcccagacggggcggccgggcagaggcgctcctcacctcccagacgaagggcggccgtttcctgcctatttttaaaaatcctcttttagcgcttttccttagtcccattaccctactgctgagagtcttgtaatacatttcatgtgtatttcctcctaccactttgtgttttttgcaaaacgtgtactttttgttttcctcttgagactgggtctcgctctgttgcccaggctggagtgcagtgatgcaaacagctcactacagcctcaacctccccgggctcaggtgatcctctcacattagcctccggagtagctgggactctaggtgcacaccaccacgcccggctaatttttgtatatttttgtaaagacggggtcttgctatgtttctcaagctggtctcgaactcttgatctcaaatgatcccccaccttggcttcctaaagtgctgggattacaggcatgagccactgcgcccggccagtgagctgatttttgaccttagcttgacctctgagctgtggactccaaggttcctgatgctgaggctgtcccagctcatccccaagactatcgactcccaatgaaaaagatccctgatccttgcttttttttttttttgagacagagtcttgctctgtcacccaagctggagtgcagcagcgtgatctccactcactgcaacctccacctcccgggttcaggcgattctcctgcctcagcctcctgagtatctgggattacaggagcccgccaccatgcctggctaatttttgtatttttagtagagatggggtttcactatgttggccagactggtctcacactcctgatctcaaatgatccacccccctcagcctcccaaagtgctgggattagaggcgtgagccagggtgccctgcccttgcttcctgtttgtaccttcccaggatcatgggtgctgactcctgacctcccatctctgccctccaggtggtggtaaatggaaatcccttctatgagtacgggcaccggcttcccctacagatggtcacccacctgcaagtggatggggatctgcaacttcaatcaatcaacttcatcggaggccagcccctccggccccaggtgtgaggggtcccatcccttcttgcgtcctttctttctaaattcagttccacattcattttttttctttttttctttttttcttttttttttgagacggagtctcactctgtcgcccaggttggagtgcagtggcgcgatcttggctcactgcaagctccgcctcccaggttcacgccattctcctgcctcagcctcccaaatagctgggactacaggagcctgccaccacgcccggctaatttttttgtatttttagtagagacagggtttcactgtgttagccaagatggtctcgatctccttacctcatgatccacccacctcgacttcccaaagtgctgggattacaggcgtgagccaccgcagttggtctattttttctttttgagatggagtcttgctctgtctcccaggctggagtacagtggtgtgattctggctcactgcaacctctgcctcccagttttaagcaattctcctgcctcagcctcccaagtagctgggattacaggcacccaccatcacatctggctaatttttgtatttttagtagagacggggtttcaccatgttggccaggctggtctggaactcctggcctcaagtgatctgctggctacagtctcccagagtgctgggattacaggtgtgagccatggtgcccagcgcattccacattcatttatttcccaagcatctccctctgctgagttatgccaagagcccagtgatgatcaagggatcccactgggaagacagacccatcactgcaagggatcaaggccgggatggggaggcccaggctgaagggttgcagttgggtttgggcccagacagagggatcagggccaggacaggagggtgggtggaggcaggcagaggggtcaggcccagggctggagacaggaatgactgagatatctctgggccctgacctcactgggctcacagacatggcatcagagagtgacagcccagaaatggtcaggtctgtgatagggagggcacaggcagaggggcaggggctgggatatggagtatacaggaggtttgggagcctacaggaagggcttgactagtcatgggtcaggaaggaagtgcttcctggagtaggaggaagtgtgtaaggtgagtcagaaagtgaggataaggaaaggcaaagaacacacgatagtgaatgaattccctagaggttgcttaacacaatcattaaaaataaataacatacaattaaattgagtttatcaatttattattattattattattattattattattattattattatttttgaggcagggtctggctctgtcacccaggctggagtgtggtggtgcaatcacagcctactgtattcttgacttcctgggttcaagtgatcctcccacctcagtctcctgagtagctgggactacaggcacgcaccaccagccccagctagtttttaaattttttgtaaagacagaggggaggaattttcctatgttgtccaggctggtcttgaactcctgacctcaggtgatccacccacctcagcctcccaaagtcctgagattacaggcgtgagccacagcccccggcttataaagctacgtttatttgtttgtttgttttttgttttttgttttttttttagatggagtcttgctctgtggcccaggttggagtgcagtggcatgatctcagctcactgcaccctctgcctcccaggtttaaggaattcttcctcagcctcccaagtagctgtgattacaggcacctgccaccacgcccggctatataaagctacttttaaaaggccttcagaatagctggctgagaatagaagtcaaggcagaatggagttaattacaaggaggagaaaagagaaggtaacagagagaaagagagagagtaaaagttaaaggtgttagacttgggagggtgaggcgagcggatcacctgaggtcgggagtttgagaccagcctgaccaacatggagaaaccccatctctattaaaaatacaaaattagctgggcgtggtggcgcatgcttgtaatcccagctacaccggaggctgaggcaggagaatcacttgaacccaggaggcagaggttgaggtgagcagagatcgtgccactgcacggcaccctgggcaacaagagcgaaattccatctcaaataaataaataaaagtgtttggcagaaggaagcccctgcgctgaggtgtggccaagacagagagagaggcagagacacagggacagaggcagaaactgagatcaagatcagcgagtgagggccccgggacagcaggaagacagcaaggggaagggcacagagaacgaaatggaccaagcattgtcctaaagctttggggtgactcactgggcatcagcgatcccagaacatggggtgcccctctccgtgaatctgtgatcggggtgccaccctttgatgccagagttctctggcatagtggtggtggtggtgggccaccccagggcaggcactctcgacatctttcagtcgcaaatctggggaccctctcataaccgctttctctttctgtgcccacagggacccccgatgatgccaccttaccctgtaagtacttgctgataggtgagggtcttcctccctagtggggtccctcagcccctctcacccttcctgccttctgtccatcgttcagggtcccggacattgccatcaacagctgaacagcctgcccgtgagtgggagggctgggagggccccgggtgaggagtgggaatggtgagaattggggtagggggagctaagaggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccggtatggcttggggaaacagagatggatggtggggagggggcacggatctccagggaatctgagacagccagaaagggagtgggctgagggttttggggtgggaggtaggggaagggtagatagagttcgtggtcaggtttagggagcagaaggaattggggatgttttccaggaggagtgggacctctcagaaaatttgttcttgggctggacatggtggctcacgcctgtaatcccagcactttgggatgccaaggcggacagatcacgaggtcaggagatcgatcgagaccatcctggccagcatagtgaaactctgtctctactaaaaatacaaaaattagctgggcatggtggcgcgcgcctgtaatcccagctactcaggaagctgaggcaggagaatcgcttgaaccagggagtcggaggttgcagtgagccgggatcgtgccacagtactccaacctggtgacagaacgagactccatctcaaaaaaaaaaaaaaaaaaaaaaaagaaaaagaaaagaaaaagaaaatttattcttggccagacacggtggctcatgcctataatcccagccctttgggaggccaaggcaggtggatcacttgaggtcaagagttccagatcagcctggtcaacatgatgaatccccgtctctactaaaatgacaaaagttagccaggtgtggtggcgcacacctgtaatcccagctactaggaaggctgaggcagcagaattgcttgaacctaggaggcagaggttgcagtgagctgagattatgccactacactccagcctgggcgtcagagggagactctgcctaaaaaaaaaaacaaaatttgttcctttgttcctgcaaggctgggcgtggtggctcacgcctgtaatcccagcacttcgggaggctgagatgggaggattgcttgagcccagcagtttgaggctgcagtgaggcttgatcatgccactgcactccagcctgggtgacagagtaagaccccatctcttataagaaaaaaagacaggaaagaaaagaaaagaaaaagaaaatttcttcccacatctggctctgctaagctgagagagaatgggaccccccgttctcttcccacagcctgtgccatatttcgggaggctgcaaggagggctcacagctcgaagaaccatcatcatcaagggctatgtgcctcccacaggcaagaggtataacgtaaactaggtgggaacccccagccccctcctccctcagacccaacaatctagaccctctgtcccctcctcctttagggattcagaggtccagcccactggcctcttcccactggactccatctgactcccccatccctctctgtccccagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatgtgagtctgagctctcttttcccacttccttccagggcctcagtcctggccctggcctcatgcccacccttctccctgcagctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatgagtgtgtgtctccatctgctccccggctactcttcccttccttggttcagtcatgcacttcatctatccttcatccatccagtcatctgaccatccatcctcctgtcatcataaatctggttatgccccaagcactgatttagggctcattcacttctcacagcaaccccaagaggtagaaacaattattatcatccctctgtaacagatgaggaaacaaaggaaaataaaacaaattgcccaaattatacattgcataaatggcagaaggaggattcaaatccagctgatctggctcccaaggatctgcacacttaaccactatacagcctgtcgttccatccatccatgcatccatctctccactcgtgtatcccaacatccatcaatctctccatgtatccaaccaaaagtccatccaaccatccatcaatcaaacatccaaccatctagacctcatcaatccatccattgagctgattgttcaaccatcctttcatccaaccctttatccatctacccatccatttacctctgcacccatcatctcatcgtcaatctctccaaacatccagtcaaccatatgttcacccattcatccaaacatgcaactattcatctactcaccagtctgtctagctctatccagctgtttatccatccattctttcattcaaccttttatccatcacccatgcatctgatcatccatcatcttctccatccatccaaacatctaaccatataccagtctatctgtctattcattcagccatccttacgaagtctaactttcgtccatccattcatttattcatccctccatttgtccatgtaattctctgctttccatcacagtcatccatttgtcctccatatgcccattcatccctccattcagcaattcatcacttttccatctctttctatccaattatccattcatctcttcattatctatttttttccaacccttttccaactcaagctggaaagttatccattcatttatattttcttctctccatctgtccacccaaccatgctttcatcaaatcactcttttgctgatttcatcattcattgatttcttgtttttatttttatttattttttttttgagacagagttttgctcttgtcatccaggctggagtgcaatggtgctgtctcaggtcactgcaactgccatctcccgttcaagcaattctcctgcctcagcctcctgagtagctggaattacaggcacccaccaccacgcccagctaatttttgtatttttagtagagacagggttttgccatgttggccaggctggtcttgaactcctgacctcaggtggtgcgcctgcctccgcctcccaaagtgctgggattacaggcgtgggccaccgtgcctggcccattcattgatttctttcttttttttctttctttttttgagacggagtcttgctctgtcgccaggctggagtgcagtggtgccatctcagctcactgcaacctccgcctcatgggttcaagtgattctcctgcttcagcctcctgagtagctggggctacaggcatgcgccaccatgcccagctaatttttgtatttttagtagaaacagggtttcaccatgttggccaggatggtctcaatctcttgactcgtgatacacccaccttggcctcccaaagtgctgggattacaggcgtgagccactgcccccagctgatttctttacattttcattcatccatctattctttattcactctcgtgtttacttattcaccagtcactgactcatccactttcaaattagctgggttggctttctgatgtaatgggttagcaagcttcaggacaaaccatgaagtgacgaattaaaccctctatattattaattggataaaatgctgtaaaaccggttattagcatgactcaaactaagtttaaatgtttgcatgtctaaagcaactttctggagtgatggatatgttccataccctag

SEQ ID NO: 13123 - DNA, 12797 bp, Human
agatcattttttcccatcacttgtccacgagatctgtgcgttccaagaccaaatgggatacctgtctcttccagtcccaggacaaatgtggttcagaagggatggcaggcagtggcaaggaagaaggaaagtttgggaggacaggcctggacttgaggctggaaactcttctctgacaatccccagaatctgcctttccccagaaagctgcactgggtggtgtgagggattggggcaatgagccgagggccctggggtgactgtttcccctttgccacctccccccagtgtgggatgtggaacaagtccgtctctctcctcccctccaccctttcccccatctcacctgagcctcctgcaccttccctgcctgggtctccagagggtgagaggctgggggaggggagcagaggtggttacagtggggagaacgattaaggggggaataaaggggttcaaatggtcagtgagggggcaagaacacccaccaacctagttacactgggatgggatggtggtaaaaatggagcagagggagggaggggacggagaaaagatcttatctacatgcaaagtgatgccgggagaggtgattagtgaggggcagagaggctggagaggaagatttagggggacagggagaaagtaggggcttttgcccaggctggtcttgaactcctgggctcaagcgatccaaccaccttggcctcccaaagtactgggattacaagcatgagccattgtttctggccctgacttactttctttcttttttactttttagagaaagggtctcgctcatgtcacccaggttggagtgcaatagtgcgatcatagctcactgcagcctcaaattcctgggctcaagcgatcctcctcctcctacctaggggattcagggcatgaaggaacactcaggaggagttaggaaggacacgacagtgtgtgagtgtgtgtgcggggagggttagatttacaaggcagagggaagtttagaaaggaaaagagaagggaagagacgctttggctgggaggcaggtttaggagggaggtgcagtggtgcagtggaggcggtaggtttaggagaggcgcggaacaaggggaagccataggaggggtcagcaggggtccctcagcatcctctggttgcctctaacaatcaggtacccatagcaagcgggaccggggcaacttatgttctttgcagcgagggaccttagcaaccaaggtgcgagaaacacgcgatcattggcaacttggcaagtggatgtggtaaacgaaccctgaacacactgcgacccagaaacccaccagcctagcgatacagatcgctaagcaacagccctcagaatcccactccccgaagcgctccctacttcccgccccaccgcggccacccttgggccccggggcctgcagcattcagccaggccccggcgcggcccgaccctcctacccggatccccgactcacggtctggctctgccatgggcgcggtgctgaagcccttgaggctgtcaccgaccgctctgtcccgtcaccaaccactgtgtcccgtcaccgactgctctgtcctgtcaccgactgctctgtcccgtgacggcaccagaaatgggagtggccgtgatagggcacagaactacaactctcagcagacattgcggccgcagacgcgctttcgtacaacacccagagcgccccagttaggtaagaaagcgcgcgaggaccggactacgagtcccagaaggcgtggcgtcagcagccatgttggtaaagggcgcccggaaaatgtgggaacggctagagagttgtagtcctcccgaatactctgattggtcaggatgcagtacgagggcggggtgtgagcgattcagcatattatcattgggtgaatcagggggcgtggtggggaatttcccgcagggcggaagctccagaactcccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacgtgagtgaaccttaggctgccaaacggagccctaggacccggcgtcacattcctcattaatctctgatccctgaggcttcctaacctcatactcctaaatctgacttccgatgctgaacttcctgacctctaacccccgagtcctaacttttaacaaaaccaatcttctatctagctatgatcctaacccaatcatttcttaccttcttttcttgaactatgattctcagctcctggaatccacattgtatccactgatacccaaacctgactccagtcctgagacttctgttagaactgtggcttctcctgacttctaacctccaaatatgatctttgattcttagttcccgatttgagccctagagtttgatttccgaaattaatacttggtccctgactctaagatcctgtcttctgagcagtgttcttcaaatcttaaattcaaagagagagaatgtaagctcttctatgttgaattcctaattaaagtaaaaaaataggaaaattaaaaaaaagaatgttagctccatgagaccaaggattcatctgttaaacaaatattctttacacattaccacgttccaggctccgtttaggtgctagtgataaaggcagtgaagaaaacaaacaaaaacttaagcccttgtggagcatacattttagtggagctaaataaacagattgataagaccgcaaggaaggaaagaaatggaaagacaggaagaaacaaagaaagacacgcagaaagaaagaaacatagaaagtaagaaaaggaaataaagtcagaggtagttaagtactttggagaaaaataaagcaggaaaatgaggcaatagataaacaagataagagcatttcaaggagaaggaactgcagttgcaaaggcccagatgagggattgtactgggttttttgtctgttgtgtttactgctgtatgcccagtgatgcaagcagggcctgatccaggaggcactgaatattgatctcaaccagctttatagtctcgttaattttcattaaatttcattaattaattttggtttcattaatttttttttactttctattcaattggtctctgttctgacttttttttttgaaacgaagtctcactctgtcgcccaggctggagtgcagtggcatgatcatggcttactatagccacaacctcctggctcaagtgatccttgcacctcagcctcctgagtagctgggaccacaggcacatgccaccatgcctggcaaatttttaaatttttttgtccccctatgttctcaaactctttttttttttttgagacagagtcttgttctgtcacccaggctggagtatagtggcactatctctgctcgctgaaacctctgactcctgggtttaagcagttctactgcctcagcctcccaaatttgggattacaggcacgtgcccccacacctggctaatttttgtatttttagtagcaacagcagtttcaccatgttggccaggctggtctcaaactcctgacctcaggtgatccacccgctgtggcctctcagagtgctgggattacaggtgtgagccactgtgtgcagctgtggtctcaaactcttgagctcaagcattcttcccaccttggcctcccaaagtgctgggttacagggatgaaccactgtgcccagacagtctctgccttttaattagtgtttagaccatttacatttaatttgatattgatatgattgtgtaaatttatcccatgtctattatatatattctacttacctatgttttctttttcctccctcctttttgccttttattgggtatagtttttgttacttttttttcaatcctgctccttctgtatagtgtttttcattttatttcttttttttttttttttttttttgagatggagtctcgctctgtcacccaggctggagtgcagtggtgcaatctcggctcactgcaagctccgcctcccaggttcatgccattctcctgcctcagcctcccgagtagctgggactacaggcacctgccacttcgcctggctaattttttttgtatttttagtagagacggggtttcaccgtggtcttgatctcctgaccttgtgatccgcccgcctcggcttcccaaagtgctgggattacaggcgtgagccaccgcgcctggcctcattttatttcttttgtttgcttattagatattcctctttttgttatgttagtggttgctttaaggtgggggttggcaaactatggcctccaggcaaaatctagccagccatctgcttttgtatggttgtgagctaagaatggtctttacatttttaaacagtttctaaaaatcaaaagaataataatattatatggcaagtgaaagtgttgtgagctaagaatggtctttacatttttaaacagtttctaaaaatcaaaagaataataatattatatggcaagtgaaagtgtatgaaattcatatttcaagctccataaataaagttcttttggaacgcaagcaagctcactcatttacatattgtcagtggctgcttttgcactgacacagcagagtcgagtagtcaaaagaaactgtatggctgctgggctcagtggctcatgcctgtaatcccagcactttgggagccaaggcggacagatcacgaggtcaggagatcgagaccatcctggctaacatggtgaaaccttgtctctactaaaaatacaaaaagttagctggcagtggtggcgagcgcctgtaatcccagctacttgagaggcaggagaatcgcttgaacccgggaggcggaggttgcagtgagctgagatcacgccactgcactccagcctgggcagcagaacgagactccatctcaaaaaaacaaaacaaacaaacaaaaaaagaaaaagaaaaacaaaaccaaaaagagaaaccatatgacctacaaagactaaaatagttatctggctccttacagaaaaagtttgctgactcctgctgtagggttgatagtttacaactttaggttatcatgggctaccttaaagtgatattatgccatttcacatagagtaaaagaaatttattttattttattattattatttgagacggagtctcactctgttgcccaggctggagtgcagtggcacgatctcagctcactgcaacctccatttctcaggttcaaatgattgtcctgcctcagcctcctgtgtaggtgggattacaggcgcatgccaccatgcctggctaaattttttttgtattttttgtagagacagggtctcatcgtgttggccaggttggtctcaaactcctgacctcaagtgatctgcccgccttggcctcccaaagtgccaggattacaggtgtgggccaccgtgcccagcataatgaactgttttaatattcttgtttgcaaattctaacatctgtgtcatttctgggtcagtttcaattcactgatggttcctattatggatcatgttttcctgcttctttacatgcctgataatctttggttaggtgccagacattgtgaattttgccttgttagtctggagaattctgtattcctataaatattcttgaggccgggcgccgtggctcacacctgtaatcccagcactttgggaggccaaggcgggtggatcacgaggtcaggagttcaagatcagcctggccaacatggtgaaaccctgtctgtactaaaaactgcaaaaattagccaggtgtggtggcacgcacctgtggttccggctactcgggaggctgaggcagaagaatcgcttgaacccaggaggtggaggttgcagtgagccacgatcgtgtcactgcgctccagcctgggcgacagggcaagactctctctcaaaaaataaaaattaaaataaataaataaataaatattcttgaatattattctgggatggagttaaattactcggaagtagtttgagtctttccagttttgcttttatgatttgttaggtgggtgttgagcagtgccccatctacagttaattattccccactattgaggcaagaccttcctgagtatcccacccgatagcctgtgatgatgtttttccagcctggctggtgggaacactcactattcctggccctgtgtgagtaacgagcacttttctgaaatccttttggatggttttcccatccccacagactcacaggcatggctgatccgtattctccggaatacacaagagaacctcctgcagttccccagcaatctctcctttggcaactctctttgttttgtactctgtcctgtgactctagccacgctggcctccacagactcttcctccatatccatctcctgacctcagacaacctgatgcgctctgcttggattcccctctctgcaccgtggctttgaaactctctcaagacaataagctgtggcagtcaagtgtggggcccacctcgtgtttcctgtctttcaggggtcactgtgattcactgcacgatgtccagtgtcttcaacactgttgcttcatataccgtatttcgtctgactcttgtttgtttgtttgtttcacgtgggagtgaattctggtccatgttacttcattttgggcagaagtggaaatcccactgaataaacattgattccacgaatttgctgatgaaactctgacctctgacctcccagatagctgacagggggttccagaactgtggtcacaaggcctagcatacagtaggcgccccatgtttgttcaatgaaggaatgcaagaggacttgaactttgccctctcaccccggtctttgtccccagggcactgcacttggctgtgattcatcagcatgaacccttcctggattttcttctaggcttctcggccggcactgagtacatggacctgcagaatgacctaggccaggtgagccacgagggatggtgtagggcttggggtccagggttcccagtgtgactccctaccgcctgtcctctgcttctgcagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggtgagggtcgtcaccagggaaggactcagctcctgggctaggcgagagcacctggccctgggctcagcttccctgatttgagactgagctccttgggaaatcatgcctaggcttcaggagcccagacatcgggaccagggacctccactcagggcccagatgattgagaattggatatgtaggacccaggacccccacctggaggccccaggtcacttgggatgcagacctgtcacccacagacccagagctgccaggatccagttgtcgggcccccgggctccccacctgcagagtgtattgcagacccctaccctacccaggaccggggaatgcagagctcaggccctctgtgaaactctggcaccccaggctcccagcaatgggcagcagggttcagagacagccctcctcagcctcatgggaagaagggctcatctgcccacagccctgacatccaagtttctgctcccctgcctataagcccagccacctgagaccagacccctcctcagatggactgacgtcattcaggacccagtgttcagggcctgcctctcgcccccaggtcacaggcttttcagctacttggtaccttttttttttttttttttttttttgagacagtctcactctgttgccaggttggagttcagtggcgtgatcttggctcactgcaacctccacctcccaggttcaggtgattctcctgcctcagcctcccgagtagctgggattacagggattacaggcacatgctaccatgcccagcttatttttgtatttttagtagagacggggttttaccatgttgaccaggctggtcttgaactcctggcctggccttaggtgatctgcccgccatggcctcccaaagtgctgggattacaggtgtgagccaccgtgcctgggcaggaaccttaatttaaggttttttttttttttttttttgacatggagtctcactctgttgcccaggctggagtgcagtggcgccatctcagctcactgcaagctccgcctcctgggttcacaccattctcctgcctcagcctcccgagtagctgggactacaggcgcccgccaccatgcccagctaattttttgtatttttagtagagatggggtttcaccatgttagccaggatggtctcgatctcctgacctcgtgatccacccgcctcagcctcccaaagtgctgggattacaggcgtgagccactgtgcctggcctttattttttatttttagtagagacgtcttgccatgttgcccaggcagcttcttgaactcctgagctcaagtgatcctcttgctttggcctcccaaagtgctgggattacaggtgtgaaatagcgtgccagctcaggtcctttgagtgataagagcagagacttgggtctcctcctggccccaaaatccaggctccctgtccacagaccccaggctgtttacccacgggccccaggcttcaaacaactcaggcactagcacttgccagcaagctcaggccatctgagataggcatttggtacccaggtacctctttgccatacccaagaattcaggaaccagcccccaaacctaatcaccctcacgccacatgaccctcccccaggatcaaagcacggtggggtggggggggccctcacctcatcatctgacgccaatcactctgtccccaggccacaccccactccacgtggccgttatccacaaagatgtggagatggtccggctgctccgagatgctggagctgaccttgacaaaccggtgagccccaacctcggggaagatgccgtcggcgggagggggcttgtcccctcttcgggccctctgacctttctgttgcacccccacaggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcggcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccaggatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccagagaccagactgatcttgtcttcccagtcctccgggtccttctggggcccatccctgtcacatcaagtgctgctcacggaggcagggtgcgtttctttgtgctttattcactcagaagggttggagtgggagtgcataggtgtgggggtgcttcctgtgtcagggctgagcccagcccccggcccagctcagactcacctccttgggtgtggttccaaggcacgtccgcctcctcccctgtttgggtaggggtggcgtggggtgctaggtgaggtggaggcttcggggtcaacagtcctaagccacagggtgtgtcaggaggaaggagggactgaggtaggggtcagccctccctcctgagctgctcccccagcgtctctgtcaccttcttcagttcgtctctcaagtgctccagctgctccacctccttttcctggtggggtcagaaacggggtagtcagcacccaccttcaaaggcaggccacctcggtcactgtgattgtgggccatgtcggttctcatagtggcatccagcagcggtcgttctgatcgtcgtggaccgcgatggtgaccatgctgattgccataaccccggaagagtggtgctggctaacgcgaccacagccaacagcagtagcttgggactggcaaaggtgcctgggatgagcacctcgtgatggcgctttatttttatttttaagatggagtctcgctctgtcacccaggctggggtacagtggcacgatctcggctcactgtaacctccacctcccgagttcaagtgattctcctgcttcagcctcccgagtagctgggattacaggcatgcaacaccatgcctggctgattttttgtatttttagtagagacagggtttcaccatgttggccaggctggtctcgaactcctgacctcaggtaatcctcccgcctcagcctcccaaagtgctgggattacaggcatgaaccaccgtgcccagccatttttttttttttttttaagatggttttgctctgtggcccaggcgggactgctgtggcacaatcatgactcaatgcagcctcaaactcccgggttcaagcaatcccaccacctcagcctcctgagagctgggaccacaggcgtgcgccaccattgctggctaattttttaaattatttgtagagtcacggtttcactatgttgcccacgctggtctcaaactcctggcctcaagggattctcccaccttggcctctgaaaggattaaccctccctaggattacaggtgtgagccaccatgcccaccctgttacggcacttttggtgccaccaatcatggtgacatcttgttttccatgacccagcaatggtgtctgtctgtcacctagtgaagtaggcacagcagccacttttcacagtggccaacttgctagtgatggtggcttgcttctgtgcaatggtgccatcttggttgctgtagtccatacagtagtgtggaagtataaggtaaaggccttgcacggaagttgttagccagtcgtggtgtcagtcttggccactgtgatccactagtgatggatctggtggtgcagggccaacaccggtggctgtgagttgtgactccactgaccatcatcaaccctgcctccaaactgtgttggtgttcctccttcatccccctactcacctccctctccgaagcctcctccttctcctgcctgggctcagcctctggctggtggtggtggtggtggtggtggggcaagtcctcgcgcctctctcctccgcctctctcggccccctgccacaggctgcggtccccgcccagcacccgcacccccttctcctctgcctggaactgggccgtctctttgtcactggccttctctgccacccgcttctggaggtcccctccattctctagatgccgctgccacaggtcctcaaaggtctccatg

SEQ ID NO: 13124 - DNA, 23445 bp, Human
gcggcctcaggttcttctaagaggcaggatcccaagggcaacacgtggcagggaaggtggaggtgcaggtgcaggagggccactctgctcagggactcaataccttgatgcaaaggctaccgacacgcagaacgctcactgtgagcccaccgggaccaggcaggcagagcagcggaggcccccggagacgtggctctcaccaggctgcactttagaatcacctgggtgctctgaaccacccaacacccaacccgcacccctgactgactgcaccggaacctcttttaaaaaattctttaaaacaattgtggtaaaatatatagaacataaaacttaacctgctttaaatgcgcagttcagtactgttaatgcacaattcacattgctgtgtgacccgtctccaaaactttttcatcttcctcaactgaagctctgtccccatgaaaaactaactcctcattccccactcccccagcccttggcaacccccattccgctccaccatttcactgctccagggacctcaaataattggaatcacacagtactgtatttgtctttttgtggctggcttatctcactcagcataacgtcttcaaggtcatccgtgttgtgacgtgtgtcaggattcccttcctttctaaggctgagtacgaatccattgtatggacggacagcatttcctttctaaggctgagtacgattccattgtatggatggacggcatttcgtttatccattcatccatccaacaacacgtgaggcggcttcaggcttcggagttgctgaagctccgagttcgggatgtgcagctgtggtggagccaggggctgggcacacccctggctcctggcctggcagcgtcatcatcggagtcacctgtccctcatgccagtggtgctctctgctgtcatcaagaccaaacaccactgtaggaagtacccccactcccgcctccaacccccacagggcctgccaggtctgcccccagtgggccccctggtgcatctgggccacccagggccagcctcagcaggggcactcgcggggctgcgcctgcggcttcccttactccagtctggaatgttgtacacacggatgagccagcagctcacgcccacgactgctggggtctccggactccctcatcagcctcctgctgtgctgtgtacaaatcctcctcctgcatgaggccccgctgtctaactcagcaggggagaatgggaggagccaagggaatccgtgctttaggaccaacaccaatactcatggtgggacgacgctgcgatatttgaagttgggagtgtgcaagaaatgttactcggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccgcatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagccgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtaacgtgcgcgcggccactgggccgcggggcgtgtggggatggcgaagggctggctccggcgtccctgccgaggtcctgcgtcctcgtcccgggctggccgggtccacggggcagccagggagccgcaccctgcaggccgggggtggggttcagcgcggctcgcagtgctgggcgaccccaccacggacgcgctgccctctcctcggcctcgagtgcagtccccgcgctagattttctttccggtggaacttgctcgtaacttccttcccgttagccgatacagatttgatatgacccaaccgcaaaagtaggacgtgggccaccttccagctctgagcgcacggatcaggaaagccagccagagggtagccctagggagggcaggcactttttcaccattctgccgcccacggcgtgtccggtggtacagcggggggcagccttcccacccaccacaggcacagaccagggacaacggggacgccgtctccagcgagctcgtcagtgacacaacatgtccaggggcctttggcccaccagcaagggaggcagatagaaaggctcacacccaccttccaaaataactgtcctacttagggtctccaccttgcagtgtccctaccatgcagatgtgaaggaagcggtcaggacaggttcccgtttcccggtggtgtggtgggagttccttcttgctggatttctgagcttgccattcgcgccaatagtttcgtgtgttctgggctttctttacatgcctatatttgtctttggaggggttcctctcctacttagtaataaaccaatacatttcttaaacatcttaaaagattgacttggagactggtgcagataggcttttccatccatccctccctctgcacctccttccaatcatttaacagacttgtattgaagacctgctgttggctagacccagcagaggatactgcagtgaccagaaaaagccagacaaagcatctaccatcctgggctttggttggcgttgactttgacttcagagacagccaggaccttagggtctaggatgtcatctcatgtgagagtgagagacggaatgatgcgtgttccgtgggaaaaagaggaccaacagctacttcccagtataaagagagttcctggggaataaacactggctttgtcggctgcacaggtctcctttttttttgagacggagtttcgctcttgttgcccagggtggagtgcagtggcgtgatctcggcccactgcagcctccgcctcgggggttcaagcgatgctctggcctcagcctccctagtagctgggattacaggtgctggcatcatgcccggctaatttttgtattttagtagagacggggcttcaccatattggcatattggccaggctgatagcgaactctagacctcaggtgatctgcccgcctctgcctcccaaagtgctgggattacaggcggcagccaccacactcagctgagggctcctttttatatcctcatgcactgctgttttgttattcagtgtgtttcggcctcgggtagaggggcaacagattttcagttgaagcttaagtgctatcctggggcagttgtgttgtcattggagtagttgatcagcgaaacacaaacttgaagttgcttttgaatctggagctggggaaagattctgagtctactttgagcagggccaggaatggatagcacagaggccagcagagggggcccagaagagggctcagcaaaagtcctgtggccgccatttacctgttggttattgccctacacctgaatctttcccactccgactttgaactttttcactctgtagtaaccgcaactgtggagtaattacaggggaggatagttactgaaggaagactggggtggtggcttaaagagctgttcatgccggcttgttgatctgcggcgagtctggttgtgggatcagcatgagcaactcagtggactgtcaaaccctgcagagccgggacacttactcatcacccccgtttcacctgtggttgagtctcatgtacagtagtactgaaaagagattaattttaatataaaaaacaatgtcagcatctggaaagagcccccttatggagggggtgctttatacctgcctgtctggtctcacactaggacagcatggcagagcagggacttgaatccaagtggtctgagtttttgctctttacttacacacgaatctgtgtaactatttttacaaaactcttaaatcttcaggagtttattttgggttatgatgtgaggtgaataactcaattatttcctaataagtatctgattgtacaaatgctgtttgttgaatactcttttccattctcgctgattgtgatgccggtttatcacattcaggcataccttggggatagtgtgtgttcagttccagaacactgtaataaagtgaatactgcagtaaaccaagtcacatgaaatttttggtttcccagtgcatatataagttatgtttacatgatactatgatctattaagagtgtaataggccaggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttctttaaaaattggaatcagtcctctctaaccctgctgctgcttaatcaactaagtgtatgtggccttctaaatcctttgttgtcattatgacagtgtccacagcatcttcaccaggagtggatttcatctcaagaaactgctttctttgctcatccattcaagtttgatcatgcgattgcagcagttcagtcacatcttcaggctgtaattctagttctcttgtgatttccactgcatctgcagttacttcctccatttaagtcttgagcccctcaaagtcatccatgtgggttggaattaacttctttcaaactccttttgatattttgacctcccatgaatcacaaatgttctaaatgacatctagattggtgaatcctttccagaaggctttcagttcatttttgcccagatccatcagaggaaccactacctatggcagcgatagcctgacaaaatgtattaaatgatgataacacgtgaaagtcagaatgactccttgatccattggctgcggaatggctgtgttcgcaggcatgaaaacagcatgaatcttgtacatctccatgagagctcttcggtgactaggcatattgtcagcgagcagtagtattttgaaaggaatcttctgagcagtaggtctcaacattgggctgaaaatattcactaaccatgctgtgaacagatgtgctgccacctgggctttgttgatccatttatagtgcgcaggcaggagttttggaatggtgaatgaacactgacttccacttaaagtcaccagctgcgttagcccctaacgagagtcagcttgtcctttaaagctttgacgctaggcattgccttctcctctctagctatgaaagtcctagatggcatctttttttccaatagaaggctgtttcttctacattgaaaatctgttgtttagtatagccaccttcatcaattatcttagccgtgtcttctggataacttgctgcagcatccacagcagcacttgctgcttcactttgtacttttgtgtgatggagatggcttctttaaacctcgtgaaccaacctctgctaccttcactctttgcttctgcaccttcctcagctctctcaggcttcatagaattggagagagttagggccttgctctggattaggctttggcctaagggaatgttgtggctggtttgatcgtatctccagactactcagatttcctctatatcagcaataaggctgttttgctttcttatcaattgtgtgtttacaggggtagcacttttaatttccctcaagctctttttcctttgcattcacaacttggctgtttggcacaagaggcctatctttgaaccttcccagctttccacatgcctttctcattaaaattaatcatttccagcttttaatttaaagtgagagatgtgtgactgtttctttaacttgaacactcagaagctgttgtagggttattaattagcctaatttcaatattgtgtctggggaacagggaggcctgaggagagagtgggagcagctggttggtggagcagtcagaacacagaccacgttgatggattaagttcattgtctcatatggcacagtttgtggcaccccaaaacaattacaatagtaacatcacaaatcattcatcaccataacagataaaataataatgaaaaagtttgaaatattgcaagaattaccagattgtgacccagaagacacaaaatggacacatcctgttggacaaatagctccaaaagacttgctcagcacagggttgccacaaaccttcagtttgtaaaaaaacacaattacgtgtgaagcttgataaagtgaaatgcagtgaaatgaaggctgccggtattaggttgtttatactgagatctttctgggcagctgatggtttgattttcttttttattctgatgagtgttctgttacctagtagggtaggtcttttctctgtacacttactaaaaaccaaaaaagttcttctcccttatattttaaaataaactttagaatattttttgtgacatctgataacaaaatcccaaagaaatgggtcacgctttatttaaaattccttgattattgaatcttttaatccaagtacttggtgttttttctgcttattctgttcttttgtgttgtttttgagttttatagtcttcattaaatgggctggatttatatttatgtacatgtgtttttaaccttcgtttttattgaggtgggacttctctatggtcaagtgcacctgtctgaggagtttcttaggcaggcctccctgtggccgttgcccagggcagcgtggtagggagtcacccgtgtagcagatagcagcatttgctcagccgttggattttgccgtatgtcttttttgtagtgaaggagatgactatgttctccttcatagttgcccagtattaagatattcccaaataccagtactaagatatttgctagattctttgatacaatattgattcaatctgctgatattttcttttttctttttctttttttttttgagaccgagtctcactcagtcgccaggctctggagtgcagtggcgcgatcttggcttactgcaacatctgcctctgggtccaagcaattctcctgcctcagcctcctgagtagctgggactacaggtgcgcggcaccacgcccagctaattttttgtattttcagtagagatggggtttcaccatgttggccaggatggttttgatctcttgacctcgtgatctgcccgcctcggcctctcaaagttctgggattacaggcgtgagccacctcacctggctcaatctgctaattttttctttaggatcttgcatccgtattcttcaggtttgccttatcagtggattctttgacacaatattgattcaatctgctgatattttctttaggatcttgtttctttattcttcagtaggtttggcttatagttcctgggccccatcaacttttaaaaaattattcttgtcagcgttggtgtcaggagtgtgctaatttaataagggaaggtttctactattttctgtgatttatttcttttgtttttacagacagggtattgctgtgttgcccaggctgatcttgaactcctggcctcaagtgatcctgcctcagcctcctgagtagctgggattacaggcgtgccaccatgcccagcttgtgatttatttcttgagcatttgaaggtgccccgtagctgggagagggaaggctcgctgcagatggcacccccttttggttagtcttggcagggcctccatgagctaacaggagcccctctcttcagtgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggaggtgagcggcgctgcccagggctggtccgggtactagggccctgaaggtctgtgtgaagctgagccccacagtcgctgtgcagatgaagaccttgatgttgggaggaatgtgttccagttttagaggacggggataaaggagactgaggcagcatggtcagagttgtaggagacagccagacagtgtgggcagggagacctgagttcaggtcctgctctgccattaaccttagtgttttctggcaacttctggccttctgtgggcctcagcctcctgatgtcactcctgaaggtaccactgtttccctcttcagtggcggccctgccccatcttgggtttctcgtggctcttaattgcaggcgcttctgtacattcaccctgcttcaccaccttccctagtgccctttcctctagcttctcaggccctcagtcatctgcccccgggacctgggcctcagccttaggcccttttacctcatcagccttctcctttctgttcccctcatcagtggtcccctgtcctggccttgccaaactctgcctgtccccacaaaatggctccagcccttccttcgcagcaagtgatgcttgcccttccctctccctgctcaggacacctgggggagcagagtctgcttgctctctggactgttctctgattgttctgcgggtctaaggttgcagtcccagctagagcttaaactcagcagcagccaggaactatccatgctgctgttgtgtttccgcgttcccttcaggacccaaatgccagtgcggtggtagaagcaatgcctacatgttggcgccgaaactaatgccacaacttttctttgcatagttcccaagaaaaggatttctaacagtacaggaatgtatttcttcatttccttctagtgtcttagcagtatttcatcaaaacagatatcagtatttaaaagaaaaataccagaaaggactgtcataggaagacagatggattacgcacagatatttaaagtgggtgactcaagcccaaagaaaaccttaattcaacttgcagatgtaacagaatgaaatagagttcggtgaggtctcagcccaagtctttctatattgcatttcccagcactgtttctcctccttcttttactcaggctcagggcatctctggttctttacattttcccattgctatttgcttctttggtgatgagttcctggagtgttcctcgactttcctgggcagtcagagcctaggcgcagctggcggaggagccccgagggctggcttgggagctgcttcccctgcatgttcctgggccctggtttggtgctctgggcctctgagctttgttctcagtgacactgggagctcgctgtgaacccgttgcggtcgctgccttgctgggtcggtgggtggggcaggcagttgcagtctgattgtgacatctgccgagagctgagtctggacaggttcctctgccgctcttggccaggggtgtagcccccgtgccaccttagtgattccttcaggccatcatttgtgcagtgttagaggttgggggcctacatagtcacctagtcctggtgaggatgctgaggcctagagaggcccagcctcaagccttcacagatggtaactggggaagagcagcctaggggctcttacccagactcccgggcgagtgcgctgttcatttggcactgcctcccaggcagacccttcccacctttgtagaggaaggcacttcagatggcagtcaggaaatctaagaactagagatcttagttttggtgctgatcattctgcaggtgccttgagtttcctgtctctggaatggggctcgtaatgcctgccctgccatgccccggtcccgcaggggaaaggtgtgagagcatttcagaaggcagagcccaggtggaggcgttattaaccagagggggaccgtgtccatgctgccagggtgaggggggcagtgcagcccgtccctgtcctgcggctgcctctcatgagcccccttgtgttcctcctgcagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggccagtactgtggagctcgcctggctcctgcagccactttatttttcttctctgtattttgcagtttttctgtctttagaattcggctctttagatgactcgcctgttttgctggcctttgtaaagagctgcctcttggctttatcaggtctctttgttttttggcttacctgttcctttatatttacttttatctttttctaatttttagttttttttcccttttgagttgactgcttattcattttttcttaagaatgcaaacttgcaacgttaatttaccttttactatagttttgaccatcctctctaggctttttccttattatttaaatagctctaattgaagttgatttcctctttgttcttagagttatggaagataaggttttaataatgctttttgttgtattatgctcagataatatggaccagatagttttcattttggggattctttgacgtaaaaaaattattattattattatttttgtttagtttttgaggtggggtcttactttgttgcccaggcttgagtgctgtggcgtgatcatagctcactgcagcctcaaactcctgggctcaagtgaccctcctgccttagcctccttagtagctgacactacaggtgtgcaccacaatgctggcttcttcttattttttaatgtcagactacattgttgtgaatgcttgaaacaagtacatgaccatgggtgttttgtttacatattatactttgttaggttagcactctctctctctcttttttttttttacatttttgtcattggatctgccagaaatttaaagaattctgttagtctctgatcacatttttgattttgccattttttccccttgtactttgaataggttttgctttgaaaattttgatgctaattgagctcataaaagttcctgcttacatattatgctctatcaaaacaagagtactattagttttatttaaggcccatttacatggcattatgtaatatttagttttaaccctagggagtttcagtagttctgtttgtgcttgtgtagaaccatttgtctaggagtttttgctttttaatacagtgaacattattgctatagctgatgttggggtctgtttctgttatctttctgttttgtaactgtttccatttgatatcttttcttcttatatgttgtttttttctttcctcttccattatactaggtttacagtcttattttattttattttttttgagacagagtcttgcagtgttgcccaggctggagtgcagtggcgcgatcttggctcactgcaacctccgcctcctgggttcaagcagttctccttccttagcctcctgagtagctgggactacaggtgcccaccaccatggccagctaatttttgtatttttggtagagatggggtttcaccatgtcagccaggatggtctcgatcttctgacctcgtgatccgcccgcctcggcctcccaaagtgctggtattacaggcgtgagccacagtgcctggcctacagtcttattttaatcatactaacggttgcctttttttttttctttttcaaccagattgtttttatttttcatgtttctagtgacttctttccagcaaagatgcttttttccctcttttactctggagaccaaattgctctgcatttggacagggtgcagtttaggtagctggttctcagggaaatttttctgtattgaaaaggattaggtaagggttctgttgttataggctgcagccagggtggctctgatgagcagggacctgggattccctttacccagcacagaatatggtctttaaattaggtactgagaatatgtttttcctgttgaagggttttataaattaaatagctacacaattggcttttgggaggctaaagaaatgagagtggtaaggttgttatgttagagggtgataaagctgcaaggctttttccctctttttaaggatttctaacctgattatctaagctacttcagtcccttgtctttgcaccttggagaatgtaagctattaatttggaaatgcttttgagtaggatcaatcagtgaaattccatgttggttccagaaagccctttgggtatttcagtcaattcatgatgcacaactgctttgagttacctgcaggctgcccgagaagtacatatacagatgcccttcattttttttttttttttttgagacggagtctcaccctgtcgtccaggctggagtgcagtggcgctatctcggttcactgcaatctccgcctccagggttcacaccattctcctgcctcagcctcccaagtagctgggactacaggcacccaccaccatgcccggctattttttttgtatttttagttgagacagggtttcaccatgttagccaggatggtcttgatctcctgaccttgtgatccgcccgcctcggcctcccaaagtgctgggattacgggcgtgagccaccgcgcccggccacagatgcccttcttgcgaaaacgttactaagacatcttactccctcactggagcacgggacattactttcacaaggtggtaccaagaacatatattattctattaaaaagttttctatattctaaattctaagataattgacacttggatagtagagtgatacggttaagttactgaacagtgatgttttctggaaataacttagcttctgccttccctgtgccagttcccccttagggctctcatctttcactgttgcaattttctgtccctctgtaagtcacctccattttgttatttgtaaattcacttgatatgtattgcccatattttagaaaaaaggtacagagtggtatttctgtatgtgcaaaagttatattgatttattgagttctcccagtggttccttgccagtgatattaaaagcaatagaggaatttggaaaatattcaggattaaaattaactggatctcatccagtatatttttatgagtggatgaagggctatctttcccacagctcagctaataccagattgtcatattgcccaaaattacaaacgttttggaagattttccctaagaataagcagaaaaaaaccatcactgcttgagatctagttttcctttgcttaattggttgggtgtatgaaatgaaatatcaatttcttgttggctctgtgtgttttagaatacttcccctgtcactcctagaatgtctttgagagtgggtggtgtttgtgtttgtagtggaagcttcattgtcatgtgagtgtgttggttggagagtgggtggtgtttgtgtttgtagtggaagcctcgttgtcatgtgagcgtgttggtccgtgtgctggtcctcaggcctgtgcttcctgaaagcagcagttttggttccaggggagcgtttctctggacactcaggatggtgctgaggagacggttagaaagcgtggctgctggccttacctgttggcgagcgctgtgattgcggcatggaaggtgacgcagttctgtcctccctgcaccctgcgtgttctggtcccgtcatcgctgctccccacatattgtcctttcctattacaaatgaaatactttggtggtgacgaatcttgtgagacattgtgggactgtgtgggctgatgaaagctcaagaaaacaggtgccaactctaatgttgactcagattagagtcatgtcatgcgttttgggcaggaatcgcaaagggaggttgtgttcgcattcccctcttatcaggctgcgtgtgatcgcagtgtgtccattactgccgatactcacttccgttatttgattaaggtggtgcctgccatgtttcgctcccgtaaagctattccttttctctctgtaagtagtattttgaggagaggtgctttacaaccatgtatatgtcctgttcatctcagatttttaatttgttcatttattaatttgttagtatagactcatggtttctgatattatccaatgagttataattcattattattgttacttattttgatattcgtattgtctcagtttgtctactgagagctgcttcaagccatctctgtccttttaacatgaccttagtcattctgtgagcagctcctcactttctcctgtaacaagatattctcggctcatcttgcactttgactgcctcagtcctggaataagtcatttctcctaggagtcctggtttcttttagtgaagaatggtgtgcagaaccctatatttggacactaggagtgcctattgcttttggggtatcactgttttcatgccctcctattggaccaagctaaggttgtatgtacattccacatttctgtttatatttctttatatacattgacaggagttcacctggctacctttaatccaggctcatgccacaaggttcatcctagttttctgcctttcgcgtttactattctcctttcaccagtgagaaacccagttcccctgccctccacatactgcctgtgttgtcctgttgtcccctgtgtggcaccagccagccccccttttgctgcctcttcccatacatggctcctgacctgtttgggctctcacctctcatgccaggtggccttctcaccttgtcaggactctgactctgagccagggccccctcattgactgatccctgttcagagtgaaaatgattggtagtttgcacttgccctggaagaaccctaaacgtctgatagagagccgtatatttggtcatctctgagtacagtgacaaggacaagtaaagtaaatggagtcatttagagattggctttggtggagaatgaggcttctaagtcaggtggctcctacacctgccctatgtgagatttgtttcctcccatcgggctgtcactggggattaggaggggcggcctaggggttacctcactcatggctgtgtacatgcccacgtggagagctgtgtgacgctgccctgccgacaagctgtgcgtcctggcctggggccttccaggtgaacgtgacgctgggagtggtctgtgctaatcatgggagtctggatgtttagtgtgcctgaaaagaaagatgtcctagtgggcagcgcatcatggcgccagctggatacctgattgagttcatgcgtttctttttgctttcaatttttttttttttttttgagatggagtctcgctctgttgcccaggctagagaagtggcatgatctcagcttactgcaacctctgccccctgggttcaagcaattctcctgcttcagtctcctgagtagctgagattacaggtgcccgccaccacacttagttaatttttgtatttttagtagagacggggttttgccacgttggtcaggctggtctcgaactcctggcctcaagtgatctgcctgccttggcctcctgaagcgctgggattacaggcatgagccaccgcgcttggccaaggtataaatttttggaaatctagcttgtatccttgtctccttgatcctgttctctccctccccagtagataaccatttaaaaagttccatggtttaccataagcacactgcaacctcctcccccacagaaacagtagtggactgtacactttcactgtgctgctttccctccctcttcctgtgctcggaggctgctccggagcagtgtacagcgaccccctcactccttttcagagctgcacagcgtggcgttgtgcagatgagctgcagttcattcagccagtcccgttagtggacacgtgggtggtttactgtctccagctgttagggatggtgctttaatgaattgccttgtgcatacatctttccatagttttgcagatgtattttggaaatagatcccgagcagtgtgattgatgggtcaaagggtaaatgcatatgtaattttgctagcgattgacagattgcccactccacagggggaaagttcacttttcattgctcaaacaatgaatgagatttcctgtttcctaaaagcctggtcaataaatttttggatttttcccaatctgataggtgagaagtgatatctcagaatagttttaatttgcatttctgttccgagtgaggctgagtgtgttttcatgtggctaagagccatttgtagctgtccatctctctaaattttttttttttttttttgagatgaagtctcgctctgttgcccaggctggagtgcagtaccatctcagctcactgcaacctccgcctcccgggttgaagcaattctgcctcagcctcccgagtagctgggatgacaggcacacccacacccggctaatttttgtgtttttagtagagatggggtttcgtcatgttggccaggctggtcttgaactcctgacctcagatgatccacctgccttggcctcctaaagtgctgggattacaggcatgagccaccacgccccgccccatctctctaatttttctgtagggctattgatctttttcttctagaagctctttatacgttaagggtattaaccctttgtaaccttttcccccaatttttcattgcttgttttacttttacttacgttgttttgtcatgcttatgctatgcaagagtttttcttttaaaaattttcatgttaaaaacattttatttgtggattttgtgtcagaattaggcaaattttacttagaggtttttttctagtttttgcatggtttcatattttacgttttaagttatggtcagtttggaatttattccagtatatgctatggtgaatggatatacttttacctttttccatatggatgtccagttaccccaaaaaacacttagtaaaacatctacaccctcccttgtttgagatactgcctttatcatatatgaaatttctatgtgcaatttggcccatttcaagattttctgtaaagttccatcattctgtcaattttgttcacataccagtgccacagttttatttttagcctttataataaacttcacttatggtgtggctacctcccaccacccccttcttgcttgtctttttcatattctttcatcttacagatgaactttatatatcaactaatgtagctccggggatgctatttttatttatttatgtttgtaatcaacttatttagttctagtaatgacattttcatttataaaataaatttagggagaattatcttcttgatgttgagtcttaatcagtactgtgctatgtctttccattctcttaggtctacttttgttgactttaagtagtagtttatcatttttgttatgcaaattttggacatttattattaagtttatgcttagatatgtcatagtaaaatttattttgctatcataaatggaattttcccttctactttttatatgaagcctattggtttgacaacctgctacttcaataagttctctcattgcttgttagttgttttcccatattatttagggcttttcagacacattgtatcctctgaaaataggaaatttttacctcttattttccaactttatgcatttaatttcttcctcttgcctgattgcacagggtacctttaacaccagtgttcaacaggaggctggaaagcaggagtctgtcttgctccagctttggccggagtgcttctagcctttccctgttaaatgagatgctgacttctggcctgagggagtatgttttatcatgttaaagaaaagccatcactttctgttttcttgagcatttttaaacatgcatagctcttgagttttgtcatatgcccacctttttttttttttctgcatctgcagagataatcagaggatttccccctcagcctcattttacaatggattatattaatagagtttctaatattggagttacctgtgcattcttgggataactcccatgaggtcatggtatattgctttcttaatatacttaaggattctctttggctaaaattttattgaagatttaaaagttggtattcctaaatgaaattagctggtagtttttcttatgctttggcccttgttgggctttggggttattgtgccagtttcatcagatgaatttgtaagtttctcttctttttctttgctctgaaatagtttaaatagccttgggattattggacctttaatggtttgaaggacttcccttaggaatttttctgtgtgcggggattccaagttctttcctgctaccttatcttgctgaacgtagtgaagctatctgatctgtggagtctcctacagcgcctggtgtcactgaatcaaggccttctgctcagggtggctgtgggatttgttggatctgtgggatctgtgggctgtggtcagtcccctgcacagtctgactttccctttcttccctgcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtaagtggcttgagttcagctctgacttgtgggctgggttgattgaatgaatcaagatgtagcaataaacaaaaaacaaaaacctccacctgagcacttggccaaaatcttcagttagaactcgcagttttccagatggttgttcagattgatcttctctttttaaattcctgaataccaagaactgatatcagggaatctctaaaagtacatgtgtgttgtcagaactcctagaattatgctcgcgctctctttttttttttttttttttttgaggcagggtctggttctgtcacccagactggagtacagtggtgcagtcatggctccctgtagccatgacctcctgggctcatgcaatcctcccacctcagcctcccaagtagctgggactgtaggtgcacaccatgcccagctaatttttgggttttttgtagagatgaggttttgctgtgttgcccaggcttgtgttgaactcctgggctcaagtgatctgcccgcctcagcctcccaaagtgctgggattacaggcacgagccactgctttggcctagagttatattctctttatccttttgctctgacctgtggccccagattcttatagacagtgacttcttttatgcctggtttttaaatgagcccttaaaacaaattgcaagcggggctttctagggttccttactctcctttcttcaattccactcaagtatcgctactttggattgtgtgataagcctaaattttgtaacaataaagttcctggtctgcttatttatgaagaaagattttgttaacgattaatgcatcaatagcaccagagattggaattgatccatagcttggtcttgttatccgaggctctctgggattcagacattgacctcatgtgttgtctttaacctcctgcccacatgtcaccccctcccaccgctcccagtctgggtcttgagacatccaagttgataacctcttccttctccctgcctctcaaaggactttaaattcattgtgtttttgttactggatttccctaaaccagttcattaaagcatgctcctgtgtagccttcccacaaatagttaatgaatggtcagctgggagctgtactgatagaagcagcagcttgcgttcaggactgttccactcctcagcttcctcgctaatcgagacagaacttggctgcgctcttttcattgggggcaaagtcgtcagcctgtgcccctcaagcagtgctcagcctgtgttccccaggcactggtggagcttcagggattgactaagggaaggggctgacagaggctgggcgtccgcggcccgcacctgctggggccttcagtggtccactctgatttctttctctagtgcattaaacatggtcgagttgtgatccagggagcagatgccctgggttaacgaggctggaaaggtttcgctctttcctgcgacagaaggagcagataagaagaccttcctccctggggcctgctctcctcatccatcaggaaaagccatcactttgtgtttcactgagcgttttgaagttggtagtgagcattggtgcacttctggctggcagtcccagctgccttttctctctataactggaatagaatgaaccttcctctatccctctctttcttcccacggccttcaggtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatacggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccac

SEQ ID NO: 13125 - DNA, 186959 bp, Human
tgtggcttctcattattagagaagattttggaaagttttctgtgtttactctgagaaatccatttgtttccattttctactgtcttatcaagagtctcacaaataatatctgtttcacttctgataatactaaaaacttgctttacataccaaggcaaatgacaaagtggtttactgaacagtacattatacttctcaggggaatctgttttacagaaaatactaatcaaagaccatatcttaagagagttgtgtaatacaactggatgatctataaaagaaagtaatgaaacatgtacaatgttgctaatgattatggtaaaatgcaagagaaatgcagtaaaaagcgtatcaaaatacattttaaagcattttcatgtaaatatttacaattaatggacactgaacatcttctaaatataagacacatgatagtggtgggcagatataaaggcaaagatggtaagcactatgaggacagggactcgtctcatccatctattaggggagtcaaaatcaagtttggtttagcaaacatttattaaattcctactatgcaccgggcttaggttaggtgcaggagtgaaaaagataaatgagacttggtgtctgtcatgctgtacaggggtttataattatggtattgcatgtctgggtgtgtatttttgtgtggatatatggggatatgtgtactctataggaatcgtcataaatgcagtatggcgggttaagacaaagtctagcaccatgtagggaaacagcccacacacggagacgaaaggaggaggaggtggaagcccagcgacatcctgggaataactgttagctagagaatgggaagatcattccatgctgaaagaacagcatgagcgtggtcagagactggaaagaaaacaatgtctggggaaccacaagcatcttagcggataggtggtgtcagggaaggcccactactgcacattatctttgatttattttgaaactcttgtaaaataactacacaagaaatttctgtcgtcaaaaaagtatcctccttcattcccagcatccttccccttttgctttggtgttgtcagacagcggagtattaaataatcgggggcagggtggggggcggttggagggaagcggtgggaggcgacagaccttgaagatacttatgagagctatgttagctgttagacatagacgacctaaagcccctcatcagatacaatcactttaatataaagaccattttaccttaattatttctacggtagcttatggaaactaatagattggaaactaaatgtaaactaaggagaatcttacatgaacttatctagttggtgcggaaaatcgaattcagactcaacagacgcttatccagcgcaaccatgctttcatatattttttccctcctgtaaagcaaggctaatttattgcccgagtggctgtctggactaactggaacaaatacggacgcggtgggagttccattctggcgaaactagggtgagaggttttttgtgggttttcatcgaggagacatggaaacgaaaaagatatggaatatattctgaaagtattggtgtgaaaaaccatgcctcgagggccaacacgaaagtacagaaacgatggcgggaaacagttttttaggctggaatgaaagtctcctttgttcacagagcaaaccgccttcaatttcactccgctctccgtgtctcctaacaattttgcttcagtattgtcaaggggtatccaagtctcccacattcatcctagctaacggaataaaaatctacatttctttcctacttcaaccctccaggctaaatgagctacagcattcagcctggaaaatgagtcgagcttttaacttacgtgtaaacattttaaatataatactgtagtcgcctgcctggaccttccacccaagaactacaacacccagaatgcactgttttcttttccgccttccacggagggaatgcctaacttgatctcatttccacaagtaatagtcacatgacacgtttcccgtcaagatggcggatactctcccttcggagtttgatgtgatcgtaatagggacgggtatgtgtagcctggtgcttcctggacaaagtttaggaagactgtcttgtttctgttttttctgtcagtggcgagttttgggacaaacatcgtgggtcgagagtgggagggagaactgaaaggaagtgaggtagtccggagtcagcgcgggagttggcagttacagggaggggctgggacccgcagtgcttatcgccatttgagtaggggttgatctggtcgatgctgattgctgaggttggttgctgcggtgattcctgttaatttccttagagggaagtggatgtgcagtgtcatgaaatggagggtcgggattttatcaacggagacgactttggcaagacattatgattccttccttattgatttcaaggtgatattccccatcattttgtctcgccatttcataggactttttcatagatttgtatgatcttagcatacatcgcagctcagacacagcttaatcctcagttttacaagaaagatgctcaattattgcccatgtgcgtatgaatttactagggaaagtaaacggattctattttgttgagaaacctagggaattttattttgttgaggtagccattattcctgctttatggtgcttaaagcatcttgctttctaccatcaataactaaatgtgctgagaataaggtcctgagttccagttcaggtgtgtgaccttatctaactcttgttttcccgtcgtttgttcttcatgttttgggtggaaccagaaactcctctgcagtttctagttgacatattcagtgtacaacacgtagcagaacacatatggcagcaatttcaattttttttaatagtgtaagggatgatcattttagatggaatgaaataggttgtttgatggggttttttactgtttgtagaatgtggtaggccagagaagctctggtggatgggaccctgtccattgtgttaatgaattcagttcgttgtcttctcatacagccatgattaggagcagccatgttttcaggttgggagtaaaaataatagctacctgttttcgaatgcttaaaatttcctaatcactgtgctaagcactttacaagccgaacataatcctcacaaccttgttagagtagtaggtactctctgcattttgtagaagaggaaaaggggacttggaaaagttgtaatttgctcaggatcacacagctggtaaatttccaaaggcccattccatcccaggaaaacagtcagtggttctgatcctcagagttgacccatattcgtagaaacaattgagaaaacttggttttaggtcttgcttagtgctagtatgaattgcttgaattgggagggccaggcactaaatctctctgagcctcagtttccttgtttttgaatataaggaaggtaaaatagatggtctttatgttgtctaacaaaaaatgcctgggtaacagttctcagaacagcatggacaggtttattcttagcctgaaaataactgcatggctgcaaataacctggttgtagctgctatgaacagatgttggatgagagctggaaagagccaatggactattcattttttcttttaagtctatactaaaactgagaacagcatccattttggaatagttgttataccatacttgagttttataatcttgctttttttgtgtaggaacttgaggtgtttttaacaatttttttaatcaacaattttttttttcaggtctgggttcaaattttaattgatgaatgttaattcttatgaatgatgctaatgtttttcataaatattttgccttctgtacagttcagaattggaagacatccatcctgatggagtctgttatggtagaggtaggaagttacagtgagtgagccagagaattgcatcaggtgacatcgcttatatttggaaaaatactcattttatacttatcccagtgagtgcaatgttatttttcagtgtttgggaagaacttatttgaagttaatcttaaaacttaaatttttcatattgtttattggtgacacattctaggttttatcaagcacattgcttaaatttatgatatgtaattttgcttttaggtacatcaaaagtgtaaaaattgaataaaagagtcattccccaaataaatgattccaacaattccaatcatgatttaatttgatttattttttagtgtgcttgggatatttctcttgtgaaatagtttgctgaaagtagcctttaaaatgtttgctttattaaatgtattacattgagcaaatcatagaaaaagcagtgtttcatagattcagttgtattaataaaagtagaagcaataatgcatgcatcagaaacatgaagaaataggctattagatatactttttagcagatttagtcctagttaaaatgtcataaaggaacaattgcttcatcaagtataatcatggaagataatattttataatccctttcaccttgattaacttgcattatcattttctgtaatgcaagatggaaattgttccttaagatcatattttcgagagattatggaaaaaaataaactttgtattttcttagttaagcccatttccttctgattagaaaatacagtaaatatctcttgaacatccaaagacagaagagtaagctaaagtggaattgcggaaaaaatagaagaaaatggaataaagaaggagggccaactggagtctcaagggagaggataaaaatagatatatgtggtaagggtctagaaggtgctcttcagcttgggtacagaattgtcattttcagggtattttgccatttaaaaagtcatttaaatgacagttttgtggattatagacaagtaccattggttgaacgttaaaagtcgtcccagtaacattacatctcactggaggtgacttatctggaagcctgtgtaatctgcagcacagcagagccaagaactcaacagaagagcagtcaagatggaagttataagatctatatgataatattgacatgcttcatacataggggaatccctgagatcatcacttagaacatattcatcctcattttaaaaataattctagcaagctcagcatattagaaccacccccttagaagatacaaggaatgttatcaacttctgcaaagactatgtttggtggggttgctattagacatacaaatgacagtttgtataggaaagggaagagaaaaacacctaaaatgcaaacttacatcaaacatcacaaaggcctgataacatttagtgtagtgacaaatactcatttttcaggtcattcaacccacatttactgagaacctagtcccttcccttgtgaagtttactgtattgcctattctcaggaacgttctggccttcctaacagtcatatccccaaagctgttcttaagacaatgtaggcttttcattgcatccttctttctttttgaagaccatgtagacattcagcctgcattttttctttttaaaagcacactgctcacatcttttggagttcttcccctaagatgggctgcagagtaggttagcttaatttttctactgcataggataaacacatatattcttttgatttaagagttttattgttagccaagcatggtggcacgggcctgtaatccccattactctataggctaaggcacaggcatcccttgatcctggaaggcggaggttgcagtgagcttagatggcaccactgcactctagtcagagaaacagagtgagactgtctcaaaaaaaaaaaaaagtttcattggccaggtgcagtggctcaggcctgtaatcccagcacttggggaagccgaggcaggtggattgcttgagctcaggagtttgaaacctcagcctcccaagtagctgaaatgggtgacacagcaaaactgtatttctacaaaaaaaatacaaaaattaattgggtatggtgacacgtgcctgtagtcccagctacttggaaggctgaggtgggaggattgcctgaaactgggagtttgaggctgcagtgagctatagttgtgtcactgcacttcagcctgggcaacagagcaagaccctatctcaaaaaaaaaaaaaagttttattgctaaagattatggggaaagagaagggatagcaaagataaacatggaaattataaggagtactgcccctaaatcctgattatcttgctagatagtgtttagcaccatacagtagtagatgtggcagcatggtgtatgataatcacatgaccatcctattgtgtgattttgggaaaattacagaatttcttgtgacatcatttagttcatctgtaaagtgagaaatttcaatagatgatctccaaggtagggatctaccagccctaaaattaccattgtatatatctatttatgacaccatgtccttgagaaaaggctaaattctgttctgtgtagtctttttaagaaggaaagtcagtgtttcatatacttcagaaattttcctataaaaatggctgatagggtttagatatttgtcctgcccaaatctcatgttgaaatgttatcctcgttgtcggaggtggggcctgatgggatgtgtttgggtcatgggagtggatccctcatggcttggtactcttcttgtaatagtgaattcgttcttgcaggatctggtggtttattttttaattttttttttgagacagggtcttgctctgtcaccctagttggagtgcagtggcacaatcatggcccactgcagccttaacctcctgggcccaagcaatcctcccacctcagactcctgagtagctgagattacagacatgcatcaccatgcctggctaatttttttttttttatttttgtagagatggggtctgcctatgttgcccagcctggttttgcacttctgaactcaagcaatctacctgccttggtggcccaaattgctgggattacagatgggagccactgtgcctggtcgactggttgtttaaaagtgtgtggcatctccccacacttgcttgccttgcctctcaccaagggagatgcctgcttcccctttgccttctgctatgactaaaagctccctcaggcctccctagaagccgagcagatgcctgtaccatgcttgtacagcctgcagaaccctgagccaattaaacctcttttctttataaattacccagtttcaggcattcctttatggcaacacaggaacagcctaatacagtgactgattagaaaaggcattttcttaaaaatgataggctgcttttttcagaaaaggtcacttaagtagcctttccttgatgttgggatgttccagtcccattccttgatgttggtgaatttaaacattaaggtagttaaccttgactggcagctcattgacttatgatgatgttggaatagcatcacttctgtaagccttgggggatagtaatattgcaggaggagttgtgaaaactgatatttaccaaatatctgtttgtgccagccttaacacaagtgatttcctatatttctaacttaatcttctcccaggatgcctgaatgtggttctcacatcacaggatgtccatagtcctccctgtgtacttccaaaatcttcacatctattgtctacagtggatttttaaaaattgtaagatgccacctattagtggatcatggagtgaattccagcattataaaaatgaggtagaatatatcagaatgcatgtagtaaggatgaatgttgttttttatatatatatgtatatatatatatatatatatatatatatatacacacacaccatatatataacatatatatatatatacataaacacacatacacacatatgtttttggggagggcaggttcaaaaaatttaaagcatagagtatattgatcagctgaatgacatagtgagtaggagtgaaatggtatttcaaaagtcctttctttgttgtcttctcttttgttcaccagcttgcattatttatcatttgttttcctcatagtttttggaacagatttagtatcggtcttatttgaggtatagtatgaaacactccgttgtcagcgtaagagatgctataggagtgaaagatagcctgcagattttgctgttctgaaaaatgctttgcacttcttcaggcatttattgatggaaaagtatgtttttgtttgcttccaatacctagaaaagtaaagagttatctaactctggagaagactctctgggagatgcttacccttctctgtaaatcatgaatttgagccaatacctcagagagagccacatctgttgccataatttcctctgcagcatcattttcatctcccatgcctcatgtcatttttctcattttctccagtgttttcatgatgttttggataacaggctacagtaattaaattcaaatatggcagcccaccattacattctcatgtttaacataaaatcccaatgcacagaaacaattataattccatataattgacctgttaactcatgctaaatcatctgctattcagtctcagtgcattctttaactaaaaagttagtctgtgcctgttctgtatataaatatatttaaaagtaaaataggctaaaaatcactgttggtgctcattggaaacattttgggggcgtttagttgtggccagcaaaatagggatacattgaaaggttgatgttttgtttttgcttttctaataatttcatttaaggtttggtgtaaaaagagttgataatttatcacagatactgcttttttagagcatgattatgagagctagcatgttatcatattgagggtgtttttgaaaagaacagtttgcaaacagacaggagaagagaccagaggcagcttggccagtatggtgcttaaataagtgtttcatctcatactggattttatcaggagctgaagttggtaatgtattccttgactgatttggtttttatcacattttaaaaagtactggtgaagcaggatattttcctgaccccttcatgggacttgtgaagggagcaccctgtttactcagcccaccgctttcaactcctcataggagggagcacgtgagtgaacaaggcaggaactggaatacatgagtgctggagtcagcctgccgctcttgtgccaggaggaatgaactccactcactcggacctgctgtgtttcacccctcacaagaggggatgtgcagttgagtgggtgcaggagccggggcgagtgcttttgggcactggcaggagtcaactctgtgctggccctgtggtagcatctccgggggtggtgcctgcaacccctgaagctccagagggaatgttacagtgctcttttagctctgctgtccgcagacggcttaagggttaacagctcagtgggccctctgcctttttgtgttaatcggctgccttctaccagtgagggcaaagggcaagtgtgacagcctttttgtgtccacactcatcgttcccgagctcttgtccggcatccaggagaaatgaggtcacatgaatgaattgaaggatggtaaatgtaggggatcttattgctgatggagatggctcttagtgggaaggggagctgcaaagggcaggaaggtagtcttcccctgaatgccagctgtctctggccagattcttcttcgaagttacgctgtcaaggtgtccctctgaagtcgagccacttctctctgatgtccagctgtagtctctaatgtccaactgcttctcttctctctgctggctgagcctggggtttttatgtacacaggatggggtgtggggtgggccgtaagtggtttcggaaaaggcaacattcgcacgggaaaatggggatataagttctcactttgcgtcatggtttcaggcttgagggtggggttttctcagggacctgcccttttctgcctagaatttccctgcctcctgtccctgtcactcactaacttctactctttcttttgagtattctcacctgtcttttttttttttttttttttggtctaggccagtgttctcattgagttattatggctactagttaatggtggttttaatcattttatattgctttgaaatgttttgaatcatgtttctgtgatctgactttgcacatttgttaaactagtcttatttatgtggatttaaaatcatcatgagaaaatttacacaagctaaagtatagagaaaataaagttctacacatggatatgaggcatattaagaagatgctgagctgtgagttcaaatccttattttctacacctgtgttactttggtttaagctatgtaagcaaaatcaatgataattagaaaattgtttttagtacctacaacacactgtcaaacacatgaaaaatattgtctaacatttgttatatgccaagcacggtgataagcccctacaatgcattgtctcattttcacagtaaccctgcagtagatactatatcatctccatttttcaaatgtgaagcctgaggctcagctaagtttgatgtaggtgaaacagttaagacgaaagtttttctgactaaggttgaggtattagattaagtttgctagaatctttcaattgaaaaaatagctcatagtatcaagatgagattattttaacctgggtttgtggttggcagttgttttattttggagagttatcattgttgacattaaaatcctgattccagcagtaacctcatgatgtcagcttcttattattgacagcatcatgacatctgtgtcagcttgcaaaccttcttttgatgaaggtgaacggaatgacctggttgtgtttatcccttaaaactgaagagagaatcaaccactaaagcaatggccagaaatgggatcagagattacagttacattttaagaaatgatttgcttcagtaggaattcttcattgatcctgtaaaccaaaataatttagattaccaaattaatttagaaagtttattttaccaaggttaaggatgcacctgtggcacagcctcaggtcctgatgacgtgccccaggcggtaggggcacagcttgattttacacgttttagggagacatgaaacattaatcaacgtttgtaagatgtataattcattggttccatcaggaaaggccagacaactcgaagtggggaggaggcttctgggtcatagttagttaagagacaaatgaggaatagtcacttatgccttagtctgtagtgaaacagtagggcggaggaagccatcagatacgcatttgtctcatgggaacagaggaatgactttgagttctgcctgtcctttggttgtccacaaggaatttccttatgggcaaattgtgagggaggtatgtagctttttaaaaatctttgtagtgatcttatttaggaatagaaagggagagaggtttgcccaacacaattcccaacttgacttttccttttggtttagtgattttggggagatttgttttcctttcacaatcccaaggtacataatttcccactgaaatacttgtgcatgtgctggggtttgccattttgtgtcttttttagtgttcttccaaattaaattttcaagatcaaatatgggactcattgtcctgtttatggagctttttttcttttggttgactattcttttgtttcctacagtcttcaacaactgttagtgcttacaatggatacatcatgcatcttaattgataggatggatatgataataccttttttggtccaaggtcccgctcattaaaaaaaatagtttataaagctgaaaagtttttatttctattttttgtaaaatgattttcatgataggattttatataaaggggaagggttttttgtatcatttttataacatttttgaaatgagtacttattctctttcatcatctattttagactcacagttttatgagtaatgcagtaaaggtcatgtggcacattagtaaaatatgttctgaacacagaaactattctccttatcacaaattaaattttatgttaagtttgaagagcactggcctggggtatactttgctgtgaaaagatcattttggtcacttaaattacaatagaaatatttgtgttaagaaaattaagtaaaaattaggctgggcacagtggctcacacctgtaattccaggactttgggaggcctaggcaagtggatcacctgaggtcaggagttcaagaccagcccaaccaacacagtgaaaccctgtctgtactaaaaatacaaaaattatccaggcgtagtggcaggagcctgtaatcccagctccttgggaagctgaggcaggagaatcgcttgaacccgggaggcggaggttgcagtgagccgagactgtgccactgtaccccagcctgggtgacaagagtgaaactctgtctcaaaaaaaaaaaaaaaaaaaaaaaggaaaaattagttgtagtggagattatttcctggcaaggataaggtcttcagcaaacatttatatttatttaacaaaacttcaagagattttgagttgatgtagttttctccatttagataaaaaacaggatgctacgtccatttttaagctttttacaatggaaaatttcaaacataaaaaagtagaataaagtaaccctccacataccagactcccagtttcaacagttatcaactcatggccagtcttgttttctctgtaatgaggactaagctctgattttttatcttgcccaaattcctacctaaggggtctagggagtcatgccctacaaaccataaattctcatcagatgggttttatttgaccctatatattgtgacttatttttcagtctgactctggcattaacattatgagacaaggaaaagatatttagccccaaaatatatttccttgccataccttgaaattgccctgcaaagtctcttgtgggaaaaatccacattctatagagaataccctcccccctttattttgcttcctttctttccagatccaggaggtaatcaactaagagccaggcacccttttaggtccaataggaaacattttacaacctgctctgtctctgaggtctgctacctgaaagattcctctgcacaataaaatttggtccccacaatcctttattttaacctgaactttcctttccattaatctcaggtcttgagataaactcaacaaattgtcagccagaaaatgtttaaatttacctatagcctggaagcacttccccccccaccagctttgagttgtctcgcctttctgaaccaaaccaatgtatttcttaaatgtatttgattgatgtctcatgcctccctaaaatatataaaaccaagctgtaccccaaccaccttgggcacatgttctcaggacctcctgagggctgtgtcacgggctgtggtcactcatatttggctcagaataaatctcttcaaatattttacagagttggctgggcatggtgtctcacgcctgtaatctcagcactttgggaggccgaggcgggcggatcatgaggttaggagatccaggccatcctggttaacacggtgaaaccccgtctttactaaaaatacaaaaaattagccgggcatggtggcggatacctgtagtcccagcttcttgggaggctgaggcagaagaatggcgtgaacccgggaggcggaggttgcagtgagccgagatcgcgctactgcactccagcctgggcaacagagcgaggctccatctcaaaaaaaaaaaaaaaaaaaaaaaatgaactcttttcgtcgacagtatcttccactgtttctctcatttcaccatccaaccctgttattttgaagcaaatcctaaatatcgtatcattctatctgtatatattccaacatatatcaaaaagtgtagggctctcctttttaaacataactactgttttgtttaacatgtgcttaacacttacatcacgtgccctcctttgtatcttcagttttttctaaggcatctatccattttgtttctttggtcttgtgctcttcctagtttagttttcttatctgaaatgattttttctttaattttttaactccattttttcaaaatgttcctgttctctaatcaccttacttttgagtttttctaattttgattcatgttgttctctcagagctgccaccattttgttaatttcttttagcacataataccataattagctacgtttttcatctaatttgtgaggttgacattcttttattgtctattgggatattattttgttccttattcccttttttccaatgtacattgaatgtgattcaactgaaatccttttgcgttgctcatttttaagtgaaaaatgttttccttttgttttcaataggaaggaggggccagtaaaactattcgaactgttttgctgtagacctctcttctttgttttcaggaggtaatcaaacatgtagcctgaaatctgctggctctgttaccctcccctagttttgtctagaccttctctttcctttgcctctattttccctgctgaatttggattaggttcccagcagttactcctcagtgtgggactatcccctcattcacaaggtgaagtctgcaaaaccccttcccagtttctgctgctgttctcagaatggtctgccaagcttccagtgagtgcctgatagcacttttggggttttctggctctcagggctgtaacagtttttttgatcttctcttcatttccttttgcacactttctttttttttgttttgttttgttttgagacaaagtcttgcttttgtcgcccaggctggagtgcaatggcgtgatctcggctcactacaacctctgcctgccaggttcaagcgatcctcctgcctcagcctcccgagtacctgggattacaggcgcctgccaccatgcctggctatttttgtatttttagtagagacagggtttcactatgttggccaggctagtctcgaacttctgacctcaggtgatctgcccacctcagcctcccaaagtgctgggattacaggtgtgagccaccacacccagcctgcacactttctaataccatgtgggtgttacagctattggtggcttgtaactacccatttctattttggggttcatgatgatattgtatcaccttgctttgttatggatgttgtccctgggagtttggtttgggtatcctgattgtactgtctgtttttatgggagttatgggggagattcaacaactgctgccatctttacagaagcctctttttatctttcactttatcatttgctcaagaatagaggtcaagttgttgacctagcataaacattcacttttcagaacttgaaacaaacctttgggtcacttattccaagccctttattttatctaataaggatatctataaggaatctgaattccagaggttaagtgactttcgtgaggtcacagctatttagtatccacctaaaaacaggaagccagtccttctgattcttaattcagtactcttgaatactgaaactctttttattagccatccctaaaggctcacaccatagtgaatttttaaaaattaaaataaattttccaagttaatgttttaatgggtagtatatttttcaaaaaattctaaaaattacatggctataaatacacattttgttccacgaggaagaagttcagagattttaaattacatttactaatatttagtattttgtggggaggttagagtgaataaaaataattgtcaatttaaaaatgatatttttatctttatgttgtggtagttccctaggctacttcatttgcaatttttccctttttatggtagccactaaaaagtagacttaagatgtaaatatttattatagaatttaagataggaatcaacaaaactacttaaacctgggttgaaattcagtttctgcttaattttgtgatgtcattattttgagtggctgcatgaattaagtatgtagtttcacctttgcattcattgctcaatcaagttttccttgccagcaattctgtttttcctaaaaaagaacttactctttattaaagcagtcacagtaaattttctagttctatgtaattttctttccattctggtcttcactggttataaataacacatggaatgactttcaaggtagaaagcagaaatccattttgaaatgttctataaaataaagagtgatttatggtttcatatgatttgagctgaaagtacttgggctttgccaggtcatcaaagtcctgtcaggggaatctattatttattgttcgatatgctgggagtggtgtaagtactttattttatgtttatctcgtgtaagcatagtgttaggaaaaatcaatcccagatactaatacattttaagaatatatcatggggaactaacctaaatgttatagttgtaaatgatgagatttgacattaagaatttggattaaagggggattttgaaaaatgaatagataatggttttatccctgtaaaatatcttaggtgaggttcttgggtcctgattttagcctagctccttcatttgataataaaacatctctatttcatctagacaggtttttagaaaattgcagaaagctggtaccatacatattagtgtatgatgatataacattccataagcttctaattttttttctagctgccacctttgtaacagaacctcaactgtgaaagtcatgatggaggaaacctcagtttcccccactacaactgttatgaaatggtaacttaatacctaatatttacctgtgtttaataaaaatgacttgccaaagttgttgtcttgcatcagaattacacatgcttgcttataatactgtggcagagcaagttgtttggtacaacctctctaatgaatgtaataattatattcaataatgtgaaatgtttaaatgatattaaatgtttgatgaacctctatagtttacataaagaaaaggttattggactttttaaaaaatgattttaagttgctagatctttgagggtaacttaagtaaatagtaagcaagtgatgccttttttttttccttcaaataactaatcttattgaaggggaaaggaagaggagggaagagaagcaacatttactgaatgccagtgacatgccaacagccactgtgtatagtgtttgataccgttttgtacctgttctccctgcacccatatgagatgtattattaacctcatcttacagttgaaaacgttgtacttgtatatttgtgctcacacattttacagagtgtttccagtggaatgctgtaggatttgaccctcatctaggttatctgtttctaactcatgtcgggcttttctttgtgggagagactgtatagttcaaaataagcacgtacatgtttcatctaaatgcctcacaaatatattgtgtgaacttgagtagtagttcacttttttaagcattgaatttgaacaggtgttattttgaaattaatcaagagtttaagtgccattaaaattgagcttagaaatattaatttaaacaaaacagtcattattttactaaattagcaataagaccaaaaacttttaagtatgcacttagaaatattaatttaaacaaaacaagcagtcattttattattttaccaaattagcaataagaccaaaaagttttaagtatgttaacttttcctaaataaattttttttttttgagacggagtttttctcttgttgcccaggctagagtgcaatggtgcgatcttggctcaccgcaacctttgccttccgggttcaagcgattctcctgcctcagcctcccgagtagctgggatgattatgggcatgcgccaccgcgcctggctaattttgcatttttagtagagatggggtttctacatgttggtcaggctggtctcgaactcccgacctcaggtgatctgcccacctcggcctcccaaagtgctgggattacaggtgtgagccaccgtgcccagcgctaaataatttttaaaaaccatgaagcataaagctccagttttatacaagtttatcctccttgctttgactacagtttttatttttattttttgaaaccctgatttgaccatgatctggctaaagtcctttcaagactccctattcctcagaggctcaagttcagatactataatttggcttcaacctcttggaaatttttttaaattttgttttatgttggtaagaagacttgacatgagatccctgctcttaacaaatttttaagtgtgcaatacagtgttgtttactataggtacaatgatgtagagcagctctttagaaattattcttctttcataactgatacttcatgctagttgattagcaactccccatttccctctcccccaaacccatggcaaccaccattccactttttgattctgtgaatttgcctatttttaaatacctcatataggtggaatcatgtggcatttgtccttctgtcactggctttatgtttgttgcagcagtgttcacaatgggtaacatgtgaaaacaacctaaatgtccatcaacagaagaatggatagagaaatgtgatatatccatataagggaatattacgtggttattaaaaaaaaaagtaatgaagtactgatccatgctgcaacatggataacccttgaaaactttatgctaagtgaagtaggccagtccaaacactttttttaaaggatcactttttggttctcccttcctttaactttgccaggaatgctcctttccactttcctttttccatcttctgcactcctcagttagggttgttagagaccctgaaagacccagctaatttctcctgttctttggagctttccatgactccctctacagagggagtgtttctttccattgtgtttctatcacagttttaaatacacttattattttaatctctttaaattcttgttacatagactctgagctctaacaggctagggattatcttgcaaaaaacgtatggcaacctctcactacctagcacagtttgttctctctctcccttcctctcccctttccccattttctttttcttttcttcagcaaatatctatggagaacctactacatgcctcctgtatcctggaaattctgtttattgaatgggtgggaagaaatatgaaatcttggccaagaagacattgttaactgtattattagtttgctattttagtcattctaagcatgaagataataggcccttgccatttaacattagaacagcttatgaatttcacaaacttatgggaatgtttggatggaagtattaaggaaaaacacaaatgatagtcattttggctttatgtaatttggactcaaatcatgttcagtattgaaatccattcttggctttgctttaatagcagagatttgacttctgacattgttgatcacagccatggaaataaccacgtgtataactgcctaccctaagtaagagttatttttgggccaaatggaggcgagtaattttattattgttcaccattggagctggcatctggtgaaaataggtttatgtttggggtagtgttagatggaaataatgcttctaaaatatcattctgaaggataataagagtagatagtgttcatagggcaagtacccttgctaacaacagaactgaattctgtgaggtagatcatgatattctcattgatagatgaggaaacaaaggctcagagaagtcaagtgacttatctgaggttgtgcagctaggtgagtagcaaaaccaagattcaagtctaagtctgtctgattgagaccatgcctgtttcattttgttgctgtattgtccttgaatcttcattttcaaacttgcatccaagttggagatagtgaattatcatggtaatttgaattggggatatggaattaccaaattacttggtatttggcaagttatttaacctttcttaacctatttcctcacatagataatactgcctgcctcctaggattataatgaggaataaataagatgatgtatgtgaaaatacagtttggaggataaaaccctatactaatatttggtggcattgttattaatgctgtgattattacacataagagcattaatctttaactactaattctgcttcctgagtatttctttgccattatccttttaactaagctgcttatcagcttttaaagtaccataatgactgcatttcactaaaaaggaacattatttctttaagtgtagcaaaaagttcagatggtcttttgatttcaataagggttttaacttaaaaactgcatttagctatttaaaactttctcctatttccctctactccagaaattcttattttgtttacttgaattatatctaaagttaagcttggaactttatgatggcttgttttcgatgattgatatttaatggttattttcagtacatttgttagaacttcttttgttttgaaccaagcattatattcccacaaaatgttcaacactggaaaactagttcctctgtgaaggcaggctggagcttgtgtttaatatggattttagctagagattgactgtatcaattgtttccatatgcatattgctttttatatacagaagatgactttcccctttcctgaaatccttgatgcttagtgtgtagtttaaacccttgccaaaagactggtgctgtttttttttccactaagtaaaaacacgagaggatcaggatgtttcatcatggtgaaggagttcgtagtagcactatagaattgcactaaacttttaaagcatgctttatttttataactaatataaaaaatactagcttctatcaacatggtagatcatatgacaaaaatttttgaagagtctggaacttacagggtattaactatcaaatagaaaacttgaatttttaaaatcataaaacatcattatctttggcaatttttaatttttggttggtgctggtagaaataatatatatatgtctttttatgataatcagctttatggtatgattaagtttgattctaaagcataaatgttttgtttttatactgctatattggtcaaaagcaaaataatgtatcttgtaagcagcccctttctaaactagctgacatatttcttaagctaaaaagtgtgtgccattccccctcagaggcattgtggcttcggagttatatctgggtttaaatttcaactctagaacttttttttgtttgttctaagcattgggcagaaagttaagatattcatgtcctggttctttttcttcttctctaaaatgcatatgcatatggttatctctcagtgcaattgggagactcagatgagctagtgtgtgaacatggtttttaactgaacaatatatagtagttacagttgctcattgatggtaatttacatacaaaaagattgtaagtacttttaaaaattattttttcttgccaaattaagcagaactgctttttaaaaaatatctctggccgggcacagtggctcacgcctataatctcagcactttgggaggccgaggtgggcggatcacaaggtcaggacattgagaccatcctggccaacatggtgaaaccctgtctctactaaaaatacaaaaattagctgggtgtgcggcgcatgcctgtaatcccagctactcgggaggctgaggcaggagaatcatttgaaccagggagtcggaggttgcagtgagccgagatcgcgccactgtactccagctggtgacagagtgagactccgtctcaaaaaaaaaaaatgtcttccacataataaaattttcagtatgagtggtatatgtttaagaaacatcttacagtataattaatataaactttataattctgaatacaagcaaggatgggtctctttggtggttaaactgttctatacagcaatggcatgtattgaacattttatgtaaaatatatatatttctacattctaaatgatacgggtgtgtgtttttgtaggtttgcctgaatccatcattgcagctgcatgttcaagaagtggccggagagttctgcatgttgattcgtaagtttatcaacgatagcatttaatatttcctaaatatctctatacaggattaaaatttacataaacacatatatgtctgtacgtatgtacatgtatgtgtatatcatacataaacttaagttagaagaaagatcggagttgtttaattttaaccactaatatgtgaaatatatagcatacaagttttactattttgtgaaatagtgatctttgagaataaaccaaatgcatcattttatttttctcatgagtgattttgtttaaaataacaagtaattctccaagaggcttggaaacctcatgcctgccccttttcctacatatgtgtgtgggtatatacaacctatatatgctattgtattttaggcttcatatttgatggttgtaaaagtcagccaatagattttgagcattattttcttaaacttcatcaaaatttaaacttaggaagtcttaactaggaaaaatatctacaattatgtttttccctttttttcttaaatgtgatgataagcaggaggttgatggaaaactcaagtttaagataaagcataggttaaatctctccatttctatatccgcccaaaacaaacccctaatctcccacctattaagtgcttttgactgttagatcttggcactttaattcttcattgaataggaatagaaagaagaaacacactttttattttctgttagatattaactacagtgtttttcagaatgctacaatataaaaaaaattagatttgtcatagcttatagtgtcttcccatatgttatctcattgtaaatatgtaggaatccaaaaagtaacatgagttaatcttcttttaacctgttctaaattcattttgaaagcatattctgttataatagctaagatttgggagcaactggatgaaatttctaaattggattcagttttcatacacgtcctgcctttgtaatttgcttttactatttcactattgtatgcacgactgcttgtgttaatctctcaattcagtctttttgacatatcatgggtttacatgttagaaaatctgctgccttgggccaggtgtggtggctcatgcctgtaacccagcactttgggaggctgaggtgggcggatcacttgaggtcaggaagtcagaagtttgagaccagcctggccaacatgatgaaactccatctctactaaaaatacaaaacttagctgggcgtggtggtgcatgcttgtaatcccagcttcttgggaggctgaggcaggagaattgcttgaacttggtccggtggtggaggttgcagtaagccgagattgcactactgcactacaacctgggtgacagagaaagacagtctcaaaaaaaaaaaaaaaaaaaaaaaaaaaaaaaaaaaaagaaaatctgctaccttgaaagcccaggtactgagacagtatactttaaaatattaattcagatatgtttttcatgaccttatttaacctaaaattaaaagtaaaattcttgcttctcatttctcaaaggtagaatgatagtaaaagttattgtttgttgagcttgcactacgtgctagtcaacatattagtttctttacacatgttatgtaacttaattctcatcacagccaagtaaggtaggtggtgttatcccaatttgacaaatggggaatgtgggacatagagacattaagtaatttttcgaaatttaccttcctaacatgtataattttagtttcagatttactttgtgtgtaggtatgtgttttttttttctttttcttttcctttttctttttctttctttctttctttttttttttttgacacaggatctcactctgttgcctagactatagtacagtggcatggtaatagctcactgtaacctcaaactcctgggctcaagttatcctcctgcctcagcctcctgggtaactaggactacaggtgcatgccgttgcacccagctaactttgaacattttctttagagatggaatctcgctatgctacccaggctggtcttgaactcttggcctcaaacgatcctcccaaaatgctgggattacaggcatgaactaccgtacctggcctattttgtgttttcttattccagaacatgaggtcttcccagaatgaagactattttacaaatcaaattgggtttactcatattccaaaaataaagtttgattaaaaatataagaacctaggtcttactttgacaagcagtgaatcaattagaaaagcttgataatatggttgtcttaagacattatagtataataaaaatggcatttcaaagtgacgaaacttttcttcttctcttgtacatcctcagacttggtggcttttgaaagtttagatacatctaggtattgattctcccacatcttaagcttagatttggggcttctttggcaccattatctgagggtagtggttgtctgcatactgatgatatctcctgatctgaatctgttctgagccccagtttcatatagcctatcatctgatatcttcatctagatgttccacaggcaccttaacatggctaatattaagccatgaattcatcctccccattctcacctcaaaatgtacagaacccaaaaaacagcatcctgctcccagtcttttggaatgataacaccgtctacccagtttctcaacttaacgaaacttgtatacttctgttgattttcttgctttatcctccagatttattcagatgattttgataataatagaacacatttattgatctcttctaggtactatgatacatactttgaaaacataatttcacttatatcccctaactttaatagctctccatatctctttttctttatgccactgtcatttccctagttcaaacctttgtcatttctcaactgaatgagctcataacctcctgactttatctccagctctctagtttatttatcacactgccaccagtcacatcactctgctgcatgaaatccttcagtgtttctctgctgcctatgttagtgattttccaagtttaaaagaaagacttagtgagggaaccgaaacaacttgaaaagatgaaagcagagctgctgtggttgaaatgagtgggtctgggtcagtgtagatataactggattttaggagaaagtccaaattttctgtatgtcatacagtgccatctatgatgtggccttgcttaaaacaccttcagcctcatctcttgccacttcaatctttaggtgtagacaccagcaatgctgaaatttgcagtagctgaacatattgtagtctttacttcatcttcccactttttgtctgggatttacataaggtatcccctcagcctggattgcctgtctctacccctcagcctggctaacttctatttgtctttcaatgtttagcttacataccacctcctcagggaagtcccacttccttaaaccccactggctatgtgtcacaactatgcccaggtttttgtaatactgtataagagtgccatggcatttatcatactcttaatcattcacttccctgtcttccccactaccctttaagcccttacatcataggtcttattcatctttgtatctccagcacctagcacagttgctggtatacattagatatttgatgggtggataagtactaatacatatttgtgtgtatgatttttttttttgttaatggttagtttggtgttgtataatctttatgtcacacacattttggataaatagccgttgttagagatgtaatctgtggctaaaaattaaagtatgcagtcagtaaccttgacttttagtgtcatcaagtttttaaactatcaccattcatttttattgagaatctttgtgcaaggaattgtgctagatgttaagaatgcaaagataaataaaaatacactgactcacaatctagtaagggaagtaaagaaatagacacacatgctatgctatttgatggaggtatatataaggtgctatagggggacaactaactcagtgagagggcttcccataggagtaggtaccttatctaaggttctaaggacaggtaggatttcatcggatgagatgtactagtaggggttggagctgggagtaacattttggacagatggagcaacatgtacaaagatttgagagatgaaagagagtgacaagtttgggaaactacacgtagttgagtatgacaggtgcagagaatatacaattaagtacaggttggggtggaaagttgagggtacaaaggtagggctcaggtcaaagaattactttatcttatagatattaaagagctattaaatgctcttaagcagaggaattaaatgatcagatgtgtgttttagtactacacagtagatggttggttggagaaaggtaggcagacttgctaggtggctgtttgcaatggtctagtttatggatgatgaactgaagaagctattggcaatcagaatgaataaaaggtagaaggatttgaggttatagcaagaatttttggtggtggatcagataaagtaggtgagggaatggaaggaattacagatgacaccaaagattctggtttgagccgtttggtggatggtggtgacaatttcatttacttatgcaaggaattcaagagaatgttcagacttagggatagaactggggaagggaagataatgtgttcagaattgaagatgttgagtttgaggtaccagtgacataccttggtgaagagatccattcacctagggatgtgtatgtgtatgtgggtatgtgtataaggagcctgagtggaagatctagagctggagataagagatttgggcattatttgtgaataaatggctgttaaaaccaaagaagtgaatagaatcatcctgaaaatgcatatagtgaaacacaaaacaggcaagtatagaaacctgggcaagagcaacttttaaggcatgggtaaaaggagaaaagccatcaaaggagattgaaaggaaacaatcagaggttgagaagaaaagcaggagggtgtagattttcatatatggcgacttcactccttgaaaaccttagtgtctctctacccatagaggagaaagtctgaaggaaaggaacatttatgtaatgttttcctgctctgggccaggattaaatattttatcatttaaaattcattttagcatttaagactcttcatcaggttcagtctacttccccagctctatctgtcatgtctgctttacatgtaaaattataccatatatctgtgttctgtggacatgcctttatttgcttttctaaaaataattttttaaaaattgtcatttaaacatgcaaagtttaccatcataaccatttttaagcatagaattcagcagtgttcagtatgttcacattgttgtgcaacagatctccagagctcttttgatcttgcagaactgaaactgtgtacccattcaacaataattccctattttctactgctcttccagccactagcaaccactactccactttctgtctatgattttgactactctggatgcctcattcatataagtgtacttatgcagcactatatttgtcttttttgtgactggcttatttcacttagtacagtgtcctcaaggcttatccattttgttgcatactgcaggatttccttcctttctaggcctggataatatcccactgtgtgtgtatgccacattttgtttatctcttcatctgttgatagatatttgagctgcttccacttcttggctattgtgaataatgctgctatgaacatggctgtgcaaatgttttttcaagatcctgatttctgtttttttggataaattaaagtgggattgctggaccatatagtagttccactcttaattttttaggaagtgccatactgttttgcatagtggctatactgtttcacattcccaccaacttcctattctttggctttattgggaagttgtatgtgagcttttaagccagagtgcctgtgttcagatcttggtttctccacttactaggtgtgtaacctttggcaagttatttaatctttctgtaccttagtttctttataaaaatgacataatattggtaccaatgtttgcaaaagaaaaaagggcataataatatttaatatctaagattgttgatgggattaaatcaactaatctatgtaatggatttataacagtgcttcatagtaagccctcagtaatgttagcatctactactcttaacaatgctgtttctgccactacaggtgaatagcccttatctgaaatgcttgggacccgaagtgcttcggatttcatatatatatatatatacacatatatatacgtgtatatatatatatatatatatatatatatatacgtatatacacatatatatacgtatatatatgtgtatatatatgtgtgtatatatatgtgtatatatatgtgtgtatatatgtgtatatatatgtgtgtgtatatatgtgtaaatatatatatatacacacatctgggattcagatgtatatatacacacatatatctctgatagataatgatatatatctctgatatataagatatatatatcagatgtatgtatctatcatatatatcagatatatatgataaatatatataaatatgatatatatgatgtatcacatatcagagatatatataagagcatctactgctcttatatatttaaatgctgcttctgccgctacaggtgaatgaatagcccttatctgaaatgcttgggaccagaagtgtttcggatatcggagatatatatcagatgtatatatcagatgtatatatcggagatatatatcatatgtatttcatatatatcggagatatatatcagatgtatatcatatataaatttttgtaatatttgcaatatatagtaatatttgtaatatatatttgtaatatgtatattttgtaatgtttgcaatatatatagtaatatttgctatgtatatatatatatatgtaatatttgcagtatacttactagctgcatgtctctaatctgaaaatctgaaatgctccaaggagcatttcttttgagcatcatattggcactcaaaaggttttagattttgaagcatttcagatttcggattttctaatttgagatgctcaacaggtactaatactactgctactattagataagaatagtaggaagccagattaaaggcgtgactaattatgcctgtgagatttgtggaaagcttcacagaggtgacatttcagctgagtcttgaaagatgattgggatttaatgaggaattggagcatttcagaaagagggaacatactgaaagagcgtgggatgctaggtgaatggtgagaattttagtaggactggaaggtaagctaagtgaattgggttcatgagagttgaaattagaagaattaaactggaatcattctgaggaccttgtatgctgaggtaggaagtactgatttttgtctttaataattatctttaatctcatctgtctttccttcaaactcatatttcatgcttcagcatatcctgtcacctctacttccaaaaacagtttaaatctgttttctctgtctccactcttcctcaccgtcattgccattggactactctgataacctccttattgatctttctgtttctactactaccccaatttttggccttttccccatttctaactgcatcatttatattctctttcttgcttactatactgtgctattgctgtaactatgcactcattttttattttatttttttaggctagtcaagtgaagcagtgggagttgaaaaggagaaggaacaaataaatctgtaactgattatgatcaattagttgtaaataccactgcacttggaccagcctctggacattttttcattgttaatattatttatgcctcttctctgtttctttctccttgatctctcttgccagatatttgtttgttttattagacttttcaaataaccagctttagctttgttgactccttcagtgttatctttaatatgtacttttatctttatttcctttctttggcttggaatccctcttgtgctttttctaactttttgaattaaattcttagctctttatttttaagccttcttttttgcttaatataatcatttatgactatatggtttcccttaaggaccacattagttctctcccatgagttctatgtattttctaatagctgttatgatttcttctttgctctattggttatttagaggttattgttttaaatttcgaaatatatttttaaatttcaacatctttattgacttttaaattccaacactcatgacagaacatgcaaatgacacaaagtaaaaaagttcaagtgtgcctcctcttcctgcctgcaccccacccactctgtcccctgtcccacctcccagaagcagctactgttaccttttatacattctccagagacgtaagttacagaaaaatatgtatttataatgtgtatgttagatttggtatagaaaaattataagatactgagcagttaacatcaaggatctctcatgttgcctttttataactgtatctacctccctcctctgccactcccctgccttcagttcctaaccccagtgaccactagtctgtttttcatctctattattttgtcatttcatgtatagaactgtacagtttgtaaacttttggcattggcctttttcactcagcctgtttccccagagatccatccaggttgttgcatgtatcagtagttcatttatttttattgctgaatgatatttcctattatgtatgtatcacagtttgtataagtattcctctgttgaagggtacctggagtgattctattttttggttattacagataaaattgctatgggaacatttatatagttgttttggtgtgtgtgaatgtaagtttttatttctctgggataaatttctaggagtacaattgctgggtcatatggtaattatatatatttagctttttaagaaattgccaagctattttgcagagttcctatactatttcccattaacagtgtatgagtgatccaattcctctgcatctttgccagaatttgatgttgtcacctttttttgtatttttggtaattctgataggtgtgtagtgatatctccttattttaattcacattttcttactggctaatgatcttgaacatttttcacgtggttatttgccatctgtatatcttttatgataaaatgtcttaatgtattttgactgttttctaattggattgtttgttttactgttgggttttgagttctttatgccttctaaccaaatacatttttaactttagtttttcttttcataaatggtttccaatttaattacactattgtcagagaatgagctctgcatgacatcaattatttggcattttttagaattgcttcatggtttggaagtatatggcttcatgtggcttgttgtgttttctctaattgttagagctttatatgttagatcaaatttgttaatgttattgtttgaaatttatgttatctattaattgaagagtatattaaaatctcctatcctgattgtggaattcttatttttccttgcaattccaatttttgctttatatgttctgagtatagataggggcatacaggtttagaattgtgatatccttgtgtaattactccatttgcctagattttttcttttttctagctttttcgtagcttttttctttaaagactattttgtgtgatgttaatgtaatgacattaggtttccttgttgtattagtctgttttcacactgctgataaagacatacctgagactgggaagaaaaagaggtttaattggacttacagttccgcatggcaggggaagcctcagaatcatggcgggaggcaaaatgcacttcttatatggtggcagcaggagaaaatgaggaagatgcaaaagtggaaacgcctgctaaaaccatcagatctcgtgagacttattcactaccatgagaacagtatgggggaaaccatccccataattcaaattatttcccactgggtccctcccacaacatataggaattatgggaatacaattcaagatgagatttgggtggggacacagagccaaaccatatcattccgcccttggcccctccaaatctcatgtcttcccatttcaaaagcagtcatgccttcccaacagtctcccaaagtcttaactcatttcagcattaatccaaaagtccacagtgcaaagtctcatctgagacaaggcaagtcccttctacctatgagcctgtaaaatcaaaagcaagctagttacttcctagatacaataggggtacaggtattgtgtaaataaagccattccaaatgggagaaatgtgccatagcaaaatggctatagggcccatgcaagtccgaaatctagtggagcagtcaaattttaaagctccagaatgatctcctttgacttcaggtcctttgacatccaggtcaccctgatgcaagagttgggtttccatggtcttgggcagctccgcccctgtaactctgcagggtacagcctccctcctggctgcttttatgagctggtgttgagtgtctgcagcttttccaggtgaacgtgcaagctgtccgtggatctaccattctagggtctggaggacagtggccctcttctcacagctccactaggcagtaccccagtagggactctgtgtgggggctctgaccccacatttcccctctgcactgccctagcagaggttctccatgagcaccccgcccctgcagaaaacttctgtctgggtatcccggcatttccatacatcctctgaaatataggtggaggttcctaaaccccaatttttgacttctgtacacttgcaggctcagcaacatgtggaagctgccaaggctttgggcttgcaccctctgaagccacggcctgagctttacattggcccctttcagccaaggctggagctgctggggctcagggcaccaagcccctaggctgcatacagctgggggatccccggcttggcccaagaaaccattttctcctaggcctgcaggcctgtgatgggtggggctgctgtgaagacttcctacatgccctggagacattttccccattgtcttggggattaacattggactcctagttacttatgcaaattcctgcagctggcttgagtttttcttcagaatttttttttttctatcacattgtcaggctgcaaattttctgaacttttatgccctgcttcccttataaaactgaatgcctttaacggcacgtgagtcaccttttttttaatttttattttttgagacaaaggctcactgtgtctcctaggccagagtgcagtggtgcgatctcggctcactgcaaactctgcctctcgggttcaagtggttcttgtgccttagcctcctgagtagataggattagaggtgcccgccaccatgcctggccaatttttgtattttcagtagagacggggtttcaccatgttggccaggctggcctcaaactcctgacctgaggtgatccacctgccttggcctcccaaagtgctgggattacaggcgtgagccaccccgcccggccccaagtcacctcttgaatgctttgccgcttagacatttcttcttccagataccctaaatcatgtttctcaagttcaaagttccacagatctctagggcatgggcaaaatgccaccagtctctttgctaaaacataacaagagtcacttttgttccagttcccaacaagttcctcatctccatctgaggccacctccgcccagaccttattgtccatatcactatcaggcttttgatcaaagtcattcaacaaatctctaagaagttccaaactttcccacattttcctgtctttttctgagccctccaaactgttccaacctctgcctgttaccctgttccaaagtcacttccacattttcgagtatctttcagcaacaccccactctactggtaccaatttactgtatcggtctgttttcacgctactgataaagtcatacccgagattgagatgaaaaagatgtttaattggacttacagttccacatggctggggaggcctcaaaatcatggtgggaggtgaaaggcacttcttacatggcagcagcaagagaaaatgaggaagatacaaaagcggaaacccctgataaaaccatcagatcttgtgagattattcactatcacaaggacagcacgggtaaaacccgcccccatgattcagttacctcccaccgggtccctcccacaacacacgggaattcaagatgagatttgagtggggacactgtcaaaccacatcagagtgacacatgaagaagtttctattcctttagaataaaaaaaaaataactttttcatgtatatattgaaactaaacttctaagctaatcaaagtgttttctcaagcaatgcaaggcccacccctctcatgttttttgttatgtagcattttggtgacactttgactttataatccttatttttttaatccttattgttattatgtttgattttgtaagtcaatgcttatctagatttgcctttttgtaccagtttctttgcttgctcttcattctggcactaatgtcctgcttcctgaagttctttcaccctgagtctgttgtttcacactctgtctttgtgatccgcccgccttggccacacaaagtgctgcaattacaggtgtgagccaccgtgcctggcctatttcattgttttaaaacatgtaaagcatacttgttatatagtgatgcaggatttttcttggccactttgccaaccagagacctccacagccggggacacccccactgcctgggcctcgcctggtcctggcagtgtcttgatttcaccttcagtttcaaattacagtttagttagttctgtaattcatagtgttttccatcagcactttgtcctctggcttcttttattgcttttgagaagtctgctgttagtctgtcattcttttgtagatgaattctcttttccttctggtaactttaacattctcttgtttgtgtttatagtcaggcagtcttgctcttagctgtctagatttgggctttgtttttatttatcctgctcaggacttgttttgccacttgaaatcagatattttatgccttttattgggaggaaagtgccgatatagtttttttaatgttgcctgtctcttattcttccttttggaaattcttagaaatatattggatcttctcattcttttattcctcataacatctctttcccatttcttgtctttttcttttcgatgctgtattctgagtaatttcctcagctttatcttctggttttgagtttgcaaactatggcccactggccacttggttttgtaagtaaaatcttattggaacgcatatttacacattaactatggcaggtttcacactacaaaggcagaattcagtaactgcaacagaggctgtgtggcctgcaaagcctaaaatatttactctctggccctttataaacattgcttgcagacctctttgccggttctccccttcttccttaagatgtgtctgattttaacttagctatcatttttatctcaatggcttctagaagttctgtttggttatgttttttaaagctgtcatgttctttgtgtttcaatttattacattgtttttcttttcttttttttttttgagacgaagtcttgttccattgccaggctggagtgcagtggcacaatctcggctcactgcaacctctgcctcccgggttcaggcagttctcctgcctcagcctcccgagtagctgggactacaggcacatgccaccatgcctagctaatttttgtatttttagtagagacggggtttcaaaacatcttggccagggtggtctcaaaactcctgacctcatgatccgcctgtctcggccacccaaattgctgggattacaggcatgagccaccgtccctggcctatttcattgttttaaaacatgtaaagcatacttgttttatagtgacgcaggatttttcttggccactttgccaaccagggacctccacagccagcaacatccccacgcctggacctcacctggtcctgggccttccactggaggtgacccgcccactcagcctgtgttgcagattgtactcgagtttggtggttccccgagctcttttcctgtgttcaggaagaatgaggatacactgacaattagaagggtctggatgggcagagaagaattttattgagcgatggaagaggaaaggggactccaggtggtttctctctctctgtcagtatggctgtgtccggggttttttatgggctcagaataggggagtgtgtgctgattgctgagtatgcaaagaaaggctaaagcaaaggcaccactcaaagttgggcatagcagtgtagaaaagcaattaggaaagggtagatataagtaaaataggtgaagggtggggatcagtcagagaaagcatgccagacaggaacacaggttttcaatccgatctgtggatttgacttctagcttggctttcaggctttaaactgtcttcagcttggaggtggggtttcactgtagacctgccactgtctgcctaggcctttgtctgcctcctgccactatcagtagcctctttcacatatttctattatattgccaggtgaggtatcagagccctggcactgggaagtggtcaacttctgggttggtaaaaagaatttgccaacaacagtataggtttgaaaaaggagtttattaggaagaactctgcaaaaggttccagcggggtgcctcaatgagaggactgagcattcagccttggctttttccttagggctatttatggaccttaaagtgggagcttagggttgtaaaatgagtttcaacatggcattccagagatgtatagaaattttagttacttataaaagttgaaagaggcctggaatcagatgtcaactttatataccagggaagtttaattatttctaaattccctagataaggagtttatcctccaaatggcctgtttgatggccaccaggtggtctttgctcccttttaaattcctcagataatgagtttttgtctccagggcctgttcaattgccaccaggcgattttcactttcctcatatataatgtttttggagggtttaatatgatttgttattttctctccagctttagggtcagtatttttccttccttttccccctgaaatgttgaattttgaatttctcttaagtggcactttgcctggaggatccctatgtttctgccgagtggttttgcatttccttttgcctcatcacttactgctattactagtggtcttagtttcctattactgctgttataaattaccacaattgtagtggctaaaaccaatacagacttattcttttacagttctgtaggtcagaagttcaaaatgagtcttacggggacgaagtcaaggtgtaggcagtgctgcattagttttggaggttccaggggaaaatcggtttccttatcttttccagtttctagaggtcacctgaatcctttggctcatggcccttcctccaacttcagagtgcatcacttcagactctgcttctcattccatctccttcttctgcctttgaattttttgcctccccattttaaggaactttgtgattacattagggcctacctggataatccaggataatcttcccatgtgaagatccttaattgcattaacaaaatcctttttgccatataagataatatattcatagcttctgggtattaggacttgagcatctttggggagccattgtctaccaccttgggccaaagcaatgtttgtgtttatttctagaattgagggttcctgttgtatgtgagtagtataaattagagcactatatttacttgtgctccaagtttacagttatatatgcttctcaggaaaatttcccctccttctacagtcatgcttcagcagcatgacaccatgcaccttgctgtctgaatatatattctctcatacctttatgccttttttatgctggtccccattgtacgtgaacaattctttctcctccttcaggacccatctaaaatactgctttctagtgatggcttatttgataatcccggtagtatcaatttttctctttgtgctttcaagtaccatgcatgtttttgtaatataacatttttcatactgtattattgtttatagatctgttggccctattagactcttaaagatgggggatcatgtcttatatgtctatatatcctcagtgcctaagagtgcctggaatataacaatccctcaataaacctttgataaatgaataaagtttaagaatatgtatatgtgccaagccactgtgctgttggtagtaatttacaattgcctagtacagttgcctagtataaaggaagcattgatcccttgctgatcatctgtagatttataaatttatggtagttcagatggaagtcatctgttgatgagaaagttgaggtgagcccagtgtcaaatggacagatcacagcaggactggtgccaaaactaagatcttcttgttcctattccagcattctttgaaatataccacactaactttgctgttgatgatttgtattactctaattacaatttatagacaaaatacatcatcaccttatatttttggatattcctcaattaagttctgcttttgaataggctagaagcatgcttctaagaaactgtagtcgtattctggcacttggtggggtggtggtggaatataaagccacaggataaacactggagcatctgcctggtatatacgttttattaaattgaaaacattaaagtttttatcggtctaagtttagacttacagaaaagttgtgaaattggtatagatagtttttgaatatatttaattttactttccctaatgctaatatcttatatatccatagtataattataaaaactcaggaattaatattggtagaatactattaactacagaccttatttgaatttcaccaatttttttctttcttttttttttttttaattatcctttaagttctagggtacatgtgcgcaacatgcaggtttgttacataggtatacatgtgccatgttggtttgctgcacccatcaactcatcatttacattaggtatttctcctaacactatccctcctccagccccccccacccccctacccccccacccctctacaggccccggtgtgtgatgttcccctccctgtgtccatgtgttctcattgttcaactcccacttatgagtgagaacatgcagtgtttggttttctgtccttataatagtttgctgagaatgatggtttccagcttcatccatgtccctgcaaaggaaatgaactcatcctttttatggctgcatagtattccatgttgtatatgtgccacattttctttatccagtctatcattgatggactttaaaattattattattgatggatttttaaaaaaatgttattctgttccaggatctggtccaggatactaccttgcatttagttgttaatagtctcagatcatcttccccatgatacactgtggtgttttcctatgctgatatttttcttgctcttgctatagaatcaaccacttacctctatgaaagaggtttacattaggtatttctacaagagccttgcctctatgtatttgagagtgatatttagaaaccaagatctgaaacactaaaaaccataaatctgtgttgatactttcaattaaatagaatacatttaagaatattatttaaaacatggatatacagtggaataagatgcaaaatataccagatttttttgttaggatgacccatgaaaattaaacattttgtgtttatataggacgactgtaagctctctcctggcttcccctagcataagctttcccttaagccatgagagctgctttgaaggaaatgttggaagccttgtgttagtgtacactttgtctgctctgagatggttggcacatagtaggtactcagtaaatactttctggatgtatgactcaatataatagtatatgactggtgggaccagaaacttacattgttccatgatcatggtcagaatttgtaaccctggccatcttgccagatgtatatcgttgaccatatgggagattcaataaataaattaaccctttcagttcaccatcacatctagaacaacagcagttagcacatatcctggcatcatcttgtcatatgaaggaccttccttacctttgttacttggcagagcaccatatgagggtagacacttcacaaatgctatttggtaatagggtagtgttgaagaaagcttactgttcatttctatgaggattagtatatgaaagttttcacagaactcgtttgatttgcttttcaccttttcaatttttaaagatttttccattcatggagaatgaatgctacttgatattttctttaatattttaaaacaatctaaactataaaaatagtacaataaggactatgttctgaaagggttggcaaactgtggcccacagtacagttgcttttgtgaataaagtttttcggaaaacagacatgtccattcatttttgtattgcctctgtctgcttttgttagacaatggcagtgttgactagttccaacagagaccatatggcttaaaatatttactatctcatcctttatggaaaatgtttgctgaccctccactagaaattttttttagcccatataaacgcatatattgtatatttaactgtacaatagctgtttattaagggaagacagcgaagtaaggatcagagaataattaaataatgattcatattttaaaatttattaaaatactacttttaaagtttattgcaaaataatacatgtatacaagatcatgaagacaacaataaaaagcatactgctatcactttttaaaatataggtgccatgaacatgtgtcatggcagttttttttattatactttaagttctagggtacatgtacacaacgtgcaggtttgatacatagggtatacatgtgccatgttggtgtgctgcccccatcaactcatcatttacattaggtatttctcctaatgctattcttcccccagccccccacctgccgacaggccccggtgtgtgatattcctcgccctgtgtccaagtgatctcattgttcagttcccacctatgagtgagaacatgtcatgtttggttttctgtccttgtgatagtttgctgagaatgatggtttccagcttcatctatgtccctacaaaggacatgaactcatccttttttatggctgcatagtattccatggtgtatatgtgccacattttcttaatccagtctgtcattgttggacatttgggtgggttccaagtctttgctattgtgaatagtgccacaataaacatacgtgtgcatgtgtctttatagtagcatgatttataatcctttgggtatatacccagtaatgggatggctgggtcaaatggtatttctagttctagatccctgaggaattgccacaccaacttccacaatggttgaactagtttatactcccatcaactgtgtaaaagcgttcctgtttctccacatcctctccagcttctgttgtttcctgactttttaatgattgccattctaactggtatgagttggtacctcattgtggttttgatttgtatttctcagatgaccagtgatgatgagcattttttcatgtatttattggctgcatagatgtcttcttttgagaagtgtctactaatatcctttgcccactttttgatggggttgtttttttcttgtaaatctgtttgagttctttgtagattctggatattagccctttgtcagatgggtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcttgaatggtattgcctaggttttcttttagggtttttatggttttaggtctaacatgtaagtctttaatccatcttgaattaatttttgtataaggcgtaaggaagggatccagtttcagctttctccatatggctatccagttttcccagcaccatttattaaatagggaatgctttccccatttcttgtttttgtcaggtttatcaaagatcagatagttgtagatatgtggcattatttctgagggctctgttctgttccattggtttatatctctgttttggtaccagtgccatgctgttttggttactgtagccttgtagtatagtttgaagtcaggtagcgtgatgcctccaggtttgttcttttggcttaggattgacttggcaaagtgggctcttttttggttccatatgaactttaaagtacttttttccaattctgtgaagaaagtcattggtagcttgatggggatggcattgaatctataaattaccttgggcagtatggccatttttatgatattgattattcctatccatgcgaatggaatgttcttccatttgtttgtgtcctcttttatttccttgagcagtggtttgttgttctctttgaagaggtctttcacatcccttgtaagttgtattcctaggtattttattctctttgtagcaattatgaatgggagttcactcatgatttggctctctgtctgttattggtgtataggaatgcttgtgatttttgcacattgattttgtatcctgagactttgctgaagttgcttatcagcttaaggagattttgggctgagaagatggggttttctaaatatacaatcacatcatctgcaaacagggacaatttgacttcttcttttcctaattaaataccctttatttctttcacttacctgattgccctgaccagaacatccagcactgtgttgaataggcatggtgagagagggcatctttgtcttgtgcctgttttcaaagggaatgcttccagtttgtgcccgttcagtatgacactggctgtgggtttgtcataaatagctcttattattttgagatcgttccatcaatacctagtttattgagagtttttagcatgaagggctgttaaattttgtcaaaggccttttctgcacctcttgagataatcatgtggtttttgtcgttggtcctgtttatatgctggattacatttattgatttgcgtatgttgaaccagccttgcatcccaggaatgaagccgacctgatcgtggtggataagctttttgatgtgctggtgtattcggtttcccagtattttattgaggattttttcatcgatgttcatcagggatattggtttaatattctcttttcttgttgtgtctctgccaggctttggtatcaggatgatgttggcctcacaaaatgagttagggaggattccatctttttctattgattggaatagtttcagaaggattgctaccagctcctctttgtacctctggtagaattcggctgtgaatccatctggtcctggacattttttggttggtagactattaattattgcctcaatttcagagcctgttattggtctattcagagattcaacttcttcccggtttagtcttgagagagtgtatgtgtcgaggaatttatccatttcttctagattttctaatttatttgcgtagaggtgtttatagtattctctgaaggtagtttgtatttctctgggattggtggtgatatcccctttatcagtttttattgcgtctatttgattcttctttcttcttctttattagtctttctagctctctatcaattttgttgatcttttcaaaaaaccagcccctggattcattgatttttttgaagggttttttgtggatctgtctctttcagttctgctctgatctcagttatttcttgccttctgctagctttcgaacatgtttgctcttgcttctctagttatttaaattgtgatgttagggtgtcaattttagatctttcctgctttctcttgtgggcatttagtgctataaatttccttctgcacactgctttgaatgtgtcccagagattctggtatgttgtgtctttgttctcattggtttcaaagaacatgtttgtttctgccttcattttgttatgtacccagtagtcattcaggagcaagttgttcagtttccatgtggttatgcagttttgagtgagtttttaaatcctgagtcctagtttgattgcactgtggtctgagagacagtttgttgtgatttctgttcttttacatttgctgaggagtgctttacttccaattatgtggtcaattttggaataagtgcgatgtgatgctgagaagaatgtatattctgttgactttgggtggagagttctttagatgtctattaggtctccttgatgcggagctgagttcaattcctggatatccttgttaaccttctgtctcgttgatctgtctaatgttgacagtggggtgttaaagtctcccattattattgtgtgggagtctaagtctctttgtaggtctctaaggacttgctttatacatctgggtcctcctgtgtttggtgcatatatatttaggatagttagctcttcttgttgaattgatccctttaccgttatgtaatggccttctttgtctcttttgatctttgttggttcaaagtctgttttatcagagactagaattgcaaaccctgcttttttttatgctttccatttacttggtagatcttcctccatccttttattttgagtctatgtgcgtctttgcctgtgagattggtcttctgaatacagcacactgatgggtcttgactctatccaatttgccagtctgtgtcttttaattggggcatttagcccatttacatttgaggttaatattgttatgtgtgaatttgatcctgtcattatgatgttcgctggttattttgcccgttaattgttgcagtttctttatagtatcgatggtctttacaatttggcatgtttttgcagtggctggtaccggttgtttctttccatgtttagtgcttctttcaggagctcttgtaaggcaggcctggtggtgacaaaatctctcagcatttgcttgtctgtaaaggattttatttctcctgcatttatgaaggttactttggctggatatgaaattctggtttgaaaattctttcgtttaagaatgttgaatattggcccccactctcttctggcttgtaaggtttgtgccgagagatccgctgttagtctgatgggcttccctttgtgggtaacttgacctttctctctggctgcccttaacattttttctttcatttcaaccttggtgaatctgacaattgtatgtcttggggtttttcttcttgaggattatctttgtggcattctctgtatttcctgaatttgaatgttggcctgtctttctaggttggggaagttctcctggataatatcctcaagagcgttttccaacttgtttccattctccccatcactttcagatacagcagtcaaacgtagatttggtcttttcacatagccccatatttcttggaggctttgttcgtttctttttactcttttttctctaaccttgtcttcttgctttattttattaatttgatcttcagtcactgataccctttcttccatttgatcaaatcggttattgaagcttgtgcatgcgtcatgaagttctcgtgtcatggtttgcagctccgtcaggtcatttaaggtcttctctacactgtttattctagttagccattcatctaacctgttttcaaggtttttagcttctttgcgatgggttcgaacatgctcctttagctgggagaagtttgttattaccgaccttctgaagcctacttctgtcaactcgtcaaaatcattctccgtccagctttgttccattgctggcgaggagctgcagtcctttggaggagaagaggcactgttatttttagaattttcagcttttctccctgctttctccccatctttgtggttttatctacctttggtcttagatgttggtgacctacagatggggttttggtgtaaatgtcctttttgttgatgttggtgctattcctttctgtttgtcagttttccttctaacagtcaggtcccttagctggaggtctgttggagtttgctggaggtccactccagaccctgtatgcctgggtatcaccagcggaggctgcacaacagcaattattgtagaacaacaaatattgctgcctggtctttcctctgtaaggtttgtcccagaggagcacctgcctatatgaggtgtctgtcggcccctactgggagatgtctcccagttaggctacacgggggtcagggacccacttaaggaggcagtctgttcgttctcagagctcaaaccccatgttgggagaacgactgctctcttcagagctgtcagacagggatgtttaagtctgcagaagttgtctgctgccttttgttcagctaagcccttcccacagagttggagtctagaggcagtaggccttgctgagttgtggtcagctccgcccagttcaagcttcctggccactttgtttacctactcatgcttcagcaatggcgacgcccctcccccagccaggctgcctcctcgcagttctcccttggttaggaaagggaaataccccgaccccttgtgcttcccaggtgatgcgacaccccgccctggttcagctctccctctgtgggctgcacccgctgtccaacccatcccagtgagatgaatcaggtacctcagttggaaatgcagaaatcacctgtcttctgcgttgatcacactgggagctgcagaccagaggtgttcctattcggccatcttggaacagttatggcatttttctatgttgtactacattagttagaatgaaagaataagaagctgtaaaaaaaaaagacccagacacaatggcttgaaaacaataactgaaaatattttgtggttaaaacaaatgtgaagagtccatgagcactctggttccttttatctcattttctttaccaccccctagggttttctttgttagcacagtctaaaacgggtcacaggtttgcccaggttccagctttcagagaggagatagagagtggatagacttttgttcttttaagtcctggacctggagtggcatatatcatctttgctcatagttcctggacaaaaactagtcataatccacatacagttttatggagttataaaactcatcgctagcttgattgccatatgtctatatccacctgtgggagatgggagattcggtagagaggtagtggtctttgcttgtaattgcatgcaattttcagagtccagggtgttgaccattacaccatggggctggcttaattgcatgcagttttcttacagaagatgtacttgttgttgttgtttttttaaacaacactttaacaacaacttttttttttgaaaaaattgtttttcaattgattgtaatgggctgtgatgtggctcggatatttgtcccctccaaatttcatgttgaaatgtaatccctagtttagtaggtggggcctggtgggagatgtttggatcatgggagtgcatccctcgtgaatgatttagcaccatccccttgatgataagttagttctcactcagttcacgtgagttctggttgtttaaaagtgtgtggcacctcccccttgttcttttgcttccactctcatcatgcatggtgcctgctttcccttcaccttctgccgtgattgttagcttcctaagaccctttccagaagcggatgttggcacctcactttttgtcctgtctgcagaaccttgagccaactaaacctcttttctttataaattacccagcctcagatatttctgtatagcaatgcaagaactccctaatactggcagtatagtatttttttttttttgcagatgaacatgtcatgatttatttagccatttctctactgttgcatattaagctgttcctgatttcttgttatgaacaaaatgtaaacattcatatatgcatgtcgtttctatttataactgtccaatatttaaaaaaggggcattgtcccacatctttatcacatttttgtgtttgtaaaatggacttatgatatttttcttatttatttgtatttttaaacaattgatacaccatagttgtatatatttttggggtatacgtgatattttcatacatgtatacaatgtgtaatgatcaagtcaagctaattgggaaatatatcatctaaacatttgtctttttgttggaaacattaaaattcttctcttttagctattttgaaatacataattattttaaactgtaatttccctactatgctatcaaataccagaacttattatatctacctgtatttttatacccatttaccaactttacttcatgccctctgctcccctttccttcccagcctctgttaactatcattctactctctaccaccatgacatccactgttttagctccgacatatgagtgagaacatgagatatttgtctttttgtgcttggcttatttcactaaacataatgacctccagttccacccatgttgctgaaaatgacaggacttaattctttttcaggctgaataatattccattgtgtatatatacaatatttctttatccatttaaccattaatgtacattaaagttgattccatatcttcgctgttgtgagtagtgctgcagttctttgatatactgatttcctctttttttttttttttttttttgaatatattcccagtagtgggattgctggatcatatgctagttgtacttgtagttttttgaggaccctccatactgttttccataatggctatactactttactgatctttttctttttctctaatttaaacaactgtcacaaagtcagtttgacttattgaacttgtataacttctgtgcctcaataaaactgaatgttacagtaaggaattaggtgaaatttactttttttttttttttttcaggaagacttacttagttaggtagctagtagaatagtaacctgaactcaagaaatgtaatttcatcctgataaaactgctgagtagggctatcttcctaattttcattaaatatttcttacttggaaacattgaatattaaatgagacaaaaactgtaagactaacagcaaacaaaaatacactttgacttttttatgtgcgtgtattacattcatgactttgtgaagatcatcttagtacttgtaatcttttgctattgtttgcatgtatattctattcaagtgatattggttgatgattctgaagtgccccgctataaatatcaagtacaacctctgttgatttataaacagtgtctgtcattatcaagagcagctaatcttattcaaaatagtcacttcattgttgtgttgccataaatttctgcagacatattttaaactaaagttaacttctgctatattgtaattgagggagctctatttttgtgtgccagctatctgtctcagtaaatgtaaaatctctagtttttttcagaggcctacaattgctgtaaatattaatgagctgcggacacgtgaaatttaaagaatagatgtgatttaaaagagcaatttgcaattcttaaatgtagagattggcatttactttaaactcgaagttgttaaatggcggtgtagtaagcacagaagtttatacttgaacaaaatctacttctaccaataattgttcatttacatgacctcaactgatccttttttctgatcatttatgtcatttggctttatatttttttcatatcagtcttcatgttctgttatatactaccttcatatatatgctaacaattcatttagattcagtttttcttagtcattattaaaaagagaatacttaatatttggggtctttaaatctcattatactaagtgtttggtgaatttatgtcatgggtccaaataattgtcataaatacagttgttgatttttaaatcttatataataaccatattatgcctaaaaggtgaaaacattggtatgttttaataatttcaccaagtaagcatattcatctaaatagtattatcttagattaagaattgatgatgtcattgttatatgtctgtcagtccctggactagatttctctttggcctgacaaatgaattttttttttctaggtaggagttgtgactatttaggaattgtgataaagaaaaatgaccaattatctttgtctctgtagttgttttttgtttattggtttgaaaaaaacctttttttctgtaattataaaaatatacatatgcttgtcataagaattcaagcaacgtatatatctatatattacaagcatatatgcatacatacatgtaagatatacatgtcatccttcccatataccactcccaatagaccatcaatatagattgtccccaacttctgatggtttaacttacagtttttcaactttatgatggtacagaagccatactcattcagtagaactcatatctcaaattttaaaatttgatcttgggcaaacagtatgcgataggatactctcctgtgatgctgggtagtgacagccagtcacagcttccaggcagccatgtgatcttgagggtaagtagctgatactctacagtgttgcctgatgattttgtccaactgtagtccaacgtaaggtatgcttacatgtttaaggtaggctaggctaagctatggtgttaggtaggctaagtatattaaatgcatttttgatttatgatatttttaacttattgtgggtacatcaggatgttatatcataagtcaaggcacatctgtatacatgaaaaatgaaaaatatgcgttatccttcccacataccactcccaagagactcattatcgttttttatgttctgtctgggggacttaagagagaaagtttcatgacagatgaaggagagtatgagtgaaaggatgaaatgaagtgaattgatgtagtgaaaatatgccataatagtatctcaccatcacctctgtgtatttactcattcttttcacatttgagaatattatttagtaatagtatgctgtagtactaatagtgaaagaacaataaaaaattaattttttttttacaaataaatatttgacaaaagctacaaaacgaaatgagaccatataggaatgtataaagaaaattcatcccaatagatttcttgggagctgtagagctatggccaacagtcatttcaaagtgtagcttgaaatctctattgtgctactgaagattatcaggattttttgtagcttcttcacttttttttttagacggagtctcgctctatggcccaagctggagtgcagtgacgccatctcagctcactgcaacctctgtctcttgggttcaagcaattctcctgcctcagcctccccagtagctaggattacaagcatgtgccaccacgcctggctaaaatttgtatttttagtacagacgggatttcaccatgttggccagcctggtctcaaactcctgatctcaagtgatttacccattggccaaagtgctgggattacaggtgtgagccaccgccaccgcccccagccagcttcttcacttttaagggagagttagaatttcctccttcagggctttgtaaggtagggtaggtagtagtggtggggaaagtggagtaggggctttttgtgctcactttttcttcagcattgacttgacattgtattggcatccgttttcctacatgtcattgttggctatgttgtggcactcaagtgggataccctaaaacttgtcaataattgtcacttctcaagaaatatagaaattataatataattagaaagcagttgtaaaactgattgaggttatgttcttttctagttcctgggtatcgaggtgaacaataaaacagactatgacccctgcccttggaccctagggggtatagacattaaacatgctcaaattttatattataaactgtactatgaaaggcaaaaggggagtactactaaagaataataggggcatcatttagatttggtggtaggaggttggagtgaattggagtggccgcaatgcaataatcccttattgacttctcactgtggatatgacactctgaaaatgtttgaaatacaaatgaaagaaaatgacagaggcaagtcttaatcatattaggtttatttgccaacattaaggacatgtgcctgggaggcaggtctgtgcctttctccaaagatgcttttgagggcttcagtatttgaaagggaaagggcagatgttgagggaagaaaaatctttaaaaactgtgttgatagataaaaagacaaaagggttgcatccttttgaatctttgatcagccttcactgaatacacaattttcatatgagtctgggtagatagaggaaatagccactcataccttcatctggctcagtgaatctgcatttttacataagatagtgtagacaatagggtggaggaagcaatcagatactcatttgtcttaggtgagcagaagggtgactttgagttctctttcctttgtccagcacctgtgaagataagctatatatataaggaatttccttgtgggcaaattgtgagggaggtatgttgctttttatcttcatagccatcttatttagcaaccaaatgagaagcagatctgcatgacccagttcccagcttgacttttcccttgggcttagtgagtttggggtcccaagatttattttcctttcacagggagccagcattattttcctccgtaatccttttatagaaatagttgattttttagtagagccggatttttgtggcttgaaaaagctctacctcatggacttatttcagaaattgcatctatattcgtcaagtcaattttatgctattttttctgccttggaaattaactgtacatatgtagaattgggtgagaaatttagttgtgatgctctgcttcagtaatgaaaggacaaaaatactttgtatagatgctcaattattatttgctcttaagaaaacaatattgattcaacagctattcatgtgaggtttctttttagtggcttgtttggaaattaaggttggttagtttatattttctttacagcaaaagtaaaataaaatggctctttctcttctaccaaaataatcatatatatgtgaataaggtaactcagagataagtattttaaaggttttagattcaagactaccataaagggataggagaataaagtaaacgtaacttcacttagaagaaattgtctctttagataaataaaacagtgcaaccctgtaagagtgagaaaaatgaacaagtatcaaagaatcagtgttaccctagttttctcctttcctttttcccccatgttgaagacagattttatgatgtctgtggaactaatttatgaatgaaagtgattgtcatttgttcaaactaatctagtattcaagatgtaagctgttgaagccaacatgtaataatagctaccatttactgaacagttacttggtgctctactaggtattttacaagtgttttaacatttaattattacatttctctaaaataagtatgatttccctccttttgcagatgaggaaacaaactcagagaattgaaataacttgtccaatgtcacatgcgtattaagggaaagaaccaggttttaaatctaggtccatttgacaacaaagcttgtgctcttttctctaagataagctgtagggttggaaaagacacaaatactgggtttgatggtcaggagatctggttcaagttatgactctcactgattagttatgtgacttgtcttgttttcctcaactgtgaaatgggtctagtgcaaaacctcatttgaagagtcactgtgagggtccagcgagttacctgtaaaaagttgaagtgtggctgccaaggcctgataataaaatgtagcaggttccacaaaaactttttttttttttttttttttttttttaagtaataaggaatgttttcaccctttactttggagggcagaatgggaaaaatatttaaaagtaatttatgtatttgtatggtcttaaaccaaatgtcattatatttttaggtcactgaaatccgtattgacatttgcaaatttcaggagcttcatttgcaaatgatattatagtttttacatgaggagagaatttttttcccatagagctcaaacagaggctagattgagacagctcttaatgtagaaattgtgaaacatcagcttctctctacatactactttgacttgtttattcagtggatttgaattaggacagcttttatatgactagaaaaatacaagcaaagataattgaaatgtactgcttctacatacaactctcttctccccttgagcaatttctttactatccttcctctttcaaaaataaagagaaagctttttctcttatatttttcctccttatttttttgtttggttttagttttattgttttgttggcttgctttgactttgaaatggcaactatccctacaaccattgggtgggggtggtagttgaagaatgtcagtcagtttcacagctgaaagtgtgctctgcagcaataaagctttaagcttttttctgacattctaattttgctatttttcctattaatgaaaatagagtttaattttcccttccaagacaaaggaagggttaaatttaaggaaccatgaatattctgaagtagaggatagggagaaaggaagagggaatcagcagtccttaaccctttgatctgtcatttctgtcctctcatctgtgtccccattcttgtttctgtttgtcttcttccttcccagggttgtcagtgaatgtagcaatgcctgactggcactggactgtgttaattgcttgcagaagtgtgctggctgtgggtacgttcttctgtgttcacattttgcaaggagcggaggatggtgatgatgctgttgataacttactatgtgctaggcattgcttcaaatactttcatttctatgttacaggtaaagaaaatgagttttagagtaacttctgtaaaattactgactgaggtcatgctgctagtaaaaggcacaactacaatttgaatccagatttgtctggtgccaaaggcttgattaatatcattgcattaatcgtaataattcccttagttaactataattattatgcattaaggattcagagatgactaagctactgtccttgcccttaagttgctctcagtctagtcacaggaagcattcatgtaatctgattataagacagcatgacaaaactctaatggaagtatgtgcaaagctgtggaagcacagggatcggttctttttgaagagttgaaggcttcacagaagagatgatactgaatttgagtagttctgtctttttttactagttccatcattagttttatggtggaatagcatttggggcataggcaatagcactaataaaagcagagagatatgcaggcccttggctcactcaaacaatgttgagtgtgcagttgtggctgatgcatggcagagaaaggcaatgtccagagataagactggggagttaggttggcactaagttttgaagggtcttatagcaatgctaagaattttggactctactatagaaacattagtgagccattaaacatctttaagccaggaatggcataatactgtttgccaacacctgatcacaatggcagtagtgtgaagattgaattggaaggggaagaaactacaggcagggaaacctttgataagactaatgcaatagatagataagagggagtgagggcctgaaataatgcagcagtggtagggatagcaaggatagaaggggcttaagaaattaactagaatggatatgtgaggaaggaatgatgaatgagtttaagattttttttttctcaggataggaggctgtaaggatggtgttgccatttattgagatagggaaactgaatggatgaccaaattgggggtgtgggacagataataaatttgtcttttggacatgtagagattaaagtacatctgggacttttagtgaaaggaggtgtccaataagctcatgagtcatgatctgtgttttcaaccaactagaagtagatttgagtctggagctcaccagaggggcccagattggagataccaattagtgagtcatcaacagagaagtgataattgaatcagtgaaaacagatgagatcacagagggaaacaaaaattgagggcaacctttgtgtattatttgttcatctacctgccttggttgtctataaacggatttgaatgggtggactaatgtggaatgagtaataactcaaacacaggaaaatctctctccagccctaatgactgcgaacacgatctggtatttctttctggcaggctgatctgattgccaaagcaacttcttgtagattcatagggctctcttaaaaccaagtaacatttcaaaacaacatgttgtacgtgagaaatatatatacactttttgcttgtcaattaataaaagcaaataagatcctggtcttcctctctgacattagaattgcttctgcataccttgtcatagaggcccactttccttggtcttggaatgaggagatggtgaaaggagctcagctttcttgtgtagcaagtatgtggaacttacagtaaatgagaatttgtgtagggagtaagtccagtatattttctagcctattctattatttgtcaccagggagatgtcatgactctttgtagtacttcaaccaaatttaaatgaaatagagcctcttttaatgtccatagtatattgtactcaataatatctggcaaatcaatactagtagacatgccagactattattttcctattcttatcatatgtgtgaagatatttgtgcacattaaatgtgagataagcaataaaattggttgtattttaggtcctagaaatgaatagtttccccagctctgacattagagtaatcatagccatggaattattatccagatgaattggggtaacaaaataaaaactagatttcattccatctgctgtttgtgaatagatgccactgtctttacttatagtatgtcagattccaggatttgtattatatgcttatgtttataatttaaatattctaatcttgtaaattataggagacagtgtatttagtggaaagagcagaggctttggtgcctgattgtccctggtcttaaatctgggttttgccatttcctagctgagagagttagacaatattcagcttcacagttgttgttgttttctccctaattgtaaaacggggataattgtagcaccagtctctggattcttgtgagaatagtgaatataaaatgccaaactcaacgtatttagtaacctatttttgttgttctacttaacatggattaagccagcgtttctcaacagatgctctattaagccctaatcctttaatatactttaaaaaaaaaaaacatgtttgttggttaactgaatttgagaaattctgcctactgctataattccctcttggagagctataacagacattaacatatttaatcgtgctgagaagccatcatataaacaaatctttttttgttggtgttgtttaaatttttcaacctagcattttccaagtttattttgtcactgtgcattgttttttcttgggagacctattaataatagctcattttgatggggtacattttagaaaaggttaatttagtaatcaggaccaggcactactcaattaagtgtttgacttcattgaaccacagctaccaatatatcttgtggactaaatggtgctagccagcttaaaagtttgggaatttgtaggttgtaatggacaggattagagttcaggagaactgagtttcaattgcagttctgcaaattgtaactgtgtggccctgactagtgactaaactctacacagacaagtcatagtgtcctcatctatgaaataacaccctttctatctgcctcacaagattgccagaagaatctatgagagaatagttgtaaaaacaagttgggaaattaaaactgctgtcaatggaagatggtattactactactctaggaaaaggaattgtaagagcagtgaatgaatactaggacagtctgaggttgagctatgctgctcttgttcccatcgagcaaccttggatcccattagctacctgcctgaaaacattttcaactcctaatttcttaataattagaatggttcccagatgaatatgcttgaatgtcagtagcttcatcttttgttactgttcttggacttgcttacagaagccatttcacaatacaatatgtagtttagtagcatttagctatgcctgctgctgaatattcaacactgaattgtaattatgatgcacaatggaaaagaagattgttaggatttaattaataagctccagttaatgggtttaatgctcagccttctcatatagttcaactttctttgagtctacctgtagtattgcttttctgttaagagatgttaagcaaactgatattgctttaacattaaacaccatatgaaggatgagaaagatcttgatttagtttcagtactatttttttctattatcttcttgattagtgttaagagagggttgtataacttatttccttattgtttctggaaaaccttaggtggcactctgaataagctatgcgaagctttcaaaagattacaaccatgttttctacaatttttttaaaacttttatgtctgcaggtacatgtgaaggtttgttacataggtaaactcgtgtgatgggggttcgttgtactcattatctcagcaaccaggtattaagcgcagtatccaaaagttatattttctgcttctcttcctcctctcaccctcaagtagactccagtgtttgctcttgccttctttgtgttcataagttctcatgatttagctcccacttataagtgaaaacacttggtatttggttttctgttcctgcgttagtttgctaaggataataacctccagctccatctgtgttcccacaaaagacacaatcttgttcttttttatggctgcatagtattccatggtgtatatgcaccacattttctttatccagtccgtcattgatgcacatttaagttgattctatgtcttagctattgggaatagtgctacagtgaacatttgcatgcatgtgtctttatggtagaattatttatattcctttgggtatatacccactactgggattgctggattggatggtagctctgcttttagctctttgaagaattgccataatgctttccacagtggttaaatttacacttccaccaacagtgtacaagtgttcccttttctctgcaaccttgccagcatctgttattttttcactttttagtaatggccattttgactagtgtgagatggtatctcattgtggttttgattttcatttctctaatgattagtaatattgagttttttttccatatgctattgactacatgtatgttttcttttgaaaagtgttcatgtactttgtccactttttaatgggattgtttttctcttgtaaatttgttgaagttctttttagatgttggatattagacccttgtcagatgcatggtttgcaaaaattttctcccattctgtaggttgtgtgtttactctgttgacagtttcttttgctgtgcagaaactctgaagtttaattagattccacttgtcaatttttgcttttgttgtgattgcttttggtatctttgttatgaaatctttgcccattcctatgtccaggatggtattgcctaggtagtcttccaacaatttaatagttttgggttttgcatttaagtctttaatccatcttgagttgatttttgtatatggtgtaaggaagggctccagatacagtcttctacatatggctagcctgttatcccagcaccatttattgaatagggagtcttttccccattgcttctttttgtcagctttgtcgaagatcaggtggtcataggtgggcaaccttatttctgggctctctattcagttccattggtctatgtacctggttttgtaccagtaccatactgttttggtcactgtagccttgtagtatagtttgaaatctggtaacgtgatgcctccagctttgttctttttgcttaggattgccttggctatttgggtattttttggttacatataaattttaaagtagtcttttctagttctgtaaacagtgttgttggtagtttgatagggattgcatttaatctgtaaatcgctttgggcagtatggccattttaataattttgattcttcctattcatgagcatgggatgtttttacattttatttgtgtcttttgatttctctgagcagtggtttctaattcttattgtagagaacttttacttccctggttagctgtattcctaggtgttttattctttttgtggtaattgtgaatgagattggctttctgatttggctcttagcttgcctattatcaatgcatgggaatggtagggatttttgaacattggttttgtatcctgaaactttgctgaagttgtttatcagctgaaggagcttttgggcccagactggggttttctagatatagaatcatgtagtctgcaaaccaagacggtttgacttcctctttttcttttggatgcccattatctctttctcttgcctaattgatctggctaggacttccaatactacgttgaataggagtggtgagagagggcattcttgtcttgtgccagttttcaaggtgaatcctagctttagcccattcagcatgatgttgtctgtgggtttgtcatagattgttcttattattttgagatgtattcctttaatacttagtgtgctgagagtttttaacatgaatgagtgttgaattttatcaaaagtctttcctgcatctattgagataaacatggtttttgtcttcagttctgtttatgtgatgaatcacatttattgatttatgtatgttgaagtaaccttgcatcccggggatgaagccttcttgatcgtggtgaattagccttttgatttgctgctggattccgtttgcaagtattttgttgaggatttttgcatcaatattcaatcaaggatactggcccgaagttttctttttctgttatatccctgcgaggtttttgtttcaggatgatgctggcctcatagaatgagttggggaggagtccctcatttttttggaatagtttcagtaggaatggtaccagctcttcttttgtgcatctggtagaattcggctgtgaatccatctggtcctgggcctttttggttgataggctatttatttctgattccatttcaaagcttgttattggtctgttcagagaatcagtttattcctagttcagtcttgggagggtgtatgtgtccaggaatttatccatttcttttatgttttctagtttgtatgcatagtggtgttaatagtagcttctgatggttatttatattcctgtggggtcagtggcaacattcccttcgtcatttgtaattgtgtttatttgtgtcttctttcttctcttctttaagtctagctaacatcctatctatcttattaattttttcaaaaagccaactcctggattcatggatgttttgaatagtttttcctgtcttcattgacattcttggttgcaaatctttttctttaagaatgttgaatatgggttcccaatcttttgttgcttgggtggtttcagctgagaggaccacttttagcctgatggggtgccctttctctctagctgcccttaatgttgtttctttcattttgcccttggaacatctgaagattatgtgttttggggatgatcttcttgtgtagaatcttgcaggggttttatgtattttctgtatttgactgttggcctctctagccaggttgggaaaattatcatggaagatatcctgaaatatgttttccaagttgtttgcttttcccctgtctctttcagggatgccagtgatttatagattttgcctgtttacagaatcccatacctctcagtcatattgtttatatctttttattcttttttatttttgtctgtcttattttagagaaccagtttgcaagttctgagattcttccctcaggttggtttattctgctgttaatacttgtgattgcattgtgatatccttgtattgtgttattccactttgtcagatttgttagttttttttttttccagctgtttcatccttcagctcttgtattattttattgtgattcttagcttctttgggttgggtttctccatcctcctgaatctcaaagattttcatttctttccatattctgaattgcatttctgtcatttcaggcggcttagcctggtcaagaactcttgttggagaactggtgtggttgtttgaaggacatacaacactggccatttgagttacccgagttcgtgcattgattctttcccatatctgcctgtgggtattcctttaactaaagtgtagagtgagtacagtcagtagacttcttttctggttattttcacaggaccgaggcttcgtacagggtctttattggaagctgacttcttgtctttggtttaagagaggtacgtatgttagtgagtatttttggtcttgaagctttggcgtgtcatccagtaggtggcatttaagtgtactggttagttgatagattcttgcttggttgtgtgcctccgctatgtttcctcacagttgcagccatgttccctatcaatgctctgaaagtgtgggttcctctcccctttgagtgctggctgtagaccatagcttggtgctcctgggctgcccactgaaactctggggtgatctcagcatttatgttttttccacaacttggaggcagcagagtaacggaccttagtagtgattttggccaagggtcttttacttgtatcctgggggctccaccccagagagatgcaggtcagcagttgctcagtgagagcagtccaggattcaggatctgtgctctgggcccaacctgggtgttctctagtggcgagcagtcgggggtgggtgtgacctatgggaaatggactgacccctttttctgttgactacagttagttggaggtttgggtaaggcacttagggtctttgcttcttcgttagtccaagggtagcaagggaagtctgctgcagaggcagtggcagagaggctttcagttgctcctgggggctctgtccagggagttgccgagctgctactggcttaaatagctctggtgagggtagctggtgacccaggactggaggacctgcctggtgtggagttatgggaacaggctcccatgtaacagtctggctgcttttctgtagggctgctatggtatactgggtgcctgctccagttgctaatgaccttggattttccagtacctcaaagtatcaacatagaaggttgtgaagcagcaaagatgatggcctgcccctccctctgggagatccatccgaggaagatgtggacttgttgccagccttaaggcacctgtagaatatggctggagactttggttgggaggtcctgcctcatgaggaggaatgggattgaggttccacttaagaaatgctgtctggccatctttttgtagagtagctgtgatgtgctggtggaccgcttccgtccctggttggcttggactctccgaagcctgaaggctggaatggctatgtcatccaaagagcaaagatggtggcccacccctccctctgggagcttccttccagggaggtttcaaatctcttttggccagagaacactggcaggggctgctggtcccagttgggacatcccacccagtgaggaggaatggaatcggggaccacttataaaagcagtctggtcacgtttttgtagagccgctgtgctgggcttgggggactgggtctgacctgcgatggcttggagtctccaaagtccaaaggctggaaagactaagttgctcaaatagcaaaaatggcagcccacctctcccgctgggagctctgtctcagagaggtgtgcaatgcggctccctttggctggctagacttccaagccagtggttcttatcctgtgaggtgccatggaagtggggcctgcagattgttgctgcccagtcctctgaattcagcccctttcctaggggtatgtatgggggtctaacctcccacttctttggagtcgcagcttctttagccaggttgcctggaaagtcacagtcaagtcctgaccccactcccagtcttgtgatatttttcatcatagattaactttttccataattttatataaatggtatcatatagtatgtactctttggccaaggctttcactcagcataatgcttttgagatgcatttatgttgtatatagcaggtgattattcctttctattggtgaatagtatcccattttatggatatacgacagtttgtttattcattctcctgttgatggatacttggattattatcagtttggggctattaataaagctgctgtggaaagacttgtacaagtatttttgtcagtatatgcttttctcatgtgtaatttcctagaaattgaaattactcgatcataaggtgggtatatatttatttattaaaaaactaccagatattagaaagtgcttgtaccattttgtatgttcaccaaaatatatgagcattctggccatccacatcaataccaggtattgacaatctttttaattattttggtggctacgtactggtatctcatatgctcatttgtaatgctattataatatgcacttacctaatgatattgcgtactttttcatgtgctcattaaccatgttcttttgtgaagtgtctcttcaaaccctttgcccatttttaccttttaatatctgtcttattaagttgaaagagttctttatatattctggataacaagttttatttttattttttattttttatttttttttgagacagagttttgctcttgtcacccaggctggagtgcagtggcacgatctcggttcactgcagcctctgcctcctgggttcaagcaattcttctacctcagcctcctgagtagctgggactacaggtgtgtgccactacgcccggctaatttttttctgtttagtagagacggggtttcaccattttggccagtctagtctcgacctcctcacctcaggtgatccgcccacctcggcctcccaaagtgctaggattacaggcatgaaccaccgtgcccgatcaataccaagcctttattagatatgttttgtgaatatttgtgtctggcccattcatttattaaaataatttattttttagggaagtttttcattttgaggaaacctaatttatcaatagttttaattgctttttgtgtccgaagaaacttttgtctgtccccaatgttagatttttgatatatatttattacttatatattggtatatccattcaaataaattttactttgatcttgaagctttcacccattagccagtgctgctcacttaagactttatgttgattgcaaataaatctaaatatctcaacaaataaatatagtgtcagtagtttcaggtttttttcccctccttcaaaacctaggatattttctagttttgttgagtattatatttggaggatgggaagagatagcagaattgtattcttctcaggcaaaagggatggaagtataaattgctatgggaaaacctcaaattctaacattcctctgtcttctctatacctgccatcacccaccttctccttcctttcactgttctctctgatgcaaggggtcactgcttgtaggtttcctgattccaacattttggtaaagggtgaccatctagaattgctactatagctgaaattctagctaaattttaaagaccattggagattctggacagtgcatgaatttacattatttccgaagagaccatcagatgtaagtacgatatgatctatattaataaagctactttcacaggcattttatttaacccttttctctgttagagaaaagcagtatttgtttggtaaaatgcttgagcctaaaatctgcttacttttcagacctgtgttgacagttgatttaggaaacatgaatcagaattgggagatgatctccagtagcattatggaagagttattttatattttatttcatttcattattttattttatgatagggtcttgctattttgcacaggctggtattgaacttctgggctcaaggactcctctctcttcagcctcccaagtagctgggattacaggtgtgtgccactgtgcctggctggaagagtaattttagatatcacattataggttttattttttgtttaattgtttaaaaacctttcatggatttttattttattagagaaacagagaagcaaaaatgaaaatggaaacaaaaccaagaatccctcccaaccagaaccagaatgggtgttgtaggtgggatcaagtgtacttgggggctcatcatacagagtcagtaagtgcaaatcgttttacaaggatccggagccccaatatgcagtgaagaattaaagagttctggttgcaaaaaatccccacttaatgatctaatgtctacaaggtttacctgacctatttaggagacctctgggttgtccaaaacagcgatcttcacaggactgagtaatgaagaataatagctcacccggttattagtgatagttttgtttctattatacttattgcaaatatcttgatgtgatgtgaataactgtttcccagtatctccttttatttttggccctaaaggctaagaatagcacagggtcttccactttatctagagtagccaattgtgtgtctgtgtgtatgtgtatgttttgtgttggagatgggtttggtggtggtggtggtggaggtggcggaggtggtggtggaggaggaggagatttaagtacttacagaaaacttagcagtttttcagtagctttctttgagatctatcaaggttttcttccttgccacatttgttaacccaagagtcatatatattcatgttacctgctaaatgcccatgtcaggcggttcacataatcagtggagaaagctttaagggagccaaagatgttttttaactccttatgtgatgaaacatttcttttgggatctgagaggcctacttttagcctaccacttccacttatgtgagccttccaattatgtgtacttttgaactcttgaggcagtaatattaaaaagtgaagtaagtttaagggttaaagatggtttgttgatgaagatcagtgaattgatttttataccattttctttacttttttttttttttttaattgttacagaagaagctactatggaggaaactgggccagttttagcttttcaggactattgtcctggctaaaggaataccaggtaaagtttgtatctgaccttttaatttgctttgttttattgtatgttacatagtaaccctgcactgaagaaaaccctaagcttcacctgtaacacaggattgattctttatttttattcacttattttacaaaaaatatgtaaagtcacctttttagctaatattttcccaatgtctttatccctttttaaatataaatagagctcgggtgcgatggctcatgcctgtaattccagcgctttgggaggccaaggtgggcggatcacctgatgtcaggagttcgagaccagcctggccaacatggcgaaatcccatttctactaaaaatacaaaaattagctgggcatggtggcacgtgcctgtagtcccagctactcaggaggctgaggcaggagaatcacttgaacctgggaggtggaggttgcagtgagccgagactgcacctttgcactccagcctgggcaacagagtgagactctgtctcaaaaaaaaaaaaaaaaaatatgtgtgtctatatatatatagaaatagaaatagaaatgttggttgaagagtaaactgtttgtacttaataactatttcctaattatttatgtgcccaaatataagatgataattttttccccaaaatcatctttagaaaaaatatcctagtccttataaaatctcacatttactggttgctcttagagtcagtatattttgaacaaaaaccttttttgaaaaaaaagaaaaaacctaacaatttggggaatatacattaatttgaaatgatctcagtggtgattttgtattttatagaggtcacctgacacaatcagccaaaagaaaaaatcaaagaaatttagtatgaattaagtaattttttttctaagagtaggatctcaatactaagctgttgaataccattataaagaaactgtttagggatcacgtatagcataatatggagagtcagttatggagcttgccaacttttataagacagatttaaaaaaatctgtcctactcttatgcagattggtacatgtggcttgaaatgaaatttctgctgagagcatcatacagaagatcagaaactgctgtatcgcaaaagaatttagatgtttggaaaggaggatgatgtagtccagaaaattgtattcagttagctaagacttgttaagcatttatcatgtgccaagcaccattgcattgattgattgatttaatcaatgtacatgacttaatcagtatacatgactcaaaaagtgcctctcatgatgacaaagacactgatattgaagatgcagtgaaaattcagtttgaatattgttgcatgaaatgagtatagagaaacaagcagtatttgtaaagtagcatttcatataataattcaaactgtgtaagtcaagagagtaaataagtagatatttaactgtttagtctgtgcttaaatattcatgtatttactttgatcagaaactcttttttgcacctcatttttgggaagtgtatgtgagggtcaccttatatttaggcatatttagtacttccatgagaaaatgtagtgtagattctcaaaacaacaataacaaaatataccccaatagtctgaatggaaattaaaaaaaatacatttggtaatgtttattatttattcaaataaaaatgtttttcttgaagtttagtttattttaatgattgttttactccagaatcttgaccctgccactgtctttgtctctccattccctttccctggtccacagttcttttcttaggctggtaacctcatgtctacacattcaaaaatcttgtatttcaccttctcttctacttatgtttggatgtttagtactatctaatattatacttgataataagagctgtatgtcactacttttcttcagtttaaaatgttaaactcaggacaacaaagccttttaaaaatatttattgcctttatgacatttgtaagtttaaaagttttctgagatgaatttacttaaaagatattgtaattctattttcctactagttccttcagtatgtataatacagtttcaaaaagttttctctgagaaagatgtgtattaaacagcttaaaattttaaacagattaaaaattgatccttgacatttgaaaaaggtatatcttgacaccttcaaaaatactgtgtattcaaatactccataaaatataattaggaattactgaacattttaacggaccactttcaacccttagtgagagtttacatgctttagtacacattcttgttttttattgtctttcttgttttttaaggtattcagggactaattattataaagcccttagttatactgggctgaatatttttcagaagtacttttatatgtaatcaaaatttgatatgactagcgaccaaccttcaaagatctgaaaataaatagaacgaagttattttgactctgctgttttgaccaaaaaatgttaaaaaaaaggccctgtttttattaataagtaatgtatataacagatatacttgattctcagcagatagagggttagttgtcctagttcttaagcaatgtccaaacagccatgtccgaatgactttttcaaaatttcatataccctgacagaaatctgtaaatcagatctagtttttgatagtacagattttacacattgtttttctccccttcctttgaagttgaaacacttgttggactttctttggtgactctgaggtgatatcctttgagttttggtaagatgaaataagcatgaatttagacaagaggtaaattttctcagaaaattgcatgtttcacactgcccactttgattaaaacttcttatctgtgttttgtttaggaaaacagtgacattgtaagtgacagtccagtgtggcaagaccagatccttgaaaatgaagaagccattgctcttagcaggaaggacaaaactattcaacatgtggaagtattttgttatgccaggtatgaaaagtatttactgcaggtaaactaaattaatgactttttcactcttctttagaagaagccaacaataaagatttatgtggcattggttgctacaagtcacgttaatatgctggttttgcctgtttttaaatggaactttcagttgtctctgtttaggtaataatgataacattttaccttaacgcctccgaatttaccaagccgttttaaatatattatctcatttgatcattaaaacaattctttgctagggtagggcagatagtagtattaatagttggattttttttacagaatcctcaatggaacttaaggagattaagtagttgcagaaggtcacgtggcttggtaaacggcagggccacacttaagctccagagtggtagagctcaagattaaattccagagtttttcctagtgctccagtgttcttccaactatatcatctttcttagataatactcagtgtagcaaaatggaagattatcatttttgaatacgtaaattttgtgggcataatatttgggtacatattttggtaaattaggatagaacagttggaagtaatgttttaagtatctccctctgagtgagagattcactgtttaaaaacaattggattagtatactttttcaaatgatatatgattgacagattaaaaggtaataatcacatagttaagccattcaagtagttatagagtccagaggcttagaacatcagtctgtcaggcactttaatagtaattaaaacttaaaattcaatacaccagagattcttcaggatacgctttgtcatcttacatatcattgttgtggcagagtgttaagcatgagcctgtgaaaagtttggtaacatgtgcttgacttcttaacctatgttcatatcttcatgtaagtagcattctttccccataatatactgtttgtgttctgtgattttctgtaaaagcacagcctttgaaatgtctggtatagattataatttgtataatgctaaataccatttggtatgaaaaggtacagctgactagatattcttcagagccagtgctgaaagatttaaaacggaagatgatttcaactgaaaagacatatgctttaacgaaatgaggaataaatatttggtaactttcttacgtgcttttgtgtgcccatgaatattatattacttgactacaatatagtgacagtcacactggccttctgagaggtattatacttttgttacttcaaggccactgattactttttatgataattgaggttaatagtttctaatggctgagttgatacattttgagtgcaaagaaaattatctcattttcagttcctgatctcttcagtttcgtttgtataacttctcaaagtgagaaactaaatggttgttggtggaaggtttgtttgaagacaacgaaatagaactctgttatatgttcctcttgccagttagagcgtggagcataaagtgaactgggataatgttttatatgtcttaattcacttggaaaagttagctggttattaatgtcatagtagtaagcaggaaaagccttgagaacatcaggaaagtagagaaagtacagaaaatccatttgtaagggctatctatagtaagtgctggcaacatgggtaaataggactaacaatatctcacttagccccagcaagactggcatccttaatcttttggatcatgttcacaaacttgaaattatatgaaaggggctagggccaaaatagttgtcacaaagttttacattatacaggaggttatcatcagcactcactgacttaaaagccttatttatttaatacatatttctgacaacctcattttctttctgtgtgtgtgtgtgtgtgtgtgtgtgtgtgtgtgtgttgtgtgtgttttccccctagcattgtagtttaaagcagcaaataggaaaggggtatctgctagaggcaagcaaactgagaaccacatggagactagggttatagtccttgacttgctatgtgatactgagcaagggatgtctctattttgagtctatgttttgccattaatgaaacgtgtttggaagggtttggactaggcgatctcagaagtctctctgggctctaacatgctactatttttttttttttgagacggagtctcactctgctacccaagctggagtgcagtggtgcgtggtctctgctcactgcaagctccgcctcccaggttcatgccattctcctgcctcagcctcccgagtagctgggactgcaggcgcctgccaccacacccggctaattttttgtatttttagtagagacagggtttcaccgtgttaggcaggatggtctcgatctcctgacctcgtgatccacctgcctcggcctcccaaagtgctgggattacaggcgtgagccactgcgcccggctctaacatgctactattttaagtgctgcttggtagaataataaaggagaagacagcatcggcaagctgaaagcagactttgggccatttagtgtatgggtaagtggcttttcatatcagaagatccctcaaggccgtcactatattatagtacagtgtaacagctgatgatcacagttgtattccagtgtcttcaggcaaaagttaaataatgttctttatcctccacttgaaaaagtagaggatttgaagtacgttttagaaagatgagtattaaaaatgattagaataaaaattgtacccttttaagagacgaggttttgttatctagaaaattctcttatttcctcttgagtaagtaagagtatcactatatagtagatctttaacattcttaaaggatacattgcaaaatcttcatgcatacccttttgtaaataatgaaaaatatggtacaggtttctggctttttgtcgttgctttttgaaacatatgtgttagtgatgctaatgttacattttgcagatatggagtttgtgtgtatttagttccatacaattttatcacatttgtgggttcatgtattcactgtcacagtcaagttacagagcagaacagttctatcaccacaaggacccctactattatttttctgtaagcacatctgatctacttcttactcacccctaccattcataactcctgacaatcactaatctgttttccagctctataatcttgtcattttaagaatattatgtaaatggaactgtatagtatgtaatgttttggcatgggcttttttttactcagcataattccctggagattcatccaggttgttgtgtacatcagtagtttgttcatttttcatcactgaatagtattccacagtaatgggtttaccacagtttgtttaatcattcacccattgagaaacatcttactgtttctagtttttgctattacaaataaagctgttatgcaattttgtgcattggttttcatgtgactttctctgggataaaagttttcatttctctgggataaatacccaagtgtataattgctgggtcatatggtaattgcatatttagttttaaaagaaactgcagagctgtttcagaggagctgtactattttacattcccaccagaaatgtgtaagtaatccaatttctccacatacttaccttaatttggtgttgtcactttcttattttagccattttgatggctcattttgaatattttttcatgttctcttatttgccatccatataccatttttggtgaagtgtctgttcatgtcttttgcttgtttttaaaattggagtagttttttactgttgagttttcagagttaaaaaaaatccattctaaatatgtgtcctttgtcagatatgtggttggagaatattttccccatgactctagcttgtcttttcatcctctttaaataggatattttgcagagcaaatatttttaatcttgatgaggtctaatttatcaattattattattttgattattttgattattttggtgtgaagtctaagaactttttgcctacctataggtatagattttctcttttttttttaattatagttttatgttgtacgtttagatcagtgttcttttttgtttttcgatctaaggatatccaattgcttcaacaccatttattgaaaaggctattcttcctccattgaattacttttataccttggtcaaaaatcagttgattgtacttggatgggtctattttgaggttctttattctgttcgatctatatgttttttcctccaccaataccacattatctttattactgaagctatgtgataggctttactatcagataaattcctcccaatttatttttccttgtcaagattgttttagatattctagagtttgtgcctttccatataaatgtttaaataagcttgtctatgtctaaagaaaaatcttgctgagattttgataacaattactttaatactatagtttgggaggattgacctctttattattttgagtcttccaatctatgaacatggtatgtctctctacttatgaagctcatctttgattttcttcaatagaattttgtaattttcagcatactgatcctgtacatgttttactaattgcatacctaaatatttaattttctttggaacaattataaatggtattgtctttttaattttggttttcacatattcattgctactatctagcaatgcacttgccttttatgttttgattttggatatttcttgaaatcttgctgaatttacttcccagttctggaagcttttttgtagattgcttgggattttctacctagataattatgtgtacagtaaagaggaaaagttttatgcctttcttttcactggctgcttttttgtttgttggtttggttttgtttttaagaatctattttctcttgtgagtcatgtgttttccatccacagccatatggcaacaggttaattgtgttttctacttatccttaggctcacttaataagccctactttgttcttttttcccagaaaggaagttctcatcacttcctgaggacattttaattatatgctaatgctgggcaatcatgtctctcatttgctgaatatattgttcttgcacatggtgtctcagcatatgcaattcaaatccataatctggccaaatgacaaattaccaaaagtattacccttaaatgatcattcatgccaagagtttactgtatttgcttgtatcaagcaagtaaatagatataagtcaaacttgaatcattggtgcactatatatgtgggatattgttttaaatgtttttgtaaatttccaaaacatcatgtaaaaattactttataatgatatgaaggctaaaatattatgacatgtcttgtcactttagaccagatgacttagcttatttatagagttggtgtatattagggtagaatctatggtttgatttctttctttctttctttttttttttttttttttttttttttttttgtcgagacagagtctcactgtgtcaccacactggagtgcagtggcgtgatctcggttcattgcaacctctgcctcccgggttcaggtgattctcctgcctcagcctcccgagtagctgggactacaggcacgtgccaccatgcgcagctaatttttgtatttttagtagagactgggtttcaccatgttggccaagatggtttcgatctcttgacctcatgatctgcacgtcttggcctcccaaagtgctgggattacaggcatgagccaccgcgcccggcctatggtttgattttcatatatgccacttgattatttaacattaaggaagagtaaaatgtgtatttcttggttataaacaatgtcatagccataccgatgagaggtgacagcgtgctggcagtcctcagagccctcgcttgctctcggcgcctcctctgcctgggttcccactttggcggcacttgaggagcccttcggcccgccgctgcactgtgggagcccctttctgggctggcaaggccagagctggctccctcagcttgcagggaggtgtcgagggagaggcacgagcgggaactggggctgcgcgtggcgcttgcgggccagctggagttccgggtgggcgtgggcttggcgggccccgcactcggagcggccggccagccctgccggccccgggcagtgaggggcttagcacccgggccagtggctgcggagggtgtactgggtcccccagcagtgccagcccaccggcgctgtggtcaatttctcaccgggccttagctgccttcccacggggcaggcctcgggactgcagcccgccatgcctgagccttcccccgcctccgtgggttcctgtgcagcccgagcctccccgacgaatgccgccccctgctccacggcgcccagtcccatcaaccgcccaagggctgaggagtgcgagcgcatggcgcgggactggcaggcagctccacctgcagccctggtgcgggatccactgggtgaagccagctgggctcctgagtctggtggggacgtggagagtctttatatctagctcagggattgtaaacacaccaatcagcaccctgtgtctagctcagggtttgtgagtgcaccaatcgacactctgtatctagctgctgtggtggggccttggagaacctttgtgtctagctcagggattgtaaatacaccaattggcactctgtatctagctcaaggtttgtaaacacaccaatcagcaccctgtgtttcgctcaaggtttgtgaatgcaccaatcgacactctgtatctagctgctctggtggggccttggagaacctttgtatctatactctgtatctaactaatctgatggggatgtggagaacctttatatctagctcagggattgtaaacgcaccaatcagcaccctgtcaaaacagaccacttggctctaccaatcagcgggatgtgggtggggccagataagacaataaaagcaggctgcccagccagcagtggcaacccgctccggtccccttccacactgtggaggctttgctcttttgctctttgcaataaatcttgctgctgctcggtctttaggtccacgctgcttttatgagctgtaacactcaccgcgaagatctgcagcttcactcctgcgcccaccgagaccacaagcccaccgggaggaacgaacaactccagacgctctgccttaagagctgtaacattcaccgcgaaggtctgcagcttcactcctgagccagcgagaccacgaacccaccagaaggaagaaactccgaacacatctgaacatcagaaggaacaaactccagacgtgccaccttaagagctgtaacactcaccgcgcgggtccgcggcttcattctttaagtcagtgagaccaagaacccaccaattccggacacaccgatagcattctaatattttacatttgattgcaaggaggactaggcgagaattcaaatggattagtgcaaacccattaccactgcttggaaaatacgtcaaagtatttgggcaatataattctaatatatgtattctaatataaatatatagggtgtatttatatattatgtattctaatataaatatataggatagttattttttgattaccatgacttatttaaaaagtattctgaagtattattcaacttaaaggttttcatgatcatttcaacattaaatttaatacgttgggtattgcaaaacaggctaaagactaaaatgtaaattgtagtaattattctatcataggctaggttcaaacatcatagactgtaaagaactatccagattgttttatcagagctttgttttcctgattcttccttacaataagtgggctacttaatattttggacctaaaatatttttgctacacaaagattgtttttcattgaagtgattttttgtgattacacaatcgagttatggaagggaaatgaaaaaggactagtgtttattggatattatctttgtggcaactgctgtaacctgttgctttacatattaatttcatttattctgtgcagcagtcatgtgcatgagctataggtacatcttactgacaaacagaagctcaaggaatgctagagatagcagagccaaatttgaacttgtgtttttctaactcaaaaacgtgtgctatttccagtgtatcatgttgtatttcagtcatcaggtaaacacatgtatgcacatcaagggaaccaaccgttccaccaagtgaattaagtatttcctttgtgaagactagcacctaagaaagtgcatttacttctttaatttactggaatactatatagtattgtaatgtagttatatctgtaatgagaaattaaagtgcctaactcccagtgttaggaagctatgggaagaatccaatattctttagttgttgagaccagtttatatgccatgggattttttaaattgatacataataattgtatatattcatgggatacaatatgttttggtacatataaacattgtagaatgatcaaattaggctaattagcatatccatcaccttaaacctttattattttttgtgagaacattcagaatcatctcttttagctatttgaaatatgcaatgcattattgttagctatactcaccttactgtgtgatagagtaccagaatgtattcctcctacctaactgtaacattatacccattgaccaacctctcctcatcttcccctccctcctgttctccccagtctctggtaaccactatcaagttttttagatttcacatatgagtgagatcattcagtatttttctttctgttctcagcttatttcacttaatataatgttctccaggctcatccatgttgtcacaaatgacaggatttaattttttttatggctgtgcagtattctattgtgtatatatgccacattttccttgttaattcatttgttgatgggcatttaagttgattccatattttcgcaattgtgaatagtgctccaataaacatgggagtgcagatgtctcttcaacctactgatttcatttcctttggctatatacccagtagtgagggtgaagattgctggatcatatgatagatttatttttaattttttgaggaacttctgtactgttttccataatggctgtactgatttgcattcctaccaacagtgtgtgagagttcttctttcttaccatgtaatagtttcatagtttatgtggggaaataaaagtagctattgtttctagttttagatcttgaacagactataaaaaggtgcaatatattaattcacacttaaatcacacaaactcaagttattcttaggtaaaatatcgttgcttgttaattgcataaagtcatctagtttctttagtgagaagagattttatctttctaaaatattaacaatagctttatacattttctgtcctattttctgcattgtactgaacgttgtttccctttttctggtataatattaaagcaggatgaaaacttatttgttaccttcaaatgaaccaactctaatgtattcataccaaaaataaagatttttttgcaataggaatctaaaattctactgatttattttgaattcttaaatttccacttaaaaattatacaagcaacaggagcttctcgaacactaatacttctaatttagatgaagcgaatacaaataaaatgtaaaatcacctgtaatttttacagtttagaggaaattactcatcactgtctacagttaagtgtgttttaggccagaattgaaacactgcccaactaaatgtggtttaaacaagtccataggtaagtgggtgggtgggtaggtagaggatttgtaattgtgctgcttcagcccatcagagccctggggcagcactccacacttctcttagccttccatttggagttacaagatgtttgccaggatttcaaagaggttctcacataagaaaaaaacttctaaacatgaggaaaaggggaagaggttttcttaacatgtttatgcttttttattttactggaaagtcttcaacaagggcccccagcagactcatcattatcttattggctgaaactggataatgtactcacttctaaatcaaacaccagcaaagggaggtaaaattatcataattggttttgatctgtcatgatccatccccaaggactgagcagcttctctctaatattggaacaaaattggagctcttaaagcaaagagaaaaagggtatttgttgttgagtagacaaccaacagtcctgctgcacaccattttatgaagttttgttcttgggtaaacatgacaagaggttgacatttcacctgtattctatagtatgtgttaacgttttaggttggtaacaaactgggaaatatatatctaccaatgtatcatattgcagcaattcaaaattgatttcactttttatattgctattttgtagaacaacaatttctgaatagtctgatttttgtaattcttatgaatagccattaaacatttattttaggaataaacagctgggtagcagtataatatatactgtgaaaatcagaaataaatggccttagaacaaagtataaacatcaaagtaaaagaatacaatgtctgcagcaagtcgtattgggtaagagaaggtgcaaatggctgaaaaataaatggtgaacacctgtgctgaataaattaaacacctgttcctcagtttttcatttgattcctctaaaaggctgttacaaggtattcataagacacatttactttgaggtgtttctttgttattactattaattgggaagcagtactagatgatatcagaatatatacctccaaactctcagagtagtatatgaattttggcaattagtgaaaaatgcatttacaaaaagcagtgttaagcagtttttattaagaaaaattatctaaaaaatattgttacattataaatgacctttggaattaaagctagcaatgtaaatgacactaaatttaatttgtgaaatcaattttgatagtgaacatttttataagaactaatgatgcagattgttttcctttagataaacagtctgcagcttaagatggttcgacttaatgatttttcaactttgtaatggttttattggggtattaaatgcactttgtcttactatattgggtttatcaggacgtaaccccatcataagtcgaggagcacctgtgtatgttaaaatcattgtaatatcttagaactccaaggttcatttgaaggcttataatgcagctacattgttttgtaattggtaaatgtgtttttatagttttcaaacacttttaaattagtagaattgaactattactggattctgaggttttctctgaaaggttgaatatctttttaagaaaatgtcttttaccacagtataaagttttaaatttggggaaagataacccttttagatgaacagaattttgctttctgaggatgtcagtggagttttaggagcttttgggtgtctttatattttctcattaggtattaacttcaaccttggcagaactccaaaaatactgtggttgtttttaatggaaagtgaggacagtgttgtgtttttattgcttgtgttttccgtagtgctaggaatctcaccaaattataatgttgagaacagtaaaacgatagtttattgatgtagaaaaaatttccgaagaataatttcttctcttcgcttatacctttaattaagtattttgacttatatcttccaggttgtccagtactggttaatgtatttcattcactctatagggcccccatcacagaatgtaatagagaaccactgactagatcatttgctatgctcagttttcacagtgtcatcatcatagtctgtaataagagaagttgccatattttgtcttatctgtaaagtgtaattaattatcctttcttaaaattaaaggcatggaacttttgctttaagagttaggcatggaacttttactgaaaaacaaaaaattaggtgtggaacttttgctgaaaattgtccccttagatccctcatgtaacacactttagttttgttggttttcaagataataaaagtgaataagagtgtgaacaattctgtagaaaatatataaatcacctttcatattatgactcttcattcttaatgctgttaatagcgatgctattatgtgcttatatggccaatgggcttttgtcatgtgaatgcagaaaacctaggtatacaggttttgagttgactgttgagctgtgggcagtttaacaatatcttatttttgagtagttttttttttttttttttagacggagttttgctcttgttgcccaggctggagtgcaatgggacgatcttggctcactgctacctccgcctcctgggttcaagtgattctctggcctcagcctcccaagtagctgagattacaggtgcccatcaccacgcccagctaatttttgcattttagtagagactaggtttcaccatgttggtcaggctggtcttgaactcttgacctcaagtgatccacccacctcggcctaccacagtgctgggattacaggtgtaagccaccgtgcccggcctgattagtatcttatctttgattaaccttttagagtttataaactacttttcatatatgttagcttccttatctcacaacagtttcataaaaggtaaggcaaatggactgatccccattttatatgtggtgaatcagagagattaaatgacttgccaagtgtttcctaagtgataaatctaggatagaacaaagtgggtgttttcctcactttggtttcctagatctcaaaaatattcatgtaacattaatgttatcaatttgtttcttcactagattttattagaattactataacagtaaatatggcattttatttcttgacatttgagtgttattctatcattgtccctcatttttttttgtagtgttcattgtgttatttttaataaggcacttctttttttcacttaactcggactttctaatttacaataccgtgtttttttcttggccttattttttgtgtttttcgcaacaagtttgtttcgcatttgaaacaaaaatagtctgcacgtataaaccattattaattaagcatttattggataccacatctatagagcagtgtggtaggtgtcgtgaggggcacagaaggagcggtgctaaggtattccctcaaggaattacagtctgatttggaagataaaggatatactggaaaactaaaggactattaaaaaggaatggataaatacatgcaaggtaaactgcatatgtgtattatgggagcatggtataatagagtgatgagtgtaattggagtaaggaagactaattggaagttaaatttaaactttttcttaaagtagtttgctaaagtatgtgattatgtttgagaatggaagaattgtgatattatgcagagtgggaagaaaaggacagaagaaacaaatgatatgaaccaaactgtcatgatttgacaattagaattgataaattcggagttagagatgccatgttggaaagtaggtggagatgaaaccagaagattagtaaataaggaaggtggtttggtttagagacaggaaaaggaagatttttttgtggggtatttgatataaggaagggctactgttagggctactgttagtcaactagcagatttttacttgccaagaccaatcacatacaaggcattctgccaggtattgagcagtgtggcaactcagtgaaaatagtgggttctgtggaggataaaatatcacagaaattcataaagcaggcagactgaatgggagcctgttctataaatcaagacaatggtggactgagaatgttagctccaataataaatttggaaatggggcttcgactagagtaatagacatcagtactaaaataggcaggaaattatacagaaaggtcctattagataccacattgtgataggccaacttaatcttttcaaggcagatatttttccctttattgaaggtcttctgtcgtatcaccaagtcaggaattcctcagtaataatcatctttgataactaccactgttgagtatttactatgtcccaggcactgtgtcaggctctttgcatgcagtacttaatttaatcttcaaaacaaccttgtggtaggtggtattatctctgtgtcatagatgggtaatttaggtggtctcagagagggtaatttaggtaattacctaaattgagggtaatttaggtggtctcagagaggatacataagtatctaagttcgcagagcttactagtcatatggtcagggtttgaaccaagatctgttattctgaagactgtgttcttcatcactgtggtaatttgcttccaatacagttcccctgtctgtcttaaattctcaaaaatgtgcatgtgacatgaaatctttatatctttcaaatcttaattttgtttcatattttactgaaacattaacagatgaatgtttaatgtctgagtcacataagcaaaacgtacactgaacttgataaaaggggtaagggaatatatatataaagcctggtgtttattattatatttcttattagtcaggatttgcatgaagatgtcgaagaagctggtgcactgcagaaaaatcatgctcttgtgacatctgcaaactccacagaagctgcagattctgccttcctgcctacggaggatgagtcattaagcactatgagctgtgaaatgctcacagaacaaactccaagcagcgatccagagaatgcgctagaagtaaatggtgctgaagtgacaggggaaaaagaaaaccattgtgatgataaaacttgtgtgccatcaacttcagcagaagacatgagtgaaaatgtgcctatagcagaagataccacagagcaaccaaagaaaaacagaattacttactcacaaattattaaagaaggcaggagatttaatattgatttagtatcaaaggtaagtactaattttacccatctttgcattgaaaacagtatctgggcccataaacccagtttttgtaattctctgagatgcagaacatttgttttgtaaagagatagtagccagatgtttgtaattcatttaaaatattccttaagtacaaattaaaaacatatttaaagtgctcacatgaaaatgctttaattatgtttttaatctatacctgaagaatacttttgtgcttgagcacatactacaacctaatattctctggacactatgaattctatcaaaagaaaaattctaatgaacctgtttagaaatccatgttatttacagtcaatttccatcgattcttttagcctttatgtatagtaactattttcacaactgtatgatgatgaatactcagaataaaccaatgaatttttaaaaatcgtgttcacatggacacagcgaggggaacatcacacaccagggcctgtcggggttgggggttagggaagggatagcattaggagaaatacttatgtagatgatgggtatgtagatgacgggtatgtagatgacgggttgatgggtgcagcaaaacaccatggcgtgtgtatacctatgtaacaaatctgcactttctgcacatgtatcccagaacttaaagtataatttaagaaaaaagtctcaaaaaaatcatgtgttcaggtttgaaagcttcagaggaaaatttaatagtgatggaggcaggaaggctgggaagaaagctattgtcttcggttatgttcctgaacataactaacttgaatgttagttcactgtaacttcacaggaggtccctccatcttagaagcgtacaatattgcatttggtttataggaagcaagactatttttagtgcaaaagaatagaaaatcagtaagataaaggattatggccttaaagggtcatgatacaggacagggtaaaagtagagaaaaacagactaaatcctataagttgagagctaacaataagtaattgaaaagaagtaggagaggatagtgaatagcacaagacttgccacagaactagcacagaactaggcttttcaatttaatgtactttcttcaagttccaagtgataggggacagagagggaccaaaacatttcccttgacaagttgtttctgcaaatcccatatcctcatactcttgctccctttgaacttgatgcctgaaaatataaatatctttttactacccatttttctttctgtctgtcatgtagcactctgtgtctgattttgcatagttggctattgcattggttctacttcatacttccgtactatctctcccacctccatctactttgaccctgtcatgatttgaaatctagcattttttccacattaccttggctgttcatctgtggatggaagtttaatcctagctcactaataaccttcctggtcccatgagcagtactctatgaaataggttaaacaaaacataaaaactgaacaagtcaaataacaaatgggctttgtgtgacaattccattttgaagtaattacttggaatttggaatgttttacctaaataaatgatgatataaatgtggttaagaatcaaggctatttcataaaagtctgtaacttttatgttagctgaaatttagtatatatcttgcaaagggaaatggtagaagacggtgctgtttcaattgtaggaattggtgtagaaaattattcagttgtataagaaaatgaatgctggttgtgggaggaaaaagacaattgaattagaagttgacacatttgaagataccctgaaggagacttctgggtattttcatcggtttgaatggttagtaataaccagttctcttatggtaagtaaaaaccaaacatgtctagaggcagtggactaggcagttgggactgcgtcctgcagagtttcatgggttcatacgttctacaaaataactaataaacatttaatgtactcattttcaaaaccagaagtatcttaatcacatataaccatagtaatacaggagattaattttccgtttttaaaatgttaagtcatttaatacatattcagtgcatgctagatggaaagcaatgtattccatgttattggggcaattggtcactccttagaaattttatctgttctaataattgcagttaataaacgtctaagtttaggatgattgccaaatatctatcttaaagccctaaagccctacctccttttttttttttttttttttttttgagacagagtcttgctctgttgccaggctggagtgcagtggcgccatctctgctcactgcaacctccgtctcctgggttcaagtgattctcctgcctcagccccctgagtagctaggactacaggcgcgtgccactatgcctggctaatttttgtatttttagtagagatggggtttcaccatgttggccaggatggtctcgatctcttgaccccgtgacctgcctgccttggccctccaaagtactgggattacaggcgtgagccaccgtgctcgtccaaagacctacctcttttctaaagtccaactcagtatctccaaactagttgacatttctatatgcgttcaacctcaaagacatcatgatataattaaatactgtggggctttacagttgacaatacacattcatgtatatagccttttaaaaagtaatagctcaaggtaggttagttaaataaaatacgtatagtgtcatactgctcagactaatagagaaggtcaaagatgaaattcttaaaatgaaagctcatttctaagtaagtccatactcttaataattatggaaccaacatgctaaggaaaaattgttaattaataaatctaatttccattattgtaatcaaattgcactgctctttagcccctcatcactgtggtagatcgcttagagggtagtgaaaaagaggcttaggctgagcgtggtggctcagtcctgtaatcccagcactttgggaggctgaagcgggcggatcacctaaggtcaggagttcgagaccagcctgaccaacatggtgaaaccctgtgtgctactaaaaatacaaaaaattagctgggcgtggcattgcattcctgtaatgccagctactcgggaggctgaggcaggagaatcgcttgaacctaggagacagaggttgcagtgagctgagattgagccactgcactccagcctgagcagcagagagactctgtctcaataaaaaaaaaagaaaaagaggcttagattctgatatgtacacatttattatttgtgagcttcagaaacaaaaatctagtataattttaattgaaatttgtttttgttcttgtgatatcttaaatgcattatttttcaagctggcattaaaccttaaggtttattggatcttattaaataaaaatgcagtttcatattttatatcttaatgtttgtgacattattatggctatgcagggatccttgagtctcaaatgtgtatctttttaaacaagtgatttttgaagtaactattttttatcattattatagagttaagaattggcaatatattctttaaaacatggtctctttcagtaatgtagtgtgttaggaagagggtaatgaagtaacgtgccatatttaatcaggatgatcagattagcttcaaaaaagtgatgtcaattttgttttgcagaatgctgaactattagtttataaaattttacttgaatggtattgatttactgatagtctttactgacttattagttgctcagactaatggtttagattgatttttgagattcctttttctttgtatagtaaagctaattttcccatttatttattatagatgtaacattcatttttaatatttattgagttataggcattaagagtatcttaatataggaaatagtcaaatctgttgcatttaaccatacggttaacatgctagataatactgtttacattattgattttatctctctgatattacttatgagatgttgaaagattaaatcaatttctcccatacatgccagcaataatcatcatcttcactttttgagaaagacatatctcatataaacccagacttctagaattacagaagtaccttataatttgactttttcagtgtaaatgcatcacaaatatttttttctttttttgatggggtagggaggttcactggactgatttcttcttataactacctggctttgtgtaagactatagattcttatccaaaaccctcagggcctggtgtattctatcattaagattaaaaaaatatattttagaaagtaatgaagtacatatactgatatgttatatgttaggttaaattattagcagggtctgaggaggaactctaactaaacacattatttctgcagtgaaatatatgaatatttatgttaatttggacaaacaaagccagagtgccttatcagtatggatcaggttttgctgctaaacatgttttgtaaaaacttatggattgcaaagttttttgaattttgaatttcagctaatcaattctgagcctgtaatagattgtgttatgtattataatatttataggtatgattgtttctacaaataataaaaaatatagcaaaattatgtatctttattgttttccaatttttctactatttcaacttttatcttgtaaaatattttctttgtacagctgctgtattctcgaggattactaattgatcttctaatcaaatctaatgttagtcgatatgcagagtttaaaaatattaccaggattcttgcatttcgagaaggacgagtggaacaggtactgtgctgatcaagaattgtaactgggcatcagcttaagttattatggtttgttttggaaagataagcaaataagattgttattttcctcataaagcagtaaattccagtcctccgtggtgatttacaaatgtaaatgcttaattaaaatttctagtgctaattttctcatggcttactctgcagcttggtgttggtaccaagcagcacacaaaaaaccaaaaagcacaccagagttactatacccaagactagtcacacaaatccttttctcccattaatcaagattttggagagggaaaagaaagaaacggtgatttttgctgtccacttgatcagattccacacagaggaggaggcccggagcctggttgggaaaaaattcttacccttatgacagctgatcagatcctgggttcttcactgcagcttccagaagagcagagctttgctatcctgctcacagcaccaaaactgtaggggccaagggaaacactccctcttaagcctctgaagtttcactgaaaaatcaactcacaaaggcagattaattggagaaaaggcataaaaatgtactaacatgtacatagggagaaccacagtgtttgttttagatagcactgctaaatttttctctgttaggatgacatgccgttggccttttaatggcatggggagtaacttggcagaattaagtaagaaagctcacaattagctctgaagttagcagagatgccattagtactgatggacggtgatgtgaaaaagcctggctagagtggaaacgataatcctgttatatgtaaaggggaaaaaagtgtaatttggaatagttatatcattaggaagcagtttcttaacttaaaatcataatatttttcaggttccgtgttccagagcagatgtctttaatagcaaacaacttactatggtagaaaagcgaatgctaatgaaatttcttacattttgtatggaatatgagaaatatcctgatgaatataaaggtatttttttcattaagtagtgctctccaattatttgacatttcttactattttaatatgcttgctctgatttagtgagccacttattactgttttaaaatgcattctaactctgcactatcaataggttagccattagtaacatttagctatttaaatttaaattaattaaagtgaaataaaataaaataaattcagtttctcagtcttattagctgtatttcaagggctcccatagccccatgtggctacagtgcagatattttcattgctgaagtggcatgctagattttaatttttattcttattatttaaatactactgtcaactggctcttcatagatgataatctgttttcatgattccattattttttctcataagtaaaaatactatatattttatcattttccaggattgcttttgcatagaatcttgaactatttcgtttgaaaaaaaaaggctagatggtatatggggaaaaatactggattcagaaaaggcatggtttctattcttggctttgacctatttcattatgtgatctggggccagttacttcattgtctgttaaaaattgaatatgccattttagtgtcagagctatatactttaagtccattggtctgaaaatgttatccaaaattggaatatactattgataatttatttataaagttacaatgagaagtgcagcgatattttttttcctctgtgaaataatgaaagtctaatccttgctcttaaagcttcaagtctactaggtactgtcatgttgttatccacagtggctgtgtaaaattcaattctctcagtaaattttcataatttttatttatgtaaattatttctgtaaagtttttgtcttttatcatgggatttatttcccaccactaacagtccaattacattatattctgttcttggtttaaaggagtaacttctgggggtcccgtatgttttgatgtgattatgtggccataagactgattccagtagccacatggaaattcatttcattattttttagtttattttctgagtatcagtgagaagtatacgttttacaaaactcacatatttatcattttaaatcaatacattcccatgttgtcatagttgtttaatattttcagtaccattattggcattatcctgcaggtttcatgataataaagtgagattattgccaactatgacaacccattgagttatttaatattttctagttttttttaaatccatgaaatgctcaatcataattcatcatttaaagctaaaaattgtgccattactccaaataagagagagagattgtttccattttttcctaagatcaaccatcagtgtccaaaatgtaataccacctatgtcctttgtgaggtctgtgaaacacacttcatctcctttttgtggggtggttttaaatagaagtttagttctgattttaagtgataaaatttcatcttttcataggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggtaagtttgccattgattttcttgtcccttctaaaagtgatacttgaataacagatgaaaattaggcaggcaaaaatgagatttattcaagatttagtatatgcaaatatatactttattctatttattttttataatctatttacctacctatctacccacctaagtgatatattcagtgtggcctctttttgagcttgataaaaatactataaattcctttttccactcaatagcatgatggaaagtattgtcattgcatataattttagttaattttttattactatatagtatgttattgtgaatacaccacaatctattttttcatttttctgttgatgaacacaggatgtttccagttttttgaggttaacacccttgtgtatgtttcaagttgtgtatgttcaagaatttctctcggaaacatatctaggggtggaattccccagtcctgagatacatgaatgttaacactttacaacatcgtgttcagttatttctctagagggctgtaccaattataaccttttagccgtacataagaatacccaaagctttacatgtttgccaacatttaaaatttttttgtcaacctaactcacataaattatcattgcattggatttttatttttcatttccctaattacctatgaagttgaaccttttctcatatgtttactggccattcatgttttatcttcagggaatacttgtttgtgtctttttttgtttgttttacacatttttaaaaatttttattttttgtgggtacataggaggcatatgtgtttgtggggtacatgagatagtttaatacaggcatgcaaagtgtaatccatcatggtaaatggagtatccatcccttcacacatttatcctttgtgttgaaaacaatccaattatactcttcattttaacatgtacaattaaatcattattgactgtagtcactctgttgtaatatcaaacactagattttattcattctttctaactacgttttgtacctattaaccattcctacttatccgctgccccctcaaaacccgccccaggctctgataaccatccttttactctctgtctccatatgtttaattgttttaatttttagctcccgcaagtaagtgaggatatgcattgtttgtctttctgtggctggcttatttcacttaatataatgacctccagtttcatccatgttgtcatgttgttgcaaatgtcagggtctcattcttttgtttttttttttttgggagatggagtcttgctctgtcacccagggtggagtgcagtggtgtgatctcggctcactgcaacctctgccacccaggttcaagtgattctcctgcctcagtctcctgagtagctgggattacaggcacgtgccaccacacctggctaatttttgtatttttagtagtgatggagtttcagcatcttggccaggctagtcttgaactcccgactttgtgatccacccatctcagcctcccaaagtgctggtattacaggcgtgagccaccatgcccagccaggatctcgttctttttatggctgagtattactccaaggtgtaactgtactacattttctttatccatttatctgttgctgggcacttaggttgcttccaaatcttggttattgtgaacagtgctgcgacaaatgtggtatgtagatatccctttgatacactgatttcctttcttttgggtatatacctagcagtgggattgctagatcgtatggtagctctatttttacttttctgaggaacttccaaactgttctccacagtggttgtactaattaacactcccacccacagtgttcaagggttcccttttctccgtatctttgccagcatttgctagtgtctttcttttgaataaaagttattttaactggggtaataaaatatctcattgtaattttgatgtgcatttctctgatgatcagtgatgttgaacacctttttatatgtctccttgtcatttgtatgtcttcttttgaaaaatgtctattcagatcttttgcccaatttttagtcatatcattagatttttttcctgtagagttgtttgagctacttatatattctggtcattaattccttgttagacgggtagtttgcagatattctctttcattctgtgggttgtcttttcactttgtttatggtttcttttgctgtgcagaaactttttaacttcatgtgttcccgtttgtccatttttgctttagtcgcctgtgcttgtggggcattgcttaagaaatctttgcccagaccagtgtcttggaggttttctccgatgttttcttgtagtagtttcaaagtttgaggcattagatttaattctttaatccattttgatttgctttttatatactgcaaaagataggggtctagtttcatttttctgcatacagatatccagttaccccaacaccctttatggaaaagactgtcttttacccagtgtatattcttggcacctttgtcaaaaatgagttcactgtaggtgtgtggatttgtttctgggttctctattctgtttttttggtttatgtgtctgtttttatgccagtaccatgctgttttggtgactatagttctgtagtataatttgaaataaggtaatgtgattcctccagttttattatttttgctcaggatagctttggctattctgggtcttttgtgtctctatatacattttaggattttttttatttctctgaagaatgccatagatattttgatatagattgcattaaatctgtagattgcttagcatagtatggacattttaacaatattgattcttccagttcatgaacatggaatagttttccatttctttgtgtcctcttcaatatctttcatcagtgttttatagatttcattgtaggaatcgtacacttctttgattaagctaattcctaggtatttaattgcatttgtgggtattctaattgagattactttttaaaatttctcttttggattcttcagtgttgacatatagaaatgctattaattttgtatgttgattttataccctgcaactttactaaatttgtcagtctaataggtttttgatggggtctttaggattctccaaatataaaattatatcatctgcaaacaaggataatttgacttctctcagcctctcccagtggccaccacagccactggtcaactgggagttctgccaggccacccctgatgttcacttaaaccccaagtacccttcagtaagcttgtgttgaatgcttccaggcctgggccttacccttcatggcagtgggctcccctctggccgagggtaggtccagaaaggctttctaagagcctaggcctcgacttgagttcccaagagcctgcttggtgctctgcacccctgtgtctgagttggtgtttaacacacaacacaaagtcccctttacttttctctctgcttttctcaaacagaagtcttttgccatagataccacagctgggaatgtactgggtctcacctgaagccagcatgtctcagaatctcacccaaggctcacggcatactacctgggtattactgttgattattttgtagccaagggcttttaactagcaagtgatgagccctgccaggattgggtccttcctttgaaggcaatgggttcccttatcgtccatggtatgtctagaaatgttttctgggagttagggtctagaatggtggcctcatgactctgcctggtgtcctatcttattgtggctgagctgctatccaagatgaaagacaaagtccttttactctttgctctcctcttctcaagcagaaggaattagacaccttcgttgctgtgagctgcatggcctagggtttggggaggggtggcacaagcactcccttagctgcccaggctgtttctccctaggtcatgtgctgccctagtccatgggctctaagcccagcctagcattagcacttgcctgggaattacagtccttgtgtcctagattgcctttcaagtttacctagaactccagagcactttagcccattgtgacaaggcttgctgagacactcgagttccagctgctgggatgggccattcctttcttgctagggctggtccaaatgttctctcagtgccacctgagcctagcatagctttgctctccactgacagggcagcaccaagttcaatgctacatcccccagttgctatgctctcactccctcaaatgcatagatttctctttccacaccatgtggccactgccgtggaattggggagggttggcattgaccattcaagactgtcttcagtgcctccttcagtgataggaagttgcagcctggtactgtgattgcttacctgatttttgcttcttatgatggttctttttttgtgtgtagttagttgttaaaattccgcattcctgtgggagggatgatcactagaggcatctatttgaccatcttgctccaccctctcattgttgacttttgcccatttgtctattgggttgttgtcttattgatttgtaggagttttaaaatatattctgattagtgatcttttttcagttatatgtgttggatgtattttgtcttatggtttttatgatacataaaggtcatgaagattaatatagtcaaatagagcaatcttttttttttatgcttagctttttttgggaggtcatttagtatacctgaagtatagagacaagactgcttagatttaagtcctgacttttctgtttattatccatgtaactttgggcaagttttacgacctctctctgtttttcaggaatcaaatttgggatttttttattcagttgtagctttgtgtcctaattcattattttctgctctttattatctcctttgttttgctttctctggattatatttagatcatctctcccctcccctgcccttggcaattattaggctgaagttccgtgaattaagtattcatcttttaaatattttttaatataagcatttaagaatagttcctctagtttacatctactggtggcaaatgctttctagttgtgtgtatctgaaaataactttttcttcttttttctcttgagtggaagtttactgagtaaacaatgctaggctgacaatttttgttaatactttaaaattttattccattgtcatttgtgttccatttttgccactgaaaagttcagtgtcagcctactttgtcattttttattatgacaagttacaaagatatctttttttctctcacattgtttttaatatagtttgtcttttgtattctatatttttactacagtgaatcttaggtgttaatttctttgtatttatcttgcttagtataggttgaaccatatgaaattaacattattcaaccattttagacctacattatcctatggttcaactaaatacattgtgctttttctgtctgtaaatttatgtttattgttttggaaatttatcagccaatatctttataagtattgttttttcttccttttctcttctcgcctttttggaaccctaagtaggtaagttttagaacttagcattctctcttctgtatctctcaatatctttttcatatttgctatcttcttgtctttctggctgcattctgggtacctaattaagatctgtattccagcatattgattctcttcacctgtaacccattcattttctttcttcaatattatctttcatttttagaaattctactcaccatcttctctgtcattcttgattttttttacttgttcatttttgaaattatttattcatttcatatatagatattttacattctctttctgataactctaatatttaaacttcataacgatataatattgccgtgtattgtttctactgattcatctcagtgatttgtgtgtgtgtgtgtgtgtgtgcaatgcttttccttagctgagagtttatatttgattgattttaatctggggacccaaattgggagtgcctttcttcagggattatttgtgtttgcttcatcctcacggcactacagaattaggatcattttagttccctttgggggtcgtcacttaataatgcaatacaacctccacatagtgataccattacaagatatatatatatatatatatatatatatatatttaatttcagtgtttattgctcaaagcttttatttcaggttagggtttgtattgtatgtacatggggatcagtgtttcccatggacattccccttccttcagtgtcattggttcaataacaattatttcatccaagacctagttttggtattaactggaagtgtcttcacagtatctagttcagtttactactggaagtaggtattctcaaatttacattacctaaatatgtgattttatgactttaggtgggaacgttataaatttggaagtcacttatttccgaatatgatggatctgtgtatttctagacaagctcttcctcttctgattacttgtcaaagtaggaataaatggggagtgccatgtcccccaggaaccaaaggtccttctatcaacttaatacaagcgggggagttctatggttttcttagttactctttccctcttcctgtgtcattgcctgattcaaaggagacacaccatgtttcctcttatgttgccacttgctactcactcctgtggagcttagggtaaggaacagaaacagaatgaacagatcactgggaagtgatctaaagctcactggcctccttactagtgttttacaaaaatggaatgtttagccctatttctcttttttccactaaatccctctatttctaattcatacattaaaaaatgcattttgtttttatttcttttgaagggaaaagacatttacaagttttgtttgtcatgtacagatataaaatttcagaatgtgatcttatgtattgaatcttagacaaagaaaacatttttctccaaagatggttgtaaccttaaggctgagatttgtcagccttacatatatttttattatctgcagagcctacatgtggctcagattgaatgttttttataaaaattatacctcatcctgccgggtgcggtggctcatgcctgtaatcccagcactttggggttaaatatattaaacttctgggtaattctcttgagttcttacattttatatacaagagtctgtctgtgaattataataaacatgcatttccttgacctacagatattaacttttagttttatattagattctcttcataatgctttataattccatataaatattgttttatttttatcctaaagtagtaacactattaccatctatacatcatagcctacactttttatcaccaggttatcagaataaggtatcacctgttctgtgatttctaaccaccattctatattctgttttaatataagcctcttaagcatttctcacagccagttacagcatgttctcatcaaggctactattataaatggtatgcatgcatatttatgtgaaggattcaaagacacttggaagtcatatccttgcattctaaatgatttctgcatgtgacattttaactactagagataactttcatgaataaatgtcctttgaggcttttatcaatttaaataggtagatttttttttggtaaagaaaatgaaacatatttatgttgctacctagtatccattaatatgtcaagatacaataattggagcatattggaagaaaagtcattaaaacctatatatttttctagtctagcaagctttacagttttccctaatgtaaattaattggttgatacattttctggcacattgcacaggatatatatgcagtttatagactttaaaacgctcacaatatattttccaaacagaagtcctttttaagccttaactgacctatttgtttatttgtgtggttggtaacatagtagcctttataactacattctagtttggaataagttttatatactacgtcaggtatttataacctgttaattggagcagtatcagtgggaacaaacttcacattttttttttatgtgtagatgtgaactgcccagagattgttacttaattttgttaaaggagggcatttaactgtcaaccttctagataattcagcctttcattattctgtggcctagatttgatctaattttttcctttaatgtggtagaattgctaaaagatgaaggatgaatatgtttcacttgtagcttgtggtataaatttatgtatgtaaataaatcatgtaaattatcaccaccaaacacgtttttaccaattgttgaacctcagatgaaattttcctgactgttgtatgtggaaaattgaagatgtgagatttataggaaattgtgtaacacaagctgatctctagcttatagctttcatttatttatttatttttaacttttagtttcaggggtagatgtgcaggctctttgttctatagataaattgctgtgtgtagtaggccattcttgcatttctataaagaaatacctgagactgggtaatttataatgaaaagaggcgtaattggctcatggttctgcaggatttacagggagcatggtactggcatctgctcaacttctgggaaggcctcaagaagcttacaatcatgatggaaggcgaaagggcagcagacatgtcacatgaccagagcaggagcaagatagagggaggtgccacacactttttaacagccagaactcatgagaactcactcattatcatgagggcagcaccaaggtgatggtgctaaaccattcatgagaaattcacctccatgatacagtcacctccaaataggcttcacacctccaatactgggaactacaattcaatatgatatttgggtagggacaaatgtacaaacttattctgtccctggcccttcccaaatctcatttccttatcacgtttcaaaatacaagcatcccttttcaataatccccaccaaaatcttaactcattccagcattaactcaaaattcccaagtctcaaattcaaattcttttctggaaatgagttccttccacctctgggcctataaaatcaaaacaagttatttacttccaagatacaatgggggtttaagtattgggtaaacatttccattccaaaagggagagattgtccaaaaaaggggggctacaggccccattcaagtcctgtaaggagtgggctcccaaggccttgggcagctctgcccctgtggctttgtagagttcagcccctgtggctgctctcacaggttgttgagtgcctgtggctttttcaggtgcagggtgcaagctgcctgtgcctctaccattctggggcctggagtattgtggctcccttcccacagctccattatgcagtgcctcagtagggactctgcatggggcctccgaccccacattttccctatgtactgtcctaatacaggttctctgtggtggttccatctgtgcagtgggtttctgcctggacacccaagctttcccatatattctctgaaatcccggtggaggctgccaagccccttccactcttatactctgtgtgcctggagtcttaacacaatatggaagccaccaaggcttatggcttacaccctctgaagtagcgaccagagccaaacctgaggtcatctgagctgaggctggagctgaagtggcctggatatggggagcatgttgtgcagggaagcagggccctgggcctggctcccgaaaccatttctttctagcccacaggacctgtgatgggaggggctgcctcgaagttctctgaaatgccttctaagcctttttcccattgtcttggctgttagtacttggctcctttttagttatgcacatttctctagaaagaggttgctttgcagctcactttgattcttctcctaaaaatgggcttttcttttctaccacacggccaggctacaagttttctaaacttttacactctgctttcccattaaatataagttccaacttaagtcatttatttgctccctcattgagcataggctattagaagcagccaggtcacatctggaatgctttgctgcttagaaatttctttaaccagataccctaaatcatcactctcaagtcaagcttccacagatcccccggacatgaacagaacgcagccaaggtctttgcttaggcataacatgggtggcctttgctccagttcccaataagttcctcttttccatctgagtcctcctcagcctggacttcattgtccatataactgtcagcattttgatcagagccatttatcctgtctctgagaaattttaaactttccctcatcttactatcttcttctgggtcctctaatttcttccaacctttgctcattgtgcagttctaaagttgcttctgtattttcaggtatctttatagcaatgccccattcctctgtacaagttttctgtattagtcagttcttgcactcgtataaagaaatacctgacactgggctatttataaaaataagaggtttaattggcttacagttctgcagcctttaggaaggatgcagcaccataggaagcatggtgccgtcatctgcttggcttctggggaggcctcaggaagcttacaattatgacagaagctgaaggtggagcaggcacatcacatggcaagagcaggaacgagagagagagagagagggagatgccacacatttttatacaaccagatcttgtgagaactcactatagtgagaacagcaccaagaggatgatgctaaaccattcatgagaaatccacactcatgattcagtcacttcccaccaggccctaccaccagtactggggattacaattcaacttgagatttcgacagggacaaatatgtaaactatatcacggggctttggtgtacatattgttagccaggtaataagcatagtacctgataggtagtttttctagtttctcagtcctcacccttctcccatcctgcaccttcaggtacgtcccagcatctattttttccctctatgtgtccatgtgttcctgtcatttagctcccacttataagtgagaacatgtggcatttggttttctcttcctgcgttagtttgctaaggataatgtcctccaactccatccatgttcctgcaaaggacatgatctcgttcctttttatggctgcatagtattccatggtgtagatgtaccacgttttccttgtcaggtcttccattgatgagcatttgggttgattccatatctttgctattgtaaatagtcctgcagtgaacatactgggacatgtgtttttatggtagaatgatttgtattcctttgtgtatgtaaccaataatgggattgctaggtcatatggtagttctgttttaagttctttgagaaatcaccaaactgcttttcttagtggctgagctaatttacatacccaccagcagtgtataagcttcccttttctctgcagcctcaccagcagctgtctaacttacagcttttaaaaagagatttagagaaggccaaaagttacaaatatataaatggatatatgtatctttaagcagcttgctcaaaattataggagcaacatggagggaatggaaaaggaatctcccatttaatgaacttattcagtgatgacaggactatgcccaaaatgggacaacatgctactgtgattttgtcataaccatggaatttgtgcatttatatagactgtaaggtattttatattgttttttcttttccccctgcttttaaaaatccccttcttcattgcagagtcaatacattttacggagtgttttttagttctctttggataaatcataagataaagcatctcttagaccaaaggaactaccttattttattctatgataaccattgtgtttttctacagagagttttcagaaatctaagaaacatttcctatcctggatcaacctattagaaaaccaagagaagtcttaaaattggccaaggagtatactgttggaaaatttaaagagtttatatattcaactgcatgtgaagtcagagcaacattgagatggaattttagtgtctgcccccgatgttgttgctcctctaccttaacaagttggagttagattatagatgtagattcttcaacagtacattattttttttttcttccatagtattctccttaacctcttttcttgtaaaaatctacctactattctggtagcagtacaaaaaaaattaaagttgatagaactcttttatattgttttgactggttgtctaatttttacaaatgaacaaagttaagataaaaaggctgaggctagaaaccagattttctaatatgcatttttcttgactcacctattatatttttaaacaacttttttgaaaataattaagacataatttgcaaaaatattgtgttattttctggaacttgttatatttgtggtatttcttaatttttaacaacttgtaatttgctatgacttaattattttctcattatggatgcatattcagcttccagaaaaagttggagagaatacggggcattcttacagtattctagaaacatgttccaattctgtgcccaatacaaaatgccagtttagataaataaagaatttatttcaactttctatattttaattaattgataaaggtaaaaggaaaaacaagccatgagcaaattatctcctccttacccctataacttgaatttgtgcattcgataagcattaatgctgaggagcccagtagcggttagaatagttagcattttttcatgtgtcttttggctgcataaatgtcttcttttgagaagtgtctgttcatatcctttgcccactttttgatggggttgtttttttcttgtaaatttgtttgagttcattgtagtttgagttcattgtagattctggatattagccctttgtcagatgagtagattgcaaaaattttctcccattctgtaggttgcctgttcactctgatggtagtttcttttgctgtgcagaagctctttagtttaattagatctcatttgtcaatttatgaagctggaaaccatcgttctcagcaaactatcacaaggacaaaaaaccaaacactgcatgttctcactcataggtgggaattgaacaatgagaacacagggacacaggaaggggaacatcacacaccagggcctgttgaggggtgaggggaggggggagggatagcattaagagatatacctaatgttaaatgatgagttaatgggtgcagcacaccaacatggcacatgtatacatatgcaacaaacctgcatgttgtgcacatgtaccctaaaacttaaagtatatatatataaaaaaaaaaaagaaaacattgacctgtttcatgtccccatccccattggtttcctcccacagtgtcatagagccacgtgatatagctaaatctaggtgcagaaactgaccctgcgtcaaatgggtagatttgactagtccagatgtgtgtgtgtgaagctcgattattgaatcacaacatactatccttttgcagcactgcagctgaggagaactgcattgagatatgcgaaatgttcttgatctagcatccataagaccttgaaatttatttacaaaatgttttatgtttcttcataaaagaagtccatagtttcatcacatttcacaggcatccatgacttaaaaacaaggattgagaaccgttgttaggaatttttattatttttttaaactcagataaacattccttaagaccttataaaaggaagaggtcctaaagagtgaatacaagagtgcttctgggatttaaagacttggggttgggggttgggggttgggggctaagggaaggggaaaagttggaaaatgttgccgttagtactatgatatataggcacctcttcatataacatgcaagcagatgatatctatgccttagtcatatgggacagaaatattataagtgtagaatagtgaataagaaagtatattttggagccagaccaatgggatcatctcctgattctgctatttattaactgtgtatcattgggcaaattatttaacttctctgtgctcatcatttttggtgggataatagtacatacctcataggttgtgaggattaaaatgagctaacatgtagaagaaagtgcttttaatattgcttgcccaagtactagataagtgttagctgttattactattactgttgttactgtgattgtttttaaccattgctgctgctgctgctgctgttacagaatgccagcagggaaaatatgaggcagttagagacttagctagatttagtaatctaagttaggaatcagcgattttttttttcgtaaatagacaaatattatagtacatagtttaggtattgcaggccgcgtggtctccattgaaaccttttgtagccatagacaatatgttaacaaatggatatggctgtattctaaaaaatttatttctaaaaataggtggcaggtttttccaacttcagttgaatagtctttttttccaaaaattgataattttaaaaaaccccagtattaagagattatacaggaatgtctcaatgcaatgcctagtgtatattagtcatgcactaagtatttgatggattaatgaatgaatagcagatgatgtataactgaggaaattgtatgttaaggaaacgatagagcagtgtttttccaagctttcaggtgtgtcagaaattaacattactgagttccatctccagcatttcttacttgtagatctgggtggagcatgagaatgtgaaattttaacaaattcccaggtgttgctcatgctgctggtctagggaacactgctgtagaagaagcaatcacaagaattgttctctgggcctaattctaatgaacaagaaagaaagggtttagttaaaatgaccaaaatcttttgaagaagcatctgtgtctttattgtaaatgtaatttttttcatttctttccatttaattcaacaacaactttttaaagcatctattctctgcataatactcttctaggtatagtggatgtacagtatatgaaaaagaatatgacatagaccttgatatcaatgtcaagaagcatctagttaaagacagatggtatgcacttatggaccaattagagaattagaaaatggattttatcgggttccaaaattttcagtagaggtatgaatgcatgatcagaaggggcctaaacagttatgacatgaaactaatcaaagtaggctgactactttgctgaagttataggaatctcagattactgttaacccatccattctcagaaaagagcaacaagattgggctccactctaagccaataaccatcagtagtctgttcatacctatctttaacatggtgcgtatatgtttgagatactaaattgtttcagagactcatggtttagaccagagtttctcaatctcagcactatttacattttttttttttgccaggataattttctctgtgttggggaaagggctgtcttgtgcattgtaaaatgttagcaacatacctggattctacccactagatgccactaccttcacccaacccacttgtgacagacaaaaatgtctctaaacattgccaaatgccctatagaggcagaaccataaccgcttgaaaaatactggtttgctccaactcagtatatattgaattgttgtagtctttacaataatatgataaatatatgattttctttctctttaacaagtaacctcaaactagttcaatgttgaaaggcagtgatgtcgtttggctctgtgtccccactcaaatctcatgtcaaattgtaattcccagtgttgggggagggacctggtaggaggtgattggatgagggcagatttcccccttgctgttcttgtgatagtgagtgagtttgtaagacattacaacagtgtttaaaagtgtgtagcacttccccctttgctctctctttcctgcttcgtcatggtaagacgtgcttgttccccatcaccttctgccatggttgtaaagtttcctgaggcctcccagccatgctctctgtatagcctgaagaactgtgagacagttaaaactccttcataaattacccagtctcaggtagttctttatagtagtgtgaaaatggactaatagaggcaggaggaataaaattttcttgcagtcctttctttgaatcttattactcatgttttgattctgtagtctggcacaaagtaaaatctatttaaggaacaggacagttttagatgtgttggcatttgaaccaatgggctaatttgtgagggttatttagcaaggtgccaaagcatataggagatactgagtagccattgatgagcaaattcttgtataccatatcttagtagttagaaaaagaataagaatatggggggaataatgtgcacatacgcatatcctcctcaattttataaagaaatagaagcaccattccacaccttcatattccacccttaatcattgttaagttggttgcatgtcttcctacattttacatgcttgtacaggtaactgtgtataaatgagtacatatatgcatactttaaagaaatttagatggctgtattgtctggtatgaggatgtatatgccataatttaatcactttccttgttggtgtaagcattaaaattatgtctttgatatggaagaaatatctcatatctagaaattttagaaaataacataagtattattttttgttacaagaattaactgaaatcccatcacctgttaacaatagcacactgaatattttggtgtattttcttctacattttttagtccacacatttaaaaaagtatatagctttgtgcatcacttaacaacagggatacattctgagaaatgcatcattaggtgattccatagttgtgcaaacatcataaagtgttcttacacaaacctagatgatacaacctactatatgcctagactgtatgatatagcctattgcttcttggctacaaacctgtacagcgtgtgactgcactgaatactgtaggcaattgtgtaacataatgataagtatttgtgtatctaaacatacgtaagcataggaaaggtacagtaaaaatacagtattagaatcttatgggactttcctcatatatgtggtccattattctctgaaatattgttatgtggcgcatggttataatctcaatattttttgtatttgggcatcttcaactatagaataagcagacttacagccatcattaaaaacacacacacacacacatatatcagcttaaaatagcaacggaaggctggctagattaagaggaggtctttaaattcaggaggccttaaactgatatgcaatgtttgtaatcagttacttgggtttcaggaatttagggggtaaataccctgaaattgcatgccaaatattgtgcgtataatgtgcatagctacatttttctaggaaggaagttcatagtgtctctattagtgtctcagaggagtgtgtgactgccccctgcaaccccaccaccaaaaaaaaaaaaaaaagattaggaaccactgagatatactatctcaattgagaactgtctttactaaattagaagagtagtgtgcagtagattgacaaaaagcttctatcccaaaagtttgaaggttgctatttgaatagaattcttataaactatggaattttggaggataaaataagcacagcaacatactttattttcagaataatttgtatatgattttaaagacaatttcctctctagttgatagtttatattagcatggagatgatacatgattatgtttgtatgatcaattatttgtttttcccttgaggaaagagtgtttcttgggataaacagaagggggtggtgagataatccatcattttgaaacctgttctctggtgatggatggatatattggtaaagtaactcaataatcttcatttttttccaggttattcacagatcagtgaacattgtcgttaataaagcaatggaatgcttttgtgtccttgcctgcattattccttacgttttgacagaaaaatatttcccatttgggaataacctcttttaaaacttacatttaagtatattttgtggaggaattattgtgactctcatgagtatattggaattacattggctatatagattatagagtttgatttccttcttttttaaacctttcctatggtgtggatacagtttaatttccttttttttttttttttgagacagtcttgctctgtttcccaggctgcagtgcagtggcaggatctcgactcactgcaacctctgcctcagggattcaactgattctcctgcctcagcttcctgagtagctgggattacaggtgtgcactaccacaccatgctaatttttgtatttttagtggaggtggggtttcaccatgttgcccaggctggtctcgcactcctgacctcaagtggtctgcccacctcagcctcccaaagtggtgggattacaggcttgagacgtgagccaccatgcccagcctgattttccattttaataatagcccccttcagtgctaactaacttagatactagattaccctcataggtagatacaaaacttacccagtccagttttctctgtatgttatatatgtatactattccagctcttaaaataattttaatagtttgtatgagaataaaaggtggttgactcataatagggcaaggctgatatttgaattaaggcaagtgtttggagctgaaatcttagtttgattaaactgaaagatagtattattacacagactgtttttttttttttttttttgacggagtctcactctgtcaccaggctggagtgtagtggcgcaatcttggctcactgcagcctccgcctcccgggttcaagtgattctcctgcctcagcctcctgagtagctgggactacaggcgcccgcaaccacacccggctaattttttgtatttttagtagagacggggtttcactgtgttaggcaggatggtcttgatctcttgacctcatgatccacctgcctcagcctcccaaagtgctgggattacaggcgtgagccactgcacccggcctgcacagactaattttttaaagattgttcaagataattcttgacccatctctggaaccagtatactgttacccagttgtgatagaaatagtatgtgaaatgtgtttatttgctagctaaatttaagattgccattcaataaaaagtataacacaaaacaaaaacaaacaaaacaaaggcagccagatctaaggctttacttgctgggtttccgtgtgttctctactattccccagtgtaaatttgtttttgttctagattaaaataatccaattaatgtgattggtataaattgtagcaaagctatttatttctgattcttcatcagtttaccttctactttggaagggaatactcaaaaactgagtctttttataaaatctttgttacatcttatgaactttgtaaggttttccatgtgctacagaagtatcaatctcagaaatgggttttgattctaactttgtcatgttgttatttaggtggacttgaacatgtcatttaaattcccaaagcctcagttgtcttacctgtattatggaaaaggccataatctagtcttacctcctacctttggctactttgagacttgtatgtgataatgtaaagaaaagagtgttgaattttatcccacactaatgcagagtattattacataaaagttgcatgactttgcggtcttgatgtttagaatgaatgttttggtgattactgaaagattaatttatatattatagatgattcagtttatacaaactagatttggtattaacatttaattatgtaattaaattagctaataatttatgtctgttgatagatgtatttgctttataaaagtcatcttcatctctcccatagttctgagcatattgccttctacaaaatgggtactccataattttttcttatcaaattctgtgttttactcatacacagttaattgcctagaactttggtaggcacatagtaggtgcttagtaaattgactttttaaaatttaattagcaattaccataaaaagaaattaaatattatgggacagaaacttttcctttcatgtactagagaaataatttgtaaaaagaactctgttaggactgaaataattaatgtagcttttactcttcctcgtttttatttctggatctcttcatgctccatcctctgccctccctccaaattaggcagtagattcacgcttgcttaatataataaaatagtatgaaagttttgacaaatatttttacagtcatgtgctgcatagtgacatttcagtcaacaacagaccacatatatgatggtgttcctataagattctattactgtattttgactgtaccttttctatgttgttgagatatgttcagatacacaaataccattgtgttacgtttgtctatggtattcagtacagtcacacattgcacaggtttgtagcctaggaacaataggctatatagcatatagcctaggcatgtcataggtcatgtcagctaggtttgttaagtacactctatgatggtcacacaacaatgaaattgcctaatggtgcatttctcagacctgttgttaagcgatggatggctgttgacatggtttagatatttatctcctccaaatctcatgttgaaatttgatcccccagtgttggagttgggacctagtgggaagtgttagggacatgggggtggattccttatgaatggcttggtgcgatccttgaggtcgtaagtgagttctcactctatttcacatggaaagtgttaaagaacctggcctcctctcctccctcccttgcttcgtcctcttttactgtgtgacacatctactccctctttgccttccaccattattggaaacttcctgaagctctcaccagaagcagatgctggcaccatgtttcttgaacagcctgtggaactgggagccaaataaactgctttataaattactcagcctgaggtattcctttatatcagtgcaaacagactaagacagttttatttggtaaaacttctctgattttaatctcaccaaattagaatttataacaaaacattcataacaattttaatgtttttacctcctactctgtatgtaaacagtttgatgatcaaatgaataccatgaacaagaaggtatattaccttcttattatacctactcaagaaaccaaacattactgggtatatacccaaaggattataaatcatgctgctataaagacacatggacacatatgtttattgtggcactattcacaatagcaaaacttggaaccaacccaaatgtccatcagtgatagactggattaaggaaatgtggcacatatacaccgtggaatactatgcagccataaaaaaggatgagttcatgtcctttgtagggacatcagtgaagctggaaaccatcattctgagcaaactatcgcaaggacagaaaaccaaacaccacatgttctcactcataggtgggaattgagcaatgagaacacttggacacaggatggacacaggatggggaacatcacaccaggacctgtcatggggtggggggaggggggagggataacattaggagaaatacctaatgtaaacgatgtgttgatggatgcagcacaccaccatggcacatgtatacatatgtaacaaacctgcacattgtgcacatgtgccctaaaaaaaaaaaaaaaaaaaaaaaaaaggctgagcgcagtggctcatgcctgtaattccagcactttgggaggccaaggtgggcagatcacaaggtcaggagatcgagaccatcctgcgtaacacagtgaaaccctgtctctactaaaaatacaaaaaattaaactggtgtagtggcaggcctttgtagtcccagctactcaggaggctgaggcaggagaatggcgtgaacccaggaggcggaggttgcagtgagccgagattgcgctactgcactccagcctgggcaacagagcgagactccgtctcaaagaaaaaaaaaaaaaaagctaatttcaaccattttgtaaatgactcctgcaatcttgaattcatgtactgagtgacaacacttgaatttaataaacctatattttataatatgcatccttcatttatttcatagaaattaaattttgccatgcagatacacacgtgtttgtaaacagccatccctattaaatgttttgcttttccatctgcagtttttaaaagaaaaatgattctgtgtggctgtttttcttaagtaaatctcttttcactctattagaatgtaaaatattccttctcgatccccacagtctttaattgtggtcctatctgcatagaatcttattcttcaggtgtatttaaaggagaaattaactctaaaataacccttttaaatagcacacatttattgaacaaataattagctttgatcctaactttgtgttttaacttcttgtattataaaagtctgcaaagtgtatataggcatagtgtggtggtcaagagcacagactttgaagccagactttctgagttagaatcctactgtttaacctctctgttttacaatttcttcctttataaaaaaggaatagtacctatatcatggggttattatgaggattaggaaattgatatttgcaaagctcttagaataatatctggcacatgatcagcactatatgagccattgttagttaaaataatttccaaactgtgttaagttgtgaatatatgaattcagattttttttcttatttatttattttattttattttttgagacagagtctcactaaatcccatgctggagtgcaatggctcttcagaggtgcgatcttggtgcactgcagcctcaaactcctgagctcaagggatcctcctgccttagcctcccaagtaactgggactacaagcacaccactgtgcctggctttgagtttaggttcttaggtatagtaggctggtctcaaatgcctaacaaattgagagacagacttctgattggagtgtttctaccttccatgatgttttcataatcaacacttaactgccaggctgtagtgatcctataacaagtgtaaatgtaccaagagcagagctgctactgtcacatatcttgtgtagcacctgcttgtccctcactgaattaactttcttgcttgtctttttttgtgaggttaggcctcactctttccatgcattgtggtggggcagtagtgtatgctatgatgtacttctttcctagaatatacagacgaaaacaagcattagttttctttgtgctccaaaaggagaaataaaaagtgctgtttaatgtccaattaggacatgaaagttttaatgtttgaaatgggctctttaaggtctgcaaactaaggcaatcactgtattgtacagataaatcaagtgcgactcagaagtgttttgtcatatgtttttatatgttcagtattctagccacgatgagactgcactactcatgtccagtgcagtttctgttttataatagagatttaataatatcacaatttatatgagaaaagaaatattgctttatttctgaatagttactggggtagaaaataattttccttggacatgtaaactttggaaatggtattttaaggccctaataaacacattgatgcttgttaatattcacagccaattgaacaaaccaaatatttctgctgttcactttagccattctttagagagatagtcttaatactagaaatgtactaataaaattggcctattgcattcggaaaggttttagaagtacccttatatagtgaggttaagaaatacgaatctgtcaaccttgcagattaaattagagcttctgtgcagtttgctccccctggaagatatcaaaggagctatgggtgacatatctccataagtagggatattttctatagtgatacaaagctaagtttgccagattaaattgagtttaattccttaatgtcagtttggagcatattgtttgtatgttgaaatggcatgaggaaaagatactatcagaaatcaagctagtaaaaatgaggacactgaaagcagcaaagcacaaaagcatagtgcaaggtactttgaggtcctctctggcaggatgccctcttgttctgctaagaattgaatacttaaataatcattagttctttaaacccatttatatgtcagcatacatggtggatgcgttttcacatgtgactcattcccagggatgtacctagagtttttacaggctttggcatagatgagaggctgtagtctctgcatgggtcccactgtgacaccatttttttctcctatgggattggggtacaatactgcctctcagaccatcaaggttaagaccactatattataaaacgaagcatgaaattcatagtagatccgtaaatcatctaggagtgatagcttttattgatcttgttaggtggaatttggcttattgacaactgatatgtgtgtttccttatgttttaaggaaaaaagaaaacacaattttagatttcttgtttggatgaaaaaatagtatctaagatatgtgaactatatctctttgtgggtctggatttttacgcatttttagttccataaagcaaatcgaactggtctatttttggcagtgcatatattaggtaaggatagcgttctgtttatttttttgctattttttttccctaacttactgctgttctgtttttggttgtgcctcatagcaagttgaccgttttttcccctgaaataaagtatttttgtcttatgaaaataatgcatgcctatgattaggaatttggataggaaagaaggtattaagaacataaaatttaaattaataattatttttatcagaattaccttgattcattttggtttgttttaaaaatggcttgtataggcttgtctttactttgaccatcctgttacttagtatccccgccttaatttatgcagtgtcaatactactagaatacttgaaaactaaaaagagctctttcatattgctcaatatggtatcattttgtaaacatgtttgttgttaaagtttgaaaattctcaggcttttttcgctcttctgtggcttccagtgttgcaaatatgttttgcctttttaatatttacatgatttattggcaaaggaagaaattctgatcctcctacaaataactcgataaagacttgaatttctcatgaggggaaggttacaagacataataaacttgaatccataagttggagaaattaagttatgggaaagcgtctctctgtctctttgtgtgttttttaaaaatagtattatcacaaagtttctgtgaggactgggaataagagagtggatttcagaggcccatccatcaaagttgaggcatttttccctagaatgtaggaatagaaaacagtatatatgtttatatgctactttttgcaagactaaagcgtgccagttatgatgttaaattagaaactagacatttcaataaaatcagccttttctacgtcagaggttttttaaaaacaaaactgtaaaagaaatttaaataggaactttgaccttggggacttgtactagttttgatctaattttcttctacccattgactatgtcctctttgaaaacagactgcttccctgtccaaagattgaggccctaaacctgtcttgcaagtacgtactcttggtcacaagagggacctcgtgagagtaggagtggttcatgtgtctgttactaccagtaccttagtgaatttctaacattctttgatagccatatgagttttgtctatgtatgcatacacagacacactttaaggcatgttaggtatggtttaatggttatggaatttctttcttttttaaaaaacttattttttttattttctattttgagacagagtctctgtcgcccaggctggagtgcaatggcatgatctcggctcactgcaacctctgcctccctggttcaagggattcttatgcctcagcctcccaagtagctgggactacaggtgcatgccaccacacctggctaatttttgtattattagtagagacagcgttttaccatgttggccaggctggtctcgaactcctgacctcaagtgatccgtctgtcttgccctcccaaagtgctgggattacaggcatgagccaccacacctggcctggttatggaatttcttaccaaagacctaaaactaatattaaatgaaaagggaggaattgactataaattcgggctgttttatcatatgcatatttagaataaaaagagctaaaactaatattttattaaatgaaaagttaagggaggaattgactataaattcgggctgttttatcttatgcgtatttagaataaaaattaggattcatttagtaaatatatactgaatgtattgatcccagctcttttgtagacatttggaatacactgctgaaaacagaaactctctggttgtggaagatgttgaaggctcttcccagagagacagtagacaaatacaatttgagagaatgaatgtgctgtgaagaaaagaaaaaaagcaaatagggtaatagacaggccagggagtgacagttggcaggaacagggaggaattcctctttagagggcataatggtcaatgaaggccactaaggagggtggcatttgagtgtgtaatgataccagaatatgatgggaatggatgagtttttgaatatttgagggaagagctctctagtcagaaggaactgtgagtgtcagaggatcttttgatatgcggaaaggttgagtgagggagttaatcaggagtgtgtttgtgacaataccaatggaggccattggtgagcatacacatcattgctgcttgcttttttgatgtatcactgtgcttccctaatttcttacgttcaagctttctgtcttttggtatatgattttctgagtttgagactttttacttcttttggaaaatatgcatcatatttaatttgctttattgcttttatatagttgtatgactcaacagctttgatgatagaaccttagctgaagggctggggaactttaaaaaacataataaaatgaagcattaaattcaggacacagaatgttctgtgtgtaaaaatagattaaataataataatatatcaatgtcccttgacattttttctctgatctccctccagcctgtcatggccttgtgcccagtgtttatcttaaggggcagaaatggcctcttgtcacctttaggaaaaactccggttaaggcaaagacctactgttcatttttcatatatagaatcccacatgcataattttagaaatgaaaacattgccttacatattgcacttatgaatttggaagctattttcaaagattcttttatgttttcagtttctaaagcattaatacagttcagttattataattttttattttatttatttatttttttgaaacggagtcttgctctgtagccaggctgtagtgcagtggcgcgatctcggctcactgcaacctctgcctcttgagttcaagagattctcctgcctcagcctctcgagtagctgggactgcaggcgcccgccaccatgcccagctaatttttgtatttttagtagagatggggtttcaccatgttggccaggatggtctcaaactcctgacctcagattatctgcctgcctcggcctcccaaagtgctgggactacaggcctgagccaccgcgcccggccctatttttataatttaaaattagtacgaatgcatatgtatataatagttcttatgttttgacaataaagatactgaataaagagacactttcattgtgtccacacagtatatttctctcttaacaggttccctaaccctgaagcctgtcttctttcttgttatacagattagtttttaattaaagaaaactagttggatgcagttactttctgtgaaatgaagatttattttggaagtgaccttcactttattagctgaagcagtaatcagaagaattaatagaataatcaaattatatacaaactcataaatcatcttgaatagtgctgtcaaaagttcggctattagtgggtcatactgttttgcagctatgattaagaaaattacaactgctgatttgtaccttgataggaaccaaaattgcttttgtaaagcatatgtagaaggggggctaccagccaaaaattttgacaactcttagtttatctgtagtgcaatttgatgtcaccagggcaaagttgaaattcagtacatgttggtatgctctctttcagtaaaatctgactcgttggatataatatactcaattagagttatattgatttaaatgtctgttgtttggggttaataacatcaaagaattagattatactccagatatacgcaattatctgaataatatactgtaaagatattaagttgctttagtgaatgtttctcgagtttgtaaacaagtaattgaagtggcagtttaataattgaaacttaagcaggaaaaatatctcattagacttagtacttcacattactcagaaactatttacatggattcccatattctttttaacttcaattaaaatgggacaaatgggaaattccttgctgctgagttttgtatttttttacagttgcatatacaggaatcgtatgggaatcgtgaagctagctggtgatactaactacaagtttcagccacagctttgtacagtcaaacattatactcttgtcagagcctattaaagtaaatttattttttaaaaaaaatccaagactgtactaacttagaaaacaatttttaaattactgggcagtataatttattttgtatagttgaaagtgacattttctttttttgtaactaattttttacaaaagaaaaccatgcttacaagtgaggaaaattgtctttactcttggtcagtagtcagacacaggtattaatttcaaataaatgcccattttttcaaattagtattcccatagtgttaatttcagaactctccaaaacttctgaaaagtatgaagattatcttggtattaaatggcaaataactgttatgtaaaacgtatgagcattctatgtaagaataactcagaataaggcttaaactttcttttatcaccggctctcatctcagagagagatatttttattttaaattaaattttaattattaaaaaatctctattaaaaatggaagtattacaaatgaggccagagtgcccttaaggcatttatcctcctcaatttcatccttagccccctaaccctctatcggaaggtaatagctcttgccagtttgtggtgtatctttcctgatcttttgctgtgcattgaaatatatatattttttctcatcagaggaaatatatagtattctatagtttttttctttttttttccttctgaagtttcaagaaacaggccagaaaccacagagaagtaaggctaactattaccgtggcatgacagtcaattttgtgaaaaatagctaaagggtgaaattcttgaacatataacccacaggagggaagaacatggtttttgtgaggtaattatatctcaaccatctaacagagttctttgagaggggtaaataaggtatgaacaagggggagccagtgaacatttgaatttccaaacagcctctgagaagattttataccaaagactgctttaaaaaataaatgttctcccaccatggggttgggaataatgtttagtcatgcataaagatctagtttaaacacaatatggaaggaagggggtggtttatatgagctcttacttgcatggggagatttttacagtaggctttgccaagaatcaatgtttagttttttgtgttttttttttaacatttttataaatgatttaagagtcagcatcgtaacacacttccaacccaccttccagtttattgttgatgctgagagcttatagatagtaaaataaaatgctaagctgaagagtatttgctaacggactatttcacaaggaccctgtgaaaaagcaggaaaatgacatgagtggccgtgtttctaagaagatggtctctgtacatttttcaacccatgaaagagatctaggagttgttatgtagggctccctaaagacattcacttttgatatttttgtttctacattcagaaaaaccaacataatcctgaacatagccatgaagagcattagaagtaaaagaagtatattctttctggattcaaaatggatgtctctttacctttatgttatttgtacaatttgaattttcaagactgggcagcaaaatggaacaatgatttaaataaggattactcaaaacaaaaatgaatatatatcatacaggacattaaaccagagaaagagcccaagaaaggagattgagcaaaagaaatcttatagagattctaagtaggattgctgtaggctagtttgctacaccccaaaagtttgaaccaaaggctttcttttgaatttaaaaaacctatttttgaatgaatttgcttaggtatctctgtggcagataataaagatggggcaaatagcatgggtgttcagactgaaaaatgcaattttattaagagcttagtttaaattatgatgtgtttaaagagtagtcaggaaacaccagtgcttttccatcaaaagttccattgaaatgatgtccattgacatcattgtgataagctatattgaggaatcattgagttggttcggtggttctggcccttgtacaaaccaggtggtcactgtacttatgaaacatagatatggaggctagggtttgacccaaacatataagttgaccctcagtattttagaaggctttatgttttaaagattgagtgatcacttgtagtctataatttgtgctaatttattctggacccctggtacaattactaatacagatctgtttttgtcatccaatacatagttttactgtgactgtcctatagaaggttaaatttaaggacagctggaaaaactgaaagatattgaatgtatcatctacagtctcatcaagaatagaggaagctagataaatggctaagatttataaaaaggaggcactttttgggagcaagttttctgaaggctatgtgttgttttttttgacagctttttctagattaagcatgatgattatgccttccaagattgacagcagttcctaaagggcagtccatctgcccacaaccttttccttgagtgggaaatccacaccagaagccccactagactcagatacttgtactacataatttcttgaattagcagcagtgctgttattccaggtccatgatgactccttaaggcacagaaactaacctgttccttgtgccctcctatatagaaattagtacccagagtattaagttgtaatcttgatgaatggccaagagatagtagtggtttttgaggttggtaacaatttgctgtctctaataatcaccccacaggtggagtaagagtgctttctgggtattccttcacagcaatacttgtataggaagactaccaggcttgagcagttgcatttgattgcttcacatttcatgggggagactgctttcatgaatgtgcacattaccttatacttgttctgaggaagacacctcccttctgcctccagtctattagcaattcttgtcagcttgatgtcttatatatgtccccagcctctccacttcttcatgtgcactgccattaccttgctttaggtcaccatcttctcttacttggtttatggcagacataactggcctcccctctttcactcttgcccctttgagaattctccacagagcagccagacccattttaaaaataatacaaatctgatcatgtcactgccttgctcaaaacttgctggttgtactactcattgtacttaagagtaaagtttaagatctttaccctggccttgaaagccttgcatgattaggcccccaactatatgcgtcctcgtttcctactgtattcctccctattcactgtgatccatctcccttagccatctctcttcttcttcaaatacactgagctagcttgcacttcaagttttgaaatttcattttctttctgcttggaatgttcttccaccctttcatgtggtcagtttcttctgatcattcaggtctcagctcagataccagttcctcaaagagactgtccctgaataccctgtctaatgttccaacccccatatcaccttcaccttatcctgttttattatcttcagaacacttaccactatctactcttatttcttgtttgttgtctctctcttgtactaggtaagttatatgacagcagggacagcatttgtctcgcatacttttgtatccccagtgcccagaattatacctggtacatagtagacctagttctacaaatatttgtgcataaaagtataaatgttgttgcttgttgccatcagcattaacacttctcttaaaactgtcacaagttcctctgtagaaggtagttgaattgaccaggtccccaagttgcttgaattctgttagaaactacagggcttgaacacctggaggtggactctcacacagtcaataagagcaatgtagcctacaaaccccacattggtggtacaatctgtaattattatctcctttgctacggaagatgatagctaacaaaagcgttgatgtatttaacatttaccatgcaccaggcagatagtaagcactttacatgtattaacccatttaatccttgtggcaagtctatgcaatagatatcattatccccattttatagtcttgagaactgaagcactgtcacacagctggtaagtgggaggaatcgggaaaggaacctaggcagtctgactcaagagttagaatgtccacattaatttcacaatcacccccacgagttgatctctttgcaatttgcacatcattactaaagttatacacttgacttctagtgacctagtaattttgattttggtgatcactgcttgctaaacaagcccactcaacttctgtcatcatgactcatatcaggtcacgcttgctgttttggcaatactggatcattgtgaatgaggctatgttgtagtggaacactcatttgaaggcttttttgatggccttgctgaatagagtaaaaccttatagataatgagtttcaagagcttgtagcagaggatgaggcctggcttgggattgttttgaacgtaactgtttcctgaggctgcaggagtcattgcctatgaaagatcatccccaacttggtttgatttaaggttttcttgacattaaaatggtatgaaagtgatacacattcagtacactcctcaacttatgatggagttgtgtcccattatacccattgatattttcagtttacaaggcaaggagcatctgtatttagctactgctcttgaggaagcattctgtttcaggccaataggaagtccatgctgagttggattccaatagcttgagtcttagcagggatcttggggagagatgatgctatggcatatgccgtccaattttgccttcccaggagccagacccactacagcaaaatacagcatttacttctgacacccaccatacaaatattctccttccctctacttcctgctcaaagaaagataccaaataccaagaaaggaagaaaaaaaaggggggaatgttagcataagtgaaaactctgataatttactttatactgtagatcatataacatgtttgtgggttacatatttatattgcatatttatatcatttatattactactacatgatttagtaatataaatatgcaatataagtatgtaacccacaaacatgctatctgatctacagtatatagtaaaactgcatttatagtgcatgaacatgtgtgtaaacagcactaagaccatcctgtgtaaaaactgcatttatagttcatgcatatgtgtgtaaataccacatgcacatgtgtgtaaatgcacatgtgtgtaaatactgcatttatagttcatgcacatgtgtgtaaagacttttgggatccccttcccgtgtgtgtgtgtatataaaaataaatacatgcatttagatttccctacatgtattttttcagactggcagccaccaatcaggtcaacattacaacatgacagaaaactcaatatgttgttttaaatatagtgttatgataaatgcatatgtatgaatatagttacaagaaacaaagttgaactttttgtagatagatgcaatcactgaagtcttacagtgtctcgtgacatgtaggcatgcctacttactgttggaatggaacttctgcttttcagtttacggttttagctggggtgtcactaaagcacattgatgatcaatggtcactctaatttttctcttgtaacagacctttttgtttggtttgtttttaatggaatttgatgaagagttcaaatgtatttttgtagtgacttttttggggacagtcctacctactgtgtttagtagatttcttttttagataagtcctgcaaaatttatacttgcttgcctctaggctgcatactaccctttggaagggaggtgtacagagctgtcttgccaggtgttatgttaggccttaggatggcttctgtaaactgcaccaaagatggagcctacctgacatctcagagatgtttgccatctttggttgcttaattgtccttcactaagacgtgttaacctttgggttgttaggctgccatttaatgcactggaagaaaacgtgtcatgtggaaacttattacctcccccaaaatcatggtaaagtatttaccttctactcacagctttttctttatttaaaaatttctagcttaccagtatactttatacatcacattttaaaatatggattacaagatagtcataatttgctaggtactctgaagaccactattcccatggttatactttgagtttttgcactatctaaaatgaagtcacacataatccatttaacatgtacagacagaataaacatgtactttcttgagagaaaataatgtgtagaagttgagggattattttactctttgtaataatttttgcaattcaacaggaattagaacaagtcttagagtaactttgatcatctgattctgttgctttccttcataatcccaagaaagataatactgacaatggggcaggttggtatgatggttaacagagaaacctctgagaccaaatcacttggatttttaccccagcaataccatttcctaaatgacctcaagcaagtcacttgacctcttcctcagtttccaaatctgtgaaaccctggcttataggattattgtaggatacaatgtgttaatacatgtaaaacatctgttgtgtagtaagcactcaatgctagttgtgattattatttgtatggttgttgttgttggctgtgtgccccaaagaacagtatgtagccaatagttatttccccacatgtaattccctacttctcatgtaaatgcctcctatttgggttttgaatacagctctcaagaactccctactactgtgcttcttacccacttacaaaagatttccactattgggccgggcacggtggctcacgcctgtaatcccagcactttgggaagctgaggcgggcggatcacaaggacaggagatcgagaccatcctggctaacacggtgaaaccccgtctctactaaaaaatagaaaaaattagctgggtgtggtggtgggcgcctgtagtcccagctactcgggaggctgaagcaggagaatggcgtgaaccagggaggcagagcttgcagtgagccgagatcgcgccactgcactccagcctgggcgacagagcgagactccatctcaaaaaaaaaaataaaaataaaaataacaaaaacaaaaaagatttccactattgctcgttgacaccaagtaatccttacacccccaaccaaaacttattttttttaaagactatcggaatgactgataagaatagcatacagaggagtctttatatcaatactcattttgtgtggcacttcttacaaatcacttttttttttcacttgggcataagatacatgaagaaaatacagaggtgacagagaacaaatgctgccattatgagctacacatagcttccctttctaacaaagactggtatgggggaaaaacaaatgagaagcaatatgaaaaatgtatgtgcacatgtaaccatatacctttccaagagcacaaaatacttcttatgttctcatttaaaattaagaggatatttaaatgaattatcacaattctgtctcattattaaacttcttctataatatttcccatcattcacactagttcttaacattctttacattcttgtgttttttttccatatagtatatatccactgttaataaatcatattgttgaaaatcaggtaattttttgatgatttactataagtagttatagatgtccctgtatctcggcatctataactgtatttaaatgtatttgaggccccatttagcctaaaaatacttcataaaattaattttcaaggaaaaggatacttaatattataaagtaatagtatatttcataaacattatactatttcataaaaggaggtctttatagaaaattacatttaattttggttaagtggattatttaggcttttgataatgtaatagcctgtggcatattgttttatatatttttaacctgtatatagttttaaccttatacagcttccagtgggttctgaatttattcctttgtatttcttgtaatgtggaaagacatttaaaagttatttttctccagtggagaattgattcaataatatgaagttttatctaatgctctttttctgtgtgtatatgctttatggttgaacatgtggtcgattttagagtatttgctatgtgcagataagaatattgtatattctgtcgttgttgggtagggtgttctgaattcaggtcctcaatatcttggttatttttctgcctcagtaatctaacaccatcagtggggtgttgaagtctcccactattattgtgtggttatctaagtctctttgtaggtcactaagaacttgttttatgaatctgggtgctcctgtgttgggtgcatttaggatagttaagtctttttattgaattgaaacctttatcattatgtaatgcccttctttgtcttttttgatgatttttggcttaaagtctgttttgtctgaaataagaatagcatttccatttgcttgatgaatctttttccaactgtttactttgagcctatgggtgtcacagcatgttagatgagcctcttgaagacagcatactgttgggtcttgcttctttatccaacttgccactttgtgccttttaagtgggacgtttatcttgtttactttcaaggtcagtattgatatgtgaagatttgatcctgtcatcatattgttagctggttgttttgtagacttggttgtgtggttgctttatagtggcagtggtctatgtacttcagcatgttttttctgctggcaagtatctttcttttccatatttaggtcctttgaggatctcttttaaggtaggtgtggtggtaacgaattcccttagcatttgcttgtctaaaagtattttatttctcctttgcttatgacacttaggctagatatgaaattttgtgttgggatttctttttttaagaatgctgtatataggcccctaatctcttctggcttgtaatgtttctgctgaaaggtctgttgttagcctgatggggttccctttgtacctgatctcccccttctctctagcagctctcaagactttttctttcgagttgaccttggagaatctgatgactgtgttttggggattgtcatcttgcatactatctcacaggggttcttggaatttcctgaatttgtgtgttgacctccctagcaaggttggggaaatttttatggatgatatcctcaaatatgttttccaagttgcttgctctatctccatctctttcaggaatgcggatgtgttataggtttggtctctttatgtagtcccatatttctcagaggttttgttcagtttttcagttcttttaaaaaattttgtctgtgttgattcgaagcatcactcctcaaattctgaggttttttttttttccctcagattggtttattttgttatttatgcttccaattgcattatgaaattcctgtagtgatttttttttatttccagaagttctgtttggttctttcttaaaatggctaagtcatctttcaactcttggatcattttactgctttacttggatgcgtttcaaccttctcctctatctcattgagctttcttcccatccaggttctgaaatatatgtctgtcatttcagccatttcaatctggttaagaaccactgctatagagctagcgtggttgtgtggaggtaagaagacactctgccttttagggtcgccagaattgtattttgtttgtttttttcttttttaaaaaactttgattttaagttcagggctacatttgcaggtttgttacatagctaaacttgtgtcatggtgatttgttgcatagattatttcatcacccaggtattaagcctagtaccctatagttatttttcctgatcctctccctcctcccagcctcccttgacccataggccccagtgtatgttgttcccctctatatgaccacatattctcatcatttagctcccacttataagtgacaacaagtagtatttggttttctgttcctgtgttagtttgctaacgataatggcccccagctccatccatgtccctgcaaaggacatgagctcatctttctttatggctgcatagtattccacagtgtatatgtaccacattttctttatccattctgtcattgatggacatttaggttgattctgtgtctttgccgttgtgaagagtgctgcaataaacattcatgtgtatgttgtctttacaatagaatgatttatattcctttgggtatatacccagtgatgggattgctgagttgaatggtatttctgtctttaggtccttgaggaatctccacagtcatccataatggttgaactaatttgcactcccaccaacagtgtataagcattcctttttcaccacaaccttaccagcatctgttattttttgatgttttagtaatagccattctgactggtgctagatggtatctcattgtggttttgatttacatttctttaatgataactgatgctgaacttttttccatatgcttgttggctgcatgtatgtcttcttttgaaaagtgtgtgttcatattctttgcccacttttttaatggggtgatttttttcttttaaattactttaagttccttatagatgctggatattagaccttagatagatagattgtaaaaattctctcccattctgtaggttggctactctgttgatagtttcttttgctgtgcagaagctctttagtttaattggatcccattgttcaatgtttgcttttgttgaaattgcttttggcatcttcgtcatgaaatctttgcccatgcctatgtccagaatggtatttcctagattgtcttccagggtttttatagtttggggttttacatttaagttgttaatctatcttgagttaatttagatatatatatggtgtaaggaaggggtccagttttgatcttctgcatgtggctaagccagttatcctagcaccatttattgaatagggaatcctttccccattgcttgtttttgtcaggtttgtcaaaggtcagatagttgtaggtgtgtggtcttttttctgggttctgtattctgttccattggtctatgtgtctgtttttgtaccagtaccatactgctttggttactgtaaccctgtagtatagtttgaggtcaggtagcctgatgcctccagcctagttctttttgcataggattgccttggctattcaggctgttttacggttccatataaattttaaaatagttttttttgtagtcctttgaagaatgtcagtggtagtttaatggaaatagcattgaatctataaattgctttgagcagtatggccattttaacaatgttgatttttcatatccatgagcatgaatgtttttccatttgtttgtgtcatctctgatttctttcagcagtggtttgtagttctccttggagagatctttcacctccttagttagctgtattcctaggtagtttattcattttgtggcaattgtgtatggtggtctttcctgattttcctctcagcttgacagttgttggtgtataggaatgctagtgatttttgtacattgattttgtattctgagactttgcttaagttgtttattagcttaagaaacttttggctgagactatggggtttctagatataggatcatgtcatctgcagacaagatagtttgacttcctctgtttctattttgatgcactttatttctttctcttgcctgactgccctggccagaatttccaatactgtgttgaataggagtggtgagagggcatccttgtcttgtgccagtattcaaggggaatgcttccagcttttgcccattcagcatgatattgactgtgggtgtgtcatagatggctcttattattttgagccatgttccttcaatacctaacttattgagcattttaaacatgaatggattttgaattttattgaaagtctttgatacatctattgaaataatcaaggatattggcccgaggttttcttcttctgttatatctctgccaggttttggtatctggatgatgccagggtttccagaattcttacggtggttctttctcgtctgtgtgagctggtgtttaacctctgaagttgccgggtttttttttatatgggttttttgcttttatatttttttatttttttgaaggtttgtttgtggtataagttgggtttatttcattggcttcctttctgggtactttcaggtggccaaggctcagctcacctgtcctgggctgcatgctctaaccctaggtggctgggaccaggcctgctactttgttctggtttattgaggtcaagcacctgctgtgctggagaaggtgaggtgttcccattccaatggcaacaattcttcaacaggggctgccagcaaaagtgctgcaattgggcgtgggaggcacagaatgggtgctgtggcagctggggcacaggcaagtgtatactagcagggcagtgttgggctccatgggtgactgcagcaatggtatcgctgagggaagggctcccagtgtgtcagtgggactgtggttggtttgtgtgtgcatgggcgctgatgtggtggtggtagattcttatgcatgtgggccctggcagcgtggcttggggaggctgtagttgagtgcgcaccgttgaggggaggctgcaagtggatgctcactgggggaggtttgtcttcaaaaatactctgatgggaaggtggagactgtcagtcaatgatctatgacagtgaactctggcaaggattttgtcagggcagctgaggctgtgctgcaagcaggtgtggccagaggagatatcagcacatgggggtttgtttagatcacaccggcccaatcctgcaggtaagatagacttgcaatctccaggtccagttgctcacaaagggtaaaaccacctagaggagcatggtgagccttgggggatgggctcccttggttgtgctccactgcaactcttcccgtgccaaaccttctgggctccaagtatactggatttctgtctctaccaactctccgagcaattctccttgccatctcaaatgtccatggggctcataggggctcctgcatctagcattccagaggtccatgacaaaggtgaaccattctatgcctatttcactcaccccttctttaggagccgctagtggccaggaacaagttttggtgtttggcaaccccatggagtcttctcggcctcctcccttttcagccctggggcctgcattctttctccgtatatccactctcagtgccttcttcctgaagatctgttcgcagtatgcttgtctacttgattgtctggtctcgcttggtgggagaagcttttattggctgtgtctagtgtgccatcttggctcttctccttccaaatcattttttcaaggttccattctttccccactgttttgtaatgccacttctgtcatcatttccatacattcatggatctttttattactttcctattggtgccataacaaacttagtagcttataacaacacaaatttattatcttaccatcctggaggtcagaagtttaaaactggttggcagggctgcatttcttctcgggccactaggggagaatctgttccttgtcttttctagcatatagaagctgcctgcattccttggcatgtgccccacttccaacagtgggatcattctgacgtctactcctgtcttcacatcatcttctttgactttggccttcctgcctcctgtcctccagtctcctctcccgtctcctttctcctttccttttccttttttctttctttctttctttctttctttctttctttctttctttctttctttctttctttctttcttttttttttttttttttttttgacagagtcttgctctgttgcccaggctggagtgcactggcacaatctcagctcactgcaacctccgccttccaggttcaagtgattctcctgcctcagcctcccaagtagctgggattacaggtgtgcaccaccatgctcagctaatttttgtatttttagtagagacaaggtttcaccgggctggtctcgaactcctgacatctggtgatctgcctgccttggcctcccaaagtgctaggattacaggcgtgggccctgcctctttctttcctttttttttttttttttttttttttctgagatggagtctcactctgtcacccaggctggagtgcagtggcacgatcttggctcactgcaatctctgcttcccagattcaagcaattctcctgcctcagcctcccgtgtagctgggatgacaggcatgcaccgccgtacctggctaattttgtatttttagtagagacggggtttcaccatgttagccaggctggtcttagaactcctgacctcaggtgatccgcctgcctcggcctcccaaagtgctgggattacaggtgtgagcctctgctccctggccacttctttcttttaaagacacttgtgattatgttgcacccaccagaataatctcccagtctcaagatcagtgcattaatcaccactgtaaagtccttcttgccagatatggtaatatattcacaggagccagagattaaaatgtgagcatcttaatgggagagtgcatttttcagcctaccatagtcgtctttctggacattccattattattttcctgtgtttttgattcattcaccctaagcatacccattttataatctcaatcagatagttataccatccgaatatcattttggggagtttaatcctatttcttttgtctgctcactcaaagtaagatgtgtttcctcatgtgttgtataattttagattataaactcatcatctagggactctatctgtggcaatctcatgtggccttggttagtcttattccaccagaaagctttagccattgcttcccctaagtgtccaggagtctactcactgacccagaaccacttctcatgatattttatattttattggctaagagtttcttgtatcatatagtggtataatttcaaacccctaacatgtatgagggcagactactgataatattaataaatacacagtgtaatcttcctccattcagggatccacccaaagaaaaatgggttttttttgcttgttttctccctctttttgtacgtggatttcttttcttggttaccctttaactgaggcatagctctttaataatccagatattataagaaaatatctcctttcctacttactgccttgtttggatcttaaggcctctcctctccttatgtgtgcattaaaacttatgcacttagattactactgagatagacacactccctagggcttctgctgcatttactcatgtttactgctctagctttcagttcccagtttagttttggctactggagattttgtttacatttattgtaagtaaaatatctaggagttttccagagtcttccctgcttaattcctctttaacacttctcaatggtgatttctcttgggtttgtcatacatgcattacctcttgaagctgtttgtgttctttgtaccttaggtaggcaggagctgattttcgggggataattggctcttgcttagggacacttctggtttgctcacagttctaagtgtcagcattgtattattatcagtaacacctctactgtgtcaagatattactaatcttgcctctgagagatttttaatactatgatagagaaaatagtacattatcaaaatgttttttctgtaataccagttatgaagtgtaaaatacttaaaagaaaatacttttacctttattttcaacccaattaccctaattcttatttttctgttctctttctaggatgtgtgctgtgtttggtggaatttattgtcttcgccattcagtacagtgccttgtagtggacaaagaatccagaaagtaaggatgatataagtaaccttcatatatatatatatatatattcatatatatatattcatatatatatattcatatatatattcatatatatatacatatatatatatatatatatatatatatatatacatatacacacacacatatcccaaacacaagtgaaaaatgctgaagtcagttttaagaaaaagattcttcaaagatcctccttggtattaataacatatcaaccttgattaaaagtaatttgtgtttaggtcctccagaacaagaatagtgagttcagaatatagaaactaaattaatttccctgcaatatgcctatagctcctggtcatccaagcttggaagacaaatcatttcagctgccagggggtgggtgatgagtgatgttagttttccttgtggccttacctcctctaattgattttcatcagatgacaacaaagccctctgttattgcatttttaaaaatggaattcacctaaagactcatcagattaatctctgctgataatgcatgtcactccaagagaaaagactttaatgagtttttaggtagattgttgtcataaaccatgctgccctcttatctaaggataaattttttacaatagtatcaggcctataggctgctttaggattgaaataagaatttaccttttctttaaaagagctgaacaccatctgtttactgtgtattttatatttcagttataatcactggtctgaattagactggataaaatattctttgatttctgccttctacactgaaacttaaatattttagatccagttttagaaactatctaaattgcaatgtgtttttcttttttttacatgttctcaacaatctactgacctgtatttcttagatgattgtttttaggagtatatagttaaatagtatttttgaggttataaaacattttaatatttgaactggaagcttaaataatataaattttaagctgtttctttcattttacaaaagttttgtatcgtttaagtggcatacaatgtctattaacttcttatagactagttgtagtgaaaaaactagtattttgaattatggtgaagaaaatcctcaactctggaaatatgtaatgcttagatagtaaatttgctttagaagagtaattctgtagtataagataacattgatacgtattttaaacggcttgtaaagtacctttagcacttttatagaaggatagtacaaaatgaaacatgatagtttgcagagaaaaattaatccctaaaggcccaggatgttaacatcttgattcatgaagaactctgttgaagttaaggaatagttgtctttagacttctagaatcatttttctttgtgcattcattttgctacaagagtatgttcccatgacagaaagccagataatgaattgcttatttggtgtttatttgcttagattcttttacccttggggtcccatttcagtcccatgtgacatgaataatttgcatagctcatgtttgtttgtttgtttgttttttaaaggtatgctagtatagtaattgcctttgttgaactaaaggctaccttttccttacctttgacttagtttttatgacatgctctaaacagaggagctcttttttatgatctggtacagattccagttgcaacagatagctgaaagctaatggtctagagaccaaatgaatctctagattggtggttttcaaactttaatgtgcccaaaaattaccaggtaatcttggcaaaaatgcagatttctgttcttcaccctcagaaagtgaaattggttaatatgcttagggggaatgcagtaatttgcagttttaaagaaaaccccaagtgaatctagtataggaagtccttagattagataacactgatctgtaaggtaaaattgagggtttagtaaagggtactgtgttccatcacaaactgggggctctaggtcttaattcagtctaaggccgtatcaatatgaaactgccagatataccaacaatcaaatgtgaattttaaatagcagacagactgcttctaagaatatcttcatagaaagacatgtcttgttttgtaacttctaaggcatgagtaaaggttgtgtagcccttgaatgagaggagacttggatttccactagtgccatgaatgacagtgggcaaatcctttcctctggaccggatcctttatctgtaagatgaatgacatggactctgcagtaatctctggatatctttctagatttgacatgccttggttgagttcttagatagttctttggtaatgttcttagaaagtacttggcttttccttatttagaaataaattatcttaaagtattttatatgctcaaatgtaagccattctcacataatgcatcatcttcagtcccagtgagaaatttaaagaagttgaacaacttggatgtgcctgcttttatgaatataaattaaatagcacacagtcttcttgtgctattaattatattgttatattactagaaccccagttttccagtgaacatcatcttcttgtccatcttgttttttcagaatgcaatgattttggattctgtatatgaatctcttcctggaaaatttattctaagctataattatttatttctgtaacttgccagtttttaaaacttgacctgtaatcatagtactactgtcatctacaatattctcactatactaaattgcttaagtgatctttaaaagttttaagactcaagcaatacttgaaaagtataagttcatatttataccttcagtaataattaccatatttatattaaatttttcctctttaaactagcaagtcaaatagtctctataaataaaagctagcattgactgaagttggctcaggtcagcgtatctttaccaaacacagctttgccattcaaaatcaaacatacaagagagataaccagtaataggagatattttgttaggacttgaacataaagtgagggatagttttttgagggaaaaaccttgacattgtattaggcaaatccaacatacatttctttttaaggattcaaggctggcttaaacaattgttatgttctaagtataattagggtactcactaaggaatctgcaaagatttgcatttgtctccttatggtttcagtttgcctttcttttcctagttttctatatggaacacttgacatcctctctcctctttaggacagttaagaactacttatactttgagtcaaagttctgagtttattctgtgatcccacagactacatcagaaccctctgtcagtctccactccccactgtcacatcccctcgtatgatcattttataagttctctataagaaaaggcaggatctcactgttgtatctccagaaccaaggcaggttcctagtagccattatactgaataactttgagttaaataaatgattaaagattaaagactggctataaccctttttgtgcttttctttgcactctccatttaggaaaactgagagaggcataagggatcatagcattgagtttaatgtggtgattatacatcaaaacactgtacaaactttgaccgaagaaatagggcattgaggaggcacactaaatcatggtatatggaatatgtaaccaaatgcatacctattttcagccaggttttatttttcatttttgtttgattggttctgctttcttatttgagaggatgtaggtatgcatcagtggttcttttctaaaccttttcactaaattctaatactgcatgcttccgttgactgtttttagaaaaactgaatgttctagttgaacagttttcttttcctttgcagctatgctgaccaggtaaaactccggtaaattagatctggccatttagtagtatagtatttgatatattggtagggtagagatgaccttggactaggaccagatacatctataaccaatagttgtaattaattacttcagctgctgtttcctgtgtacttcacctgtctcacttaccagctttcctactatgactctttcttgatgtcaggaatatatttttctgatgtcaggaatatatattttctgatgtcagatatatttttctgacttttcttttctttttttctatttttgagacagagtctcgctttgttgcccaggctgcagtgcagtggtgcaatctcagctcactgcaacctctgcctcccaggttcaagcgattctcctgcctcagcccccctagtagctgggattacaggcccgtgaccacgcttggctaatttttgtatttttagtagagacgggttttgccatgttgtcagggcagtctcgaactcctgacctcaggtgatcagccggcctcagcctcccagagtgctggtattacaggcgtgagccaccacgtccggctgtctatgccttttctagatacttggaagttagtaatgaatagaatgtgagaccaagtttgaggtgactgactgttaataccatttgtcattgctgaagcactgattttagcatggcctgcttgcaaaatggtagtggtcatattctggatacttaacgtctgccaacccccgtgctagttgttatggggataaagaagtgaatgaaacatggaccttgcccttgtatacaaggagacttcagtaaagagtacagctctaaagttagatagattggatttggatcctgactttgtcactagctgtgtgtacttgagcaattgtttaactctctgtgacccagtttctttatctagaaacttggacaattgactacacctacttcatagggttattataagtattaactaaatagacaaaacttgtagaaccatttgttacacattgtaagtgctagctatgttagctaacaataactattaatataattggagaccttggaatccagtggtgggggagacctattgtgaagattcttctgtgctatgctaataaggaatttggactataatcagaggtaacaagattaaatttgctactttaagttagtaattctggcaatgatttggaagaagcactgtgatggaaagtgattcttttcctcctaaatcagagattctgtatcgtttttttcctgtctctacactattcacaaagtacggaatacttcattaaccatccatccattcacccatccatgcaacaagtattatttgttttctttttgccaggcactggggatacagcagagaataagacaatcagggtctttgttctaaggaacttacagtctactgggggacattacagaacaactaaatttataagataattgcacattgagatctgttcggtatgcagatctggccccctccttatttaaaaagcttcagtgcctttatataatctcagaataaagtgtaagacctttttacatgacatatgacgggtgagactctgtaatctggcctctgtctccctgtctaggctcatctctcttccctacttgcttttcattttattgtcacataatactgatctgttcatgggtctctgtacctgctgttctcttacttgcctttgtaaccccgcaaattctgcccttctacctgagataactgtatccttatttgcttgcttaactgtatgttatcctttaaaagcaacaaatgtgtcacttcctccaaagagcattccctgatactccacccctccaccataagatgagttaggtacctcttctagtactgtgtaattccctatccttatcttttatcactggactttgctattgtcttaaaattgtctctgcctgaatcttcaaaaattgtctctgtctgaatcttgtcctttagggcaaaacatttttattcttacctcttagaacagtgcttggcacatggttgttatgctatacatttatgttgaacaaatgaactaccaatttgctagcaggtcattatcatattagacattgtaagagtctaaggcagtatcagtggagacggagagaagaggctagtttcaggaagtatttataaagcggaatcaaaatgttatagcagactagatataaaaagagatttgaggtaggaaaactgctgattatgccattgcctgacatagggattccaagggagtgggagcaggtgaggagccatgataaactcagtttgcagcatgctagttttaaaaaatgcttggctaataatactatattatttccttgagatttggtaagagcaggtattaagttcctcatgacacccacagatggtaatgatgggtggcaatagatgtgttaattcatttgtggtaatcattacacagtgtatatcaagtcattacattatacacattgactatatacaatttttgtttttcaattaagtatttattaaaagggagcttggagtctatccagaaagtagtagataatagacaattacaaatatggatacagaacttaacagaagtcagagcctaaaactatagatttgaagttatttgcctgctaatggtgtttagaactagtagagtgtttttcacccaagaaaaatgagtgggaagcatttgaaatggttttatggatgaggtagcatttgaactaatgtgtttgagaaagctcagaagggcatagtgactagggaaaattattttgttttcttcagtgattgagaatcttctaatttccttagtacattttcctttaaattattccatatgtgatttctgctttctttatcataaaattagttggtatattcattctgaagatcacagagattgaatacttgttttagtgttatttttcctcttctgggccaaattccagattttgagttttcatcttactattttcttcctcatcatcattttgctatctacacacttatatcgttgaaccaataactgaataacttgtgatttgttgatttagaaagcttagctctagaaatgttctgtctggcttgagtgttttgtatggtcagcttggtcattgtgtccctgtaactggagacacctgttacgttcctcctcaagttactatttatgaggctcagcaaggccctcaactaaatcttacgtggtttaatctttcctgccttcctcaggtttatgtgggaggggtattttcatgactctggcagcactgtttattttgctgctttctgttaattaaatgtcatctaattttttatatgaatctttataatacaaagactaaatttagatctaaaatcaatgtttttttattcattgttttcccaattatgctgaatatatgacagtaagttaaatgtctgagaggaaaacatatcttatcacttgcttaaacatgtcttgatttgagcagttttgcttaagcctagagtcttagtacttcagcgtgatattatcaggtgagtcatgttattatcatctaccagactgagacttgggcatatgtgaccatcacctcaatttctgcagaaacaaatattttatctgtaccaatagcccttgatttttctccacctagcacaacataagagatacaacagtagcagtggcacgcttgacagtgatttttttcctgggatttgggagcttatcagaatctccaggggtactttataatttcaaaaagtcccccaggtgtgattctgatttgcttccttttcctcctcctgctctgagaatcaccgtttctttagaagcatcagcataaataggcacatgtattagtatcttctcctggtatggttgagctccctaactcccaaacccccatacttgccttttgagtgatctccattagttctttctaatatcataacttttgaaacaaatgtctgtcaccaaaggtatggctaccaccaaaacaacctcgttcatgtttagaagcctacaaagcttgagggccaggtttaataatacagtttaaatgggaaccctttttaaagacttacactcaggtctgagatttatattaacactgaccccctcccccagttttattttaacattttatgatgaacattttcaaacttatactgacatggaaggaatttcaagagaacacctgtatatccacctcctggattctataacattttaataaacttgttcagtcacacgtctacccaaatattaacccctctatccatgtatcgagtcatctttttaatgcatttgactgtgaattgcagatgtcagtaaaatttcccctaaatacttccagcttgcatattattacctggagctcaatatttgttaagtgtttttcttttgatgtaaatttatatacagtgaagggtccaaatcttaagtgcttcttaactgagttttaacaaatgataaatctgtataacctaagcccctatcaagatatagaaatttaacaaccccttttttctgcccagttatttcctcttgactttacatagtctctgaattaaaggtaagaaaaagatttgtcagtgcttacaggacaaatagagattgatgtttaatgacagcagatttctcttctcaattgcctgaagcactttgtgtttcaaatggtatatgagtgttttaaaatagaagactgagtgaattacttatattttcagtttttaaaacattattttggagaatatcagatgtaaatacttcagatctattttcttaagtattttataaggcaagagctctagttcaatgaaatatgaggaggtatgtatagaaacagaagtgtagaagagaaagaaggtggagatgagatggaaaaaaatcatgtaaatattaacgtaatattacaaatgttatattaaaaggtggttaattggttaaaatatctattatgtacatgtaacatcactagacatcatagactatccttacaacagtgggatgccatttattaaaaaataccagcatattataatctgcctttaggaaatacaaattaaattcctctcactattggtcttgagtgttagtcattttatttttaatgcctttattcctggaaaatatcacttatatggcttatttttaaagtgaatgaacagattttaacttataccagtatattttacagtatgcttttggaattaatttgcttgcatcttatgaggggcaacacataagttcatttctaataaaataattctgttccccaaaggagaagctgtgacacaaataaattgatatttccataatcaaaagatatagcaaacacacagtcatttgcatatagttcctgaaatattgcatactggctttgtcaatgctggtaagtccatttcaaggatgttgcccttagtccattagtttggataatgagccctataaagtacatttataacttgtggcactgcaaggagatggattctaattttcatccttttatctagacacattgaaagaaggtcaatggagggttctatatgattcattgttccaacacatatcagatgacagagacctgataatgtccgtgcataagtgttttccttatttggaaacaacacttcaaagaaatctttctatgatcatcctttgaagtaaagtagaaacagatattaaaagaagctctatcacatttttctgtttcaaacattatccaacacgtgaccatatagctattcttggacaaaagagaaaccaacatttaacagaaaaataaaaacctcgtaaaaggcctttacaggctctgaatggtatagcaaggtatttaatcaatttttctctctttcttttcttagagctgtgaaggggggaaaaaaaagcctgttttctaaacaaagggaatgcttttatgttcctaaatattaggaaatttatggtttactataattcttatcctgactttattcttattaatggcattcaaaatacatgtttaagttgtattccatgttcattttgtactttaaaagccctcaaaatagcaacaagaatatatattctgtcatttactgtcagttttgtgtcagaaaacatggaattgtaggcaagttttaaatcttgtcttcacgtgaaattcattttagattcaaaattggtagccgattacattttctcaattatttaatcattaatatgaacttttatggtatgcttatcttctttatagatgtaaagcaattatagatcagtttggtcagagaataatctctgagcatttcctcgtggaggacagttactttcctgagaacatgtgctcacgtgtgcaatacaggtaaggccccctccacccattagcaagcgaaggtaattttattgacattcctgtgtaattctgttcttcaagtaacatgcaaataaatgccaaaccaaagatatattcaatatcttacttcacttacagggtctggttttagggaagcctagcataatttcaactcctttgcttcagctggggtttgtctgtaggtcaggcattcttctttcatgagccaaggaaagattaaagccgaacttgacttggttttgggaggtgacacttttatcctgacttaaatctttgaaacgtgccttctggtggttatataactataaacgaaacttatccatggaatcagaattactgcttcactgttttgtgcattacaggcagatctccagggcagtgctgattacagatagatctgtcctaaaaacagattcagatcaacaggtaaattcagtcctatatatttttaataaaagttgtatatatgaagatgtttcggtatatatatacatggtgaactaatcactacactcaagctaattaacatatgtctttacatagttacctttttttgtggtgagaacacttaagatctactttcagcaaattttaaatatataataccatattattaactgtagtcttgtactgtacattagatctctaaaacttattctttttgtgtaactgaaagtttgtaccctttgaccaacgtctccccattttgcctagctcctggcaagcaccgttttactctctgcttctatgaatttgaagctttttgtatttcacatataagtgcaatcatgcagtactttcctttttgtgtctggcttctttcacttagcataatgtcctccaggttcatctatgttgttgcaaatggtaggactttcttcttttttaaagattgaataatattccattgtttatacatacacacaccccatttttaaaaaacccattcttccattgatgaacacttaggttgtttccaaatcttcgctgcaatgaataatgctgcattgaacatgggagtggtggatcataggataattctatttttaatttttttgtggaacctccatactgttttccgtaatgtttgtatagatttgatttgcattccaaccaacagtgtaaagggtctgcttttttctgtatcctcatcaacacttgttatgtcttgtcttgttaataatagccatcctaacaggtgtgagatgaaacctcattcagtcctgtgctaataacattgttactaacttaatctacatggtaatatgtataaatcaatactggcaaaatacagcgtattaagctatatgtactaaagtttgagtatcccttctccaaaatgcttggggtcataagtgcttggattttaggggtttttttggggcggggggtgggtttagagcattttggatttcggatttttggattagggtactcagcttgtcatattttttaaatgtgtttttaaaaaaatacatgatggcaataatgtaatggcattggtttcttaaggatttccatccagtggaacaaatagttgcatcttatataacagatttattttaggaaaatcagactaaatactagattttgatgattatttctgtgaaattgaaaatacattgttatggggagaaaaagagaatccccagagaatacatttaaaaatctggtaggaaaagacagtagccaaccctatggcaatgactataagtccactgttaggcctggtttgaatgtatttccacacatgtccccggttatggtatttacttaccaccattgttcatttcagtaccctcttctttctccttacccccagttccatagaggaatgtcattatgcctctgatttttcctcagtcagacctcttaaattccagggtaccagttctccttctgaccatattttatagtgattgataaactcaccttactcagtaggcgtgactttcagttctgtatgccactgctaaaagtaggctcctaaagttctttaagttgaaagctgcttcttatgtaaaagaaatatgtgagtggataaagtcaattcatttgtaacaatttttattgctaataaatgaacgttatatacaaaaaagtcccccaaatatacttgttatatgtgtaagcataaatactttcattaagccattcagcaaacaatgagtgccttttaccttccagccagtgttgctgggttctaaggagatagtggtcactatgatagcatctctgctctcaaatagcttacggtctggagaatacagatactgataagtagcaactgtagttcagagtgacaagtatgagcatgggcgggtagaagaaatagtacagcagctattatattacttactccactgtcctacaattactggtttattgtctgtatctcccagtaagctatgaggtttgtgagtggatcaaagagtgccagggaggcagaagagtgaagagagcaaatagagataactcttggaggaagctaagctgtgaagagtaagagagaggaactggtctttgaagagggatgtggagatgaagagggtgtttctttactttaaaagattagtatatatttcagctgatgggatgaagccagtagagagggagaggttgaagataacgaagtaagaaggaggataattgatagatcaaggtccaggcaaaggctggggaggctaaaattcagagaacaggcaaaaatgttgcccttggatgggatgggagacacgttgaaaccagagggtgaatgcatttgtagatttgggaattcacatcttatgggttacatttattctttaaattataaacaaggtgaggtcatcttttgagaatgggggtgtgcaaatgtggatgggtagaagctcaaggaaagatgtaaaataatcaccataaggagttggagagtgtactgtctcatggtcaaattgctgggcaatattaatggcccagttgagtctgaaggtcatgaatctatagtggcattaatctgctcctatccttccagctctttcattctcttacccccacccagtctgttaagagacgtacaattcctcattccctgtttcttttcagtttatcatctgccttctgcccttttccttttccctgtgctagaccccatagtaaatcttctgaattgctctttgtctgacactctcagtacccatgttgtcatgtcctttcactacacccacagaggaagatcccattcctgagtcaggctgtaatcttcatctggatcactgatggctgcttaagaaaaccatgcaaccagacagactaaccatgccacagacacaagggtgccagcgttattcagctggaccttcagcacacaccaccagtcagttcttccactggcctcagacagcccctttcccttttccctcagtgcctaatccaagtcttcctgattttacccaccctgcttatcccctgctcctctcaacctgctgcccctcccccaccaaccttgcttcgctgaaaatagtgaggctgtccaccacgcgcagtagtccttgacttcctgccccaccaccacgtgtgtacttcagcccaggaatgaatcaggaggctcccctccttgttcaaagccagcccttttgacaagtgctcttgtacacgcacacacaccaccctttattgcctgctctctctcctgtatcttcagcctctccccactgctgctggcaacattttttttaaacagacacagacacacacacacacacacacacacacacacacacacacgcacacacaagcattttctatttcatatatgctagtatatatatatatactactttctatttcatatatgctagtatatactttcatatatgctggtatatatatactttataatatatagtatatatataatatatatattagatatatatgctatatattatatatacttattatttatatattatatatacttcatatatgctgttatatatattatatattatgtaattaatatataatatattatgtaatgtattatatattatgttattatataattaatatattatatattatatgtattatataattaatatatagtatatattatatgtattatatattaatttcatgtattatatattatgtattacgtattacatattatgtattatatatagtatgtattatatactatatataatatgtaatacatattatatactatatataatacgtattatataatatattatataattatatattatataagtttgtactcttggcttccatgaaactgccctttggttcccctcatgactctggctgtttcctctctacttctttagtgggctcttgttcctttacccagtccttaaatatcagggctcctcagtatttttccctcagcccacagtatgccttgctttgggcatactcactagatgactctgtgtagtctcatgatatcaattctgcataaatcttggtgacagacacttctgtatctcccaggagtgtctggcccacatgctaagcttcctgctggacatctgtcaaatggaatacactcagaactgaactcaccatcttccctccacaaactgctcctcatccagtgttccctacttctgggaacagttctgacatcctttcaatggcaacttcttccttccctctctgacatctcttcaacttcacgtccttcaatgtacttcctaaaagttgctttgatctgccttttctcactgttcagttaggttctcatcacctctgacttgtaattggtcaccctgcctctcatcttgtctacttcaaatctgccttctacatatccttcagagtgatcagtctaaagtgtgtgtcctgattgtctttctttgttccctgtagagagttttcttctttcatcttctctctttttttttttcttttttttttttttgagttgtgcagtatagatagaatgatgagacttagagggaagaataggtgtgggtccaggtaaattttatggaagtgatagtagagggttgagggaattcttttttgatggttttttatcatctctatgaggtttgagacagttaacttctcagagttcaggtgacggaggtactgtagtaggaggttactaattgcatctcagttaaaaaaaaaaaggtgatagtcgtagaaatcaaaagacgtccttacatgttattgcagtcattaaggtacttttccaattatggtcatgtttttagttgtactcatttaactattgttcaacattcaatgtcttagtggcttctatctctttaatgccaaagtacattttctatcatgaacaaagggagttaagaggaacatggagaaataaatttttgagacattttgaggctagaaatgcacataaaagtaggatagtcatggttatcaaaataatttctatgtaaaatttgttttaggtgtttcctctttgggccatcactgtgacattctcagtcaaaatgtagcatagcacttatagggcaaagtgcaaatgggcttttcccttttgacaagtattttctatgtgagaggataaaatttcctcagatgaatattagtttgaggattagtattgaaactttaggatctacaaagaaacattgacctgggtcgggcgcagtggctcacgcctataatctcaatactttgggaagccaaggtggctggattgcttgaggtcatgagttggagatcagcctggccaacatggtgaagccccatttctacaaaaaatacaaaaaaaaaaaaaatagccaggtgtagtaatgcatgcctgtaatcctagctacttgggaggctgaggcatgagaatcacttgaacccaggaggcgggggttgcagtgagctgagattgtaccactgtacaccagcctgggcaacagagtgagactccatctcaaaaaaaaaaaaaaaaacaaaaaaaaacattgacctgaaggtcatttaaagttttaaaatataaagccatctagcgtatcattaatgcctaggatagcatactacatataaataaatagtacttaagaataattttacattttacttttgattctgaatttctagttttattaatggagtctttaaaaattgttttcaaatgttttgatatatatatagtttgactgcttgcttcaatataattggaatgggtaacatctttaattattaatgctaactgctgtttttagccattatgagtaatcaagattgatttaatatggtctgatttcaaacagcaaaatacacatatttcagaactaagaagtcataattgtatcctttgaaaaatacagattgagtatcccttatctgaaatgcttgaaaccagaggtgtttgggatttcagattttttcagattttggagtgtactagttgaatgtccctaatctgaatatctaaaatctaacatgctccaatgagcatttccttagagcatcatgtcggtgctaaattttggattttggagtattttggaatttagataatggttactcaacctgtagtaagtttatagtaagaaacctatagtaagtaaggatttaataaatattaaagatatttaaaagttattatctatgagaattatgaaaatgatacataaatatgtttcaaattctgttccaaaattaaatccttacaaggcatatttttttcagacatgatgtttgaaaaagatactcagtttagaagttaacagcattttaatgttagaagaatgaaaatgagatctaacagctgtgtctgatactttatttttgctttttagatttccattttgacagtgccagcagaggaaccaggaacttttgctgttcgggtcattgagttatgttcttcaacgatgacatgcatgaaaggcacctgtaagcatagtagagtggttatttgtattttgtgtttgtttagggggtaaagggggcagttattacagttgtgaaggttgtatttgtagagattttcttacttttttattattcacagtttttgtttatataaaagatggttatagagtaagtcatttcacaccatccccttacctataaacatttcagtggctaaatcttcacaagcatgatgttttagttctccagttaaggaattttatgactttcaattctaatttttatttagcttattgaaaacctggttgcataacattttttttattgttaattttttttctttactttcttagtccatttgggctgctatgaaaaaataccttagactgggtaacttataataaacaatagaaatttattgctcacaattctagaggctggaaagtccaaaatcaaggtgccagcagattcagtgtctgatgaggaccctttcctcataagtggcaccttctgtgtgtcctcatacaggcaaggggataaaaaagcttccttgaacccttttttaagagcactaatcccatttatgagggcagagctcttgttacctaaccatcttccaaagcccctacctcttaataacttttgcattgtgggtctacttgaggtattaagaggtaatacttttgtattgcatatgtcaacaaatgaattgtggggagacacaaacattgaaaccatagcaccttgaattctaaattctaaatccaattactgaacttttttcatgtataaattttcaatgtattttgtttatttatgagactaaagttaaggactactttacctgctctttcacttatttgtttcaaattttttgtttccagcattagatatcatgcattctacaacatatttcttgaggctatttcagtaaataggagtcaataagtatacattatacatcactgtgtctagacctaagctatgtactataagtattagaagcagaaggtgagatacctgatttgaaatgctcataatcttactgctcacctaatggaacaagactatttattaaccaagtacaacatattgtgctaggcatttcatggtacgtaaagatgaataagatattcccttaccataggagattcacagtctagttgaacagataaaacaagcacagaagtagctggaagatgcaaaatatgagaggtaccaacaaacagtgtactctagggattcataggagggagacataatatcattaactagaaaaaaattttttgtaaaaaaatatttgagtaaacgtaagtgttactcagattgttatgtgagttctgagaagcaaaaaaactaatatggttttgcgtagtcacaaggaaaacttcagtggggaaatgtagagctactacttaaaaatgggaacatgtggtcaggcagaaaagtgggaagtctgatgccagcagagagggttaagaaaacttttcaacattgctataatcctaaatttcctttggaaaagtagctcagaggaccatttctccttttatagtgtattagtcccttttcatgctgttagtaaaaacctacccgaaattgagaaggaaaagaggtttaattggaatcacagttccacatggctagggaggtctcagaatcatggcaggaggcaaaaggcacttcttaacatggcggtggcaagaaaaaaatgaggaagaagcaaaagcggaaacccctgataaacccatcagatcttgtaagacttacacactatcatgagaatagcacaagaaagaccggcccccatgattcagttacctccccctgggtccctcccacaacacatgggaattctgggagatacaattcaagttgagatttcagtggggacacagccaaaccatatcattcttcccctggcccctccaaatctcatgtcctcacatttcaaaagcaatcatgccttcccaacagtcccccaaagtcttatttcagcattaacccaaaagtccacagtccaaagtctcatctgacacaaggcaagtcccatctgtctatgagcctgtaaaatcaaaagcaagttagttaacttcctagatacaatgggggtccaggtattggataaatacagccattccaaataggagaaattggccaaaacaaagggtttacaggccccatgcaagtccaaattccagcggggcagtcaaattttaaagctccaaaatgatctcctttgactccaggtctcacatccaggtcacactgatacaagaggtgggttcccatggtcttgggcagctccactcttgtggctttgcagggtatatcctgcctcccggctgctttcacaggctggtgttgagtgtctgcagcttttcctggcgcaacctgttggtggatctgtcatcattctggggtctggaggacggtggccctcttctcacagctccactaggcagtgccagaataggggctctgtatggggcctccaaccccacatttcccttccacagtgccctagcagaggttctccatgggggccccacccctgcagcagtcttttgcctgggcatccaggcatttccatacttcttctgaaatctaggtagaggttcccaaaccccaattcttaacttctatgcactcacagggtcaacaccacatggaagctgccaaggcttggggcttgcacctctgaagccacagcctgagctctatgttgggccctttcagccactgctggagtggctgggacacagggcaccaagtccctaggctgcacacaatatggggggactggcccatgaaaccactttttcctcctgggcctctaggcctatggtgagagaggctgcagtgaaggtctctgacgtggcctggagacattttcctcatgggcttggggattaacattaggttccttgctacttatgcaaatttctgcaacaggcttgaatttctcctcaaaaaatgtgttttctactgcatcgtcaagctgcaaattttctgaacttttatgctctgtttcccttttaaaatggaatgcttttaacagcacccaagtcaccttttgaatgctttgctgtttagaaatttcttccaccagataccttaaataatctctctcaagttcaaagttccacaaatctctagggcagggccaaagtgctgccagtctctttgctaaaacataacaagagtcacctttactcgagttcccaacaagttcctcagctccatctgagaccacctcagcctggaccttactgttcatatcactatcagcatttttgtcaatgccattcaacaggtctccaggaggttccaaactttcccacattttcctgtcttcttctgagccctccaaattgttccaaccctctgcctgttaaccaattccaaagtcgctttcacattttcgggtatcttttcaacaatgcctcactctacggggactgatttactgtattcgtctgttttcatgctgctgataaagacatacccgaaactggaaagaaaaagagatttaattggacttacagttccataggctgaggatgcttcagaatcatggcaggaggcaaaaggcacttcttacgtggcagcagaaggagaaaaatcaggaagaagcaaaagcagaaacccctaataaacccatcagatctcttgagacttattcactatcacgagaatagcgtgggaaagaccagcccctgtgattcaattacctcccactgggtccttcccacaacacatgggaattctgggagatacaattcaagttgagatttggctgtggacacagccaaaccatatcatatagtgatttgtgctacaggaaaatcttcaccatgacagttgttgttattttctattattactttaactatttttcatgtctttttatctgtgttagcttcttagatataaaataaaactgcacctattatggtttttgtaatttgtattttatgtttgtgaatattatttttcaaatttccatttttagtttagattcacggagtatatgcacaggttcattacaagggtatatcgcatgatgctgaggtttggtcttctatttatcctgtcactcagatagtgaacatagtaccccataggaagtttttcagccatttcctcccttcctccctccttttagagtctccagtgtctattgttcccatctgtatctccttgtgtatgccagatttagctcctacttgtgagttcatgtaatatttggatttctatttctgtgttaattcacttaggataatggcctccagctgcatccatgttgctgcaaatgacatgattttctttgattttatggctgcatagtatcccatgctgtatatgtaccacatttttttaatccagtccaccgttgattggcacctaggttccatgtctttgctatcatgagtagtgctgtgatgaacatgggagtgcatttttttttctttgtacaatgatttcttttcttttggatatatacccagtaatgggattgcttggttgaatggtagctctgttctaagtttttagagaaatctccaaactgctttccacagtggctgaactaattcacattcctgccaacagtgtataagcattcccttttctctgcagcctggacagcatctgttattttttgcatttttaataatagccgttctgactggggtgagatggtgtctctttgtggtttgatttgcatttctctgattagtgatgttcagcattttttcatatgtttgttggctacttatgtatcttcttttgagaagcatctgttcaaatctttgcctgctttttaatgggatggttttattcttgttggtttaagttttttatagattttggatattagttgttttttggatgcatagtttgtgaatattctctcccattctatagtttgtttgttcactctgttgataatttcttttgctgggtacatgctctttagtttaatgaagtcccatttgtcaatttttgtttttgttgcaattgcttttgaggacttggtcataaattgtaaatagtcttcataaattgttttgtaaattatttttccatttgtcatattttaatatccccagtctaataattcatgttcactgttgataatttggaagatatgaaaaagaaaagttactataatccctctaccaaataatgataaatacccttggtgtatgattctttgtccttttttctttgtatgggcatgcacatacattttcataaaatgcaatattgttttatatactgttttataatatgtttttaaataaatgtagtacaaaaatggttttgcatgtctgtgatagcattttcagtgattttggttatgccatttaaactgaagtgagacctcaattttttcagtgatgcttggtagaagtagagcaattattgtctcaaagttttctatcttgctaagatatggtcttttgctagagcgtgtaggtttttgttggggtttttaaaatctgagaccattggtgtttccagttgtcagtttctatggctcttacttggagatatatgatacaaaaagaaaacccaggggactctgccattttgctctttggtcccaagttctctagccagtctgctttcttcgttccagctttcagagtcttgctatgttggttttatatattatgtctaagatttttagctgtactcaggaaaaaccgggataacctcttttattctttctggatgtggaagtctcaaagtgcccccaaagttatatcgacttacacatccaatggcagtttataaacaagcatgtctgttttcttcaaagcctcaagagcactgaatattatcttatcaaaactcttttgccaatttgaaaattgaaatattgtgtttaaacttgcatttaataactcataacgttatgagttatgagctgtaccttggccccttttagccatggctagagcagctgggatgcagggcaccacatccttaggcttcacacagcagggggccctggcctggcccatgaagccattttttcctcttaggcctccaggcatgtgatgggaggggctgctgcaaaggtctcttgacatggcctagagacattttcaccattgtcttggtgattaacatttggctcctcattacatgtacaaatttctacaaccagcttgaatttctcctcaggaaataggtttttcttttcaatctcattgtcaggctgcaaattttccaaacttttatgcactgtttccctttcaaaaccggatgcctttaacagcacccaagtcacctcttgaatgctttgctgcttagaaatttcttccaccagataccgtaaatcatctcccttaagttcagagttccacggatctgtagggcaggggcaaaatgctgccagtctctttgctaaaacataacaagagtcacctttactccagttcccaacaagttcctcatctccgtctgagaccacctcagcctggatttcattgtccatatcattatcaacattttggtcaaagccattaaacaactatctatggagttccaaactttcccacattttcctgtcttcttctgaacccaccaaactgttccaacccctccctgttacccagttccaaagtcgcttccacgttttcaggtatattttcagcagcgccccactctaatggtaccaatttactgtattagttcattttcatgctgctgataaagacataccagaaaccgggcaatttaccaaagaaagaggtttataatggacttacagttccacgtggctggggaagcctcacagtcatggtgggaatcaaggagcaagtcatgtgttacatggatggcagcaggcaaagagagagagcttgtgcagggaaactccctcttgtaaaaccatcagatctcatgagacttattcactgtcacaagaacagcatgggaaagacctgtcaccattattcagttacctcccgctgggtccatcccacaacatgtgagaattcaagatgagatttgagtggggacacagccaaaccatatcaccatagtttaatcagtttatcagtacaaaactagacaaatggactgggtttgggttttttagtcttaatagtaaggcttacaccaggaaggttgactgagaaagttaagtttcaatttattatttatactatgccttgttctcaataaaaagagaagttaatgttcatttaaaaatctagtatgcattctttttaaaataacattcattactgtagtagtgctataatagagttaatgtgtaatatataacaagacttaagaaatacactgagataaaactgatatttttatcattcacttgttcttattaaagcttaaattctttttttctcctcctttttcaatgcttttggcctgttcatagacattcaggagcaatttgtaacttggacattaaaagactttaatgatatattttcttgctgctgccctaattgagagtcactgacgtcacaaatagttgcaagttgttctgttctcagtctgtcttctgaaacaactagccttataatctcatagaaggctttaaaccacctttttcttttctattgatttctttctgtttcaagtcagaaaaaagaaaaagaagcaaatataccctgtgtttattttatgtatccaaacctgttcgtaactcatttatttttctctttttaagctccccaattatgggcaaattatatagtttagaatgttacacagtcattctctttcctaactacttttacttccaaatctcttttaagggttttgactttcctataccttttgaataaagcatatcctgagcacaatagaacatgttttaaaattcacataattgtttctttacagaataatgtagaaacataatttcattattttcctggtcaagcaccaaaaactgaaaatgctaaatatgcttattatgccataacatcccacttttggggggaaggatgtgtggaatttgacattactcataattggaaagaaatgtatattcagaacaatttgtttcaaatagaattcttggtggaaggctttttaccattctatctgaatgttgttatttatatatgtctacattagctatgtggtggaattctcatatttgtagtaattatgatgttgaaatgtttgtgatcatccatttgatcatggttttgtagaaatcaaacaataaaatcgtgtttaagaagaataaattttaaatgtaaattttatatttttaaaaaatcattaactctaaatggattttgttgtgacttattttcccttcaaacaactacttaaaataagtggacaaacacatctatacatttaaactttggttccattgtataagtgacagacatgtaatcagtattgctaaatgagtggaaccaagtgccttcccttgccctaaaacttgatgctgtaataatgaaatcatgaaataaacttattgttcttcctgttggaagaatcatttgacaaatattggcaagtactgtaactgatttagttatacttgaataaatcaaatataatcaaaatatagaccaatgagactttgtgacttgtacgcatacctcaaagtttataaaatgaattttatagaaagtaaatgatgtaaactttggtgatttaattagagttcaattgtttaacaaagaatgtgttttaaagatatattattcatgagcaaattaacttggacatacttattacaaaattatggcttttagagaaattatgggaattcttcagtaaaaatttaagcctttttgtagttttaaacactggatttcatttatgtctaatctagtttgtccattattcattagccataacaatctatatgtgaagatgtatttttctttgaaaaatattactgattttaaaggtattttccccacatagataaatccaagcagatgaggaagtttaaatttgtcacgggtactctactcttaactagtgaaggttttatgttgttgtctttaagtacatattaagtattcacttgttaactaattctgatactcattttatctttacttctcttcagtatctactactcaaattcgtccattcttaaatcagcacaagcttttacttcccattgagcatggggtagaaatttgtgaatttttagtgttgactaatcaggtttgactaatattgtggcactttatattaaatattatttaattactgtgtcacagtggcgtataatatataaaacattaaatcttaatgttttagatgtcatgtaataagataaaatgtataattctcagtgttttcaacttctcaaccacttttttctttatacaaatcacactttttacactttttatttttaatcctgtgctatgcaaatactgtactgtatgtagtcttaagtgtgtgctcaagaatgtgcttaagacataaaactacctcagagttcacttatactttttattctctttaatgacttttcatagatgtcacattgccttaaatttggtttgatttagaatttgtaaaatcatacgtatgccactgaagtttaccttcacatcatatgggaatagtatatatgaaaggttcttgaaaggcaaataaatagttcaataaacaagggaggtacatttcattaacatactaccttatagtggtggagaacataggctaagttcaaatcccagtttttactaactacttgactaaccttaggcaagttacttaatttctatgtgcctcagctttcctatctgtgaaataggaataatgatactatctgcctcaggaccgttattagtatcaatgttacttaagctgatattttgatagactgataggaaatcatgattatccagtaatgcaggggtttttctaagcaactttgggttagcatcgttattgcatctttttttaaagtagtaaagttatgttttgtaaaatctataagtccacttaaattttcctcccctcagctaatttggttcaagttactgggattgttaaataactgaaatgtatttgtttattgtgtttttcaaagctaaacaagccatattttttttcacagagttcatctttcaggacatacccaatatatttatttctattcatcttatatcctaagtgaatttaatatgagatttactttcttttaaagtcatttgtaaatgaacaaaacattatctttgcagcccttccattcgacattcattttcatgttctttgcagtacttactcatacactagacattttgaatttttttcgtacatactaatcaggcaataacagctgttttattctgggatttgatgttacaggatgttagttatctgtgatatgattatatatttgtgaatatataatgtgaaatatatatatgatgtatgtaataatccagaatttcatgtaggtactggtttatatactttttctgcttttgtgaccctagttttaaaatgctatataccttttataaaaatgagttagatattgatttaaaacaattatcagtgcctttttcatttgctttttgaaaatgtgacatttcaaattattattgttagtattatcacaaaacaaagatttgattttattatatgtaaactaatttttcttcctgatcttaaggtgatgttctggagttcttaaattctactgagaaagtataagccgactatagactttttcatagttgaattaaaaaattaaattgtgtgtcatatatcatcaaactcagttccttacttgctaccatagagaaagtgtgtctctgaggttctctgttttattgatacagtcatatcctcatttgtgctatattacataaagtacatgtggcctttatagttatatgaaagatatgttaccagccacattgatctctatgtaaattaattacatatttctagttaggttacacaacaaagcctacttgctgactagcctataaataaagattctttaaatgcatttggaacaattttgcctgcttgtatagagtgaatgactgctgtatgtggtaacctcagaagcttgaggaatagatttcctaccttttacagcaagcatttacttaggttttacattcacatttgtaatgccatccgttttgatttaaaatctgtcatcattgaaagaattgtagctggtgagtaaggaattagcttcgtaaatttgagaccggaagaggtcttaaagatggactaattgcaccccttcattttaattatgaggacactgaagccagagagaaaaactgacttggccaagtagatatagagagctgacgtaataccagacccacgtaatcatcctatagtatgtcactctgctactgtacattggacttgttacttttaaatgtgctcattattgtgcacattctgagcagaaatcctacttctcatgtgtttcaaaacaactcgtaagagcgatcagcattccaaaggcagttttggagaactgaaagtgtgttgttatttctagttttgtgttgttacttctcacttctaaattaaaacttattttgcactaagatttctttaatgccaatacaaatctaagtgtattgccaaaagagggattgtgatagaaaacacattttttcattaagtctttggccatttttagctcattaagcctttaagcagttgctaaatgaagtcaaaggagcatagtttataaaaagatattaattttttttttgttcagttatctcacatggtgcctgtgggaaatgtttccacttgtattgcatcttccacaatcttagtgatagttgtcaattggtactaatgaaacgtaatacttttaggaaagcatttaccctgtatgatctaatttgtggtcgttgttggcctgtattgagcaagttcattatttggagaagaattaaagtcacatagatgcaaagaagtattttacataattgaatttcagtagaaatgtgatagcatgttctacatgtttggttttgagtttaccttatacccttaaggtcttcagactttttgctcatttatcccttgaaccctttacaagttgacatacacagtttttcatcagaagagtcaaataattgcaaagaatataatttctaacatcgtaaatattgacttatagtaaaattataacatcagtcatttaaatgtattcagtggaatctaagtatcagggatatttgatacccatcacccatttaaaaaaataaatggaaatagaatttttttgaaactttctagggcaataagcttctaatctaaaactttcttctggatttagtaattaatgcaattattatttctacagaattaatctaactgtcataaatatattacagttttggtaaataaatattaaacagaataagtaaaatttcactgaatgaagtaggagaggtggagctgagcatctgtatgagaacccccttgtaggtgatataacttgtgaaaagtcctcttgtatcctcacacacatcccagtttgaatgctgctgacttaagtgactgactgtgccttctgcaggagattattagaatcacataatataatttagtgactaaaggcagacactctgcaggcaggccatatgggcttcaattcgagctctgagtcccagcccttccttctactaattgcatgactttaggaaatctgcatagccccccatccctgttttctcatctgtaaaatgagaataacagtttgctgttgcacaagtaaagtgaaatgatacttgtagcatgcttaaaatagtgtctaacacatgcatgttatttgtacagtcaactctagatattctcttaaatgtattttgagaattttatagatatatcttaatgtgtttataagcatttctcagacagatttaaataatttgagattatcaattggtacttccctttcctctttcctggtaaatcagataatttcccaaattttatacaagaaactaatcagaatttccccatgaatatgtacacatagatctattggtatgggaatgcatatctatttaaacacaggaatacttgatgtttgtccgtgacagtgagacaaattataattaacatttattgaatacccactctaagtaaaagttgtatttaacaaaaaggagaaaaatcgactctaaagcttgcccctgcaaaggacttacaagatatattaagattaataaacaaatgttgagaatcaatgaattttaaaaagagcacaatcagcaatctctgatttgaagagaaccaaaatgaattcagtaatctatactagaaggtgacctaggtaacaggaaaagcaggaacggtaaggggaaaaagtagttattcataccttaaatttgtattaatagatcaattaacaatgtagcctctaagcaaagtcaatgtatagggattataattcagcttatgaatgtctttgtaagaattgttataaaactcattaatcatgagatgataatcttacttcactactagacatttttcctagcataacctgaactgtctgttatgttgctaagaaatataatgatatactaacttaagtgtatctctttaaaatatatgtcctgtttaacagaaccaatagtttacccattaagatattttccaaaatatacttatttatgtccaggttcatctgctttttcccaaataaacattaacaaacaagcaaaaaactggaaaattgagaactttgggcattggtatttcacgagattttgaaataagagacaggatagattatctcctatggattgctgacctttgtaactgcataccctgtttacttcagtaattatctaggaggattaagtctcatcccaactaatgctatacagcatttgaaaaaagttaaccaaaataatttttgttatgaagctcattatatctttggaaataattagtaccatacatcctacagtatcccagaaccaatgagaatcattgttaaattcatgtgaaaacaatgcttaaataaggtagacctattattaggccataagtaattcaggaaccatccgaaaatatacttcctttagtggacctgggagggaaaaacctacaacatttgattttagttccatggttattagagtccctcaatttatgcttagatatattttaaagtagttgaatgtagaataaattttgataatgagaatcttattctgatgttggctttcatgataaaatttgaactatcttcctggagtttaaaaaaaaaattctagtagtctgaaataaactattggaagagaagtgggtgtatctttctccccctactaatatagtggggggaggaatttctcggtactggtacttactgttctctaatatattctttctgccattattgtatctcatcccaaataacaggaccataagaacttctgtcatttggaggtccctttactcctttattgcaaaacacagaactctttattctttcttcacctttgtgcacaggcctttaggagttttaacggagttaggctacaatattttacttccatgaagggccttgtttgtacgtgattttctctaacataaacattctccaagattcaggccccataactctgtaaatgcaaaaggaaaataatttgaaattcctgaaaatattatagactgttttaacctatgccgttttatgtgctttcaagtatatgtgtgattctaagtcagcagtgttctcccaaaaggtttttagataaccctgtaattagtagataatttgttgttaacttatcagcaaaacatgtataaatgggtgtttctgtctgcagtatatgaagtgtgttctcttaggtaaatacatacctcactttcagcctttttttacccagttattctttaggaatgtcataagtataacaagctcttttctgtgaataaatgattgtctaagattttctactctgttttatcaaattaacatcaactggtacttcttgggtacttgttgggtacttcctttagctgttagttaacaaatgttgtaaccaccatgacttgctcagctctctattatccataataccagcttaatgccttaagtataagtaaaatagatttgtgatgacaaggaactcaaatattttttttttaacagatttggttcatttgacttgcacatcttctaaaacagcaagagaagatttagaatcagttgtgcagaaattgtttgttccatatactgaaatggagataggtaagaaaaataattgataactcatgatggaaaggtaatgtaaccatcataatcttcttagatatatcatgaaagtttctgcaacctgaactgaaatgggatgtattcaacaacaattcacatgttttgataagatgcttgagcacagtgtctgcctaaacatgtgggaaaatgttcactctacaatgttaaaggaagtatatacatcatacacacaccaaaaaaacataattaagcacaaaaatatacatttatatgtatagttacacagaaaaaggattgttagaaaatcagttaattttggtgggattatgggcaattttccttataattttctttattttacaagtgttgtacaaaaagcatatattcctttatcagagaaatgtatcttcctttaaggaaaaaagattcaactaacagattaaaatattaattggcagatgtagaaatcctttcctatccaatagtctttttttttttttgagacagagtctcactctgtcgcccaggttggagtgcagtggcgtgatctcggctcactgcagcctccacctcccacgttcaagcaattctcctgcctcagcctcctgagtagctgggactacaggcgagtgccaccacacccagctgatttttgtatttgtaatagagacggggttttcctatgttggccagggtagtctggaacgcctgacctcaggtgatccgcccacctccgcttcccaaagtgctggaattaaaggcgtgagccactgcatccagcctctaatagtcttttaatacatagtgtgctagtgatttaatatttaactcccaaaagtgtatatgctacttattcatgggggaaacacattttaaaactttccccctacataatagggtagcacttgcagctgtgaatggagaaaatatggcatattttctgtgtaaatgataaaagaagccttttgcattttcttttatatgaagtgaaggtgatttttattgtaggatttgcatgtgcacttgaatcttgatcattttcttccattgatttatatatctttattttctttgcatgttacttttgttcatgcaaccatttatttactcatacctgttctgtttccttgcagctcatttcctatgtgggttgcttattttcttaatgcagagatagtgcatagaggggggtttatttacataagaagacaaactgttctgttctttaattttttttttaattttatgggtacatactaggcgtatatatttattgggtacatgagatatattgatacaggcatacaatgtggagtaatcacatcatggtaaatgggatacccatcactttaagcatttatcatttctcagtgttacaatcattccagttatactcttttagttatttttaaagtacactgtaaatgactgtactcaccctgttgtgctatcaaatgctagatcttattcattctatttatgttctgcaccctttaaccatccccacttttccctcttccttctccattacccatcctagcctctgataaccatcgttgtacactctatctccatgaattacattgttttaatttttagctcccacaaatgagtgagaacacattaagtttgtctttctgtgcctagcttatttcacttaacataatgaacctgttatgttctcagaggctaatatcaattatgttttttgggagctacccaaatgaagtatttgaaaacttcactttaatttgggggttaatttacaaattaaattattttagttttaatttattaatttgtaagttacatattttctttattggaaagtatcatataaatgtttagattattaaaaatttgattgctaaggtaaaatacatgataatattcctaaatctaatatggagtcatagttttttcttttggctttaactacaactatactttgtgtagaaaccctgagtttcttaattatttctgaaattttaaataattcttatattgtaatttcattgtgtagtagtctcaatgcactaaatatgaatcatgtcattactcttcactttttaaatgcatttaattttctttaaaaaaaatcaagctgggggaaattacatgttcattacttagcatcctctatccattttagatttttaaacattaatcttaatagttaaagtgatcccattttgaaatgatgtattgtttagaacctgagaggaattctttgataagaactatgtgctcagaagggtcctcaggtgcactgaggcactgaaaagctagttttcactgacacataggcctttttatcatcaggatgaggtagtggtcatattttaattaaaatgtcagaacaaatactgttggagttattgaaaatgaatcaccagataaagtgagcactgggccatagcaggtcaaaaaggcaaagtcacctggagaagagaactcaattcattttcctgcctaaatgaggaagaaggaactttatgagcaatatgaacttctaatacattaaagcacattcttctctgtaggagaagcccctattttcacagattgatggcttttagtattatgttttgattatttgacattcatataataccttatgctttactgcattgtaaatattttagtttaaaacatgtaccaaaggaataacattatttgggcatattttctttttgtttgtctttgaattctacattctctgtgcttcataatcctcagtgaaagtcagcctagtcaccttttaaaaaaaatctatataatagccatcctagtacgtgtgaagtagtatctcatagtagtcttgctttgcttctcccccagcgattagtgatgttcaacatcttttcaagaacttattggccatctgtctgtcttctctggagaaatatctattcatttcctttgcacatttttaattggattttttgttgttgttgagttgtaggagttctttacatattctggatattaatcccttatcagatacatgacttgtaaatatttgttgtggcattgtaaataggattgcattcttgacttagccctgtgcttgattgttattagtgtatagaaatcctactgatttttgtgtcctaaaactttactgaagtcgtttatcaattcaaggagccttttgatggcatctttaggattttctaggtatagaatcatatggtcagtgaagcgtctcactcattttctatctcaaagagcagcactgcctaaaaaaacagaaatttcccttataggtgtagtttaaagtccatagctagtgtgttaagtaattgttgggctgtgaaagcaaatgtcttaattcctttctgtgtgtgctgtatccagactcagtcagggctatgacagtctccaccactctgctggtattactaacatagtttactctatccctaaacatggcatgcagctgtagacaccatttcttgctttcttgttattgttgtgctatagttgcttttcttctacctaccctattctacacttactccagtttaatttgcccaagaccctattctaaattacctgttacatctttagtccttcttactatcaagttgaatgaaatgagctactgcagaaaaccagttctacccctggcaacttgtgatgcactcctagccaaagctcagcaactttaatattttttgacagttttgcacttcacaactgcatattctttttctagctatctctttgccttccagctgacctcaaagaaagatgaagcaattatatatctctttaaagttttaaggtcaaagcctgataatgccctagtatccagagcatttatcttcagcctatgtcagtttttcaccttcctcatggtttcttttcaaaggcgcaacgtctatgaaattagtttaaatctattggattattcatttcctccagcgtttattaagtgaagtgttcctttgagctggatgtttaatgagatacaagataagctctcctagtatatgcttagaaatgggctgggcactattaaagactttccagaccttagcccacttgttagcagtgctccccaagtctggtatcccaaatcataggagatacatttaagtatcttcccataagattcgtgtaactaaactcattaatcagtttactaagagccatatgatgttagctataaaatatgaattccttatgttcctttattttgtcaatagatttagccacctaatatgttcctacatgaagttagcaatatcttagatgactcgtagatcttagcaccagaaaggggcaccttaggagatcacttcttccactcagtttcttcatcctattccactaataattatggattattcaggttgaactaggaaaataacttatttggtgttcttatagtggagatactgtaaattaaatataataaaatcctgtttatcctgatgtgggaaatagggctttcttgttaattgaatactgctattaggtgaagatttctctacattgattaccaattaaataatagtaattaatgagataattatgcctttagcattttctttgttattcatgaggtgcctcatggtcttgggcaatcttcataaacattcattattattgtacaaaatttgaacttttgttcagattcaggctaaagaaaactctctagtcaatgaatgtatcaacagcagtattttatgttttcaaacagaaaatttaattataacagttttaaagaagagaggcaaataaatgattatcaaattagcaagaaataggctttatgcattgagattagtaatgttggacctttttataagcacatcgtactttgatcatacctgaaaatacaataacatcaattcagaaattatttactgagcatctgtcgtgtgctaggccctatattagggaaccaaaaacaaggaaggagagtaagaactaagtctacttcatgtgtatatccccagctcctagctcaatgcctaacacgcataaaagacacatgctcttaaatgagagaacatgtgctcaaaatggcattcactgttatgacttcatttttgatatttgttggttgtcattaattttttaatccaataagacaaagcattaggatgtgagttaggacaacaaagttttaatcctgtatttactatttttttaataataactttattgagatatcattcatataccatatgattcacccatttgaagtgtacaattcattgtctcttagcatatttgtagaattgtccatacatcaccaccatcagttttagaacatttccatcaccccaaaagaaacgtcataccaattagtgatcacctcccatttgcccccaatttccttcagccctaggtaacctactaacccacttcctgcttatcctggatatttcatgtgtatatactattgaataactatataatttatcaagttggtttgtccatttgaaacataaggaaatcaatttatgttatcttctctatagggaaaattttaggatgaatgtgatcataaaccctttgatactagtgagaagaagtaatagaagtccaaaggagcatgactggagtaaaatctaattaacttactaatcaaaatagagtgtgtagatgcaaatttactaaatgtttacatacgaagctctgatttcctactatgtctagtcatggcttaatcggtaataggctacacagtgtagtaattgacaaacatattgtattttagaatgtaaataaaatttatttctatatttagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggtaaggctcttgatgtttctcagttttgtattaagatgttggtgtggttgggaaatattttttcctctgggaggagagaagtctagaaaagcatctctcagtagtaccatttctgtaatttgccctaaaagttttttctatgacctacaaagctactttaaatatactttaaatacaggatcaggtattttcactttcttgaataaaatgttgagttacagagattttttatgagttccatcgtgggaatgacgatagaagatgctaaaaatacatatttcataagaatttataatgccaatattttaaagaaacattgtttctaacttaaacagttggacgattgctatattattttgaaatacataaattatttttcttggtaaacagtcaagaaggttgtaactactaaggcttataaaattaattttacagtagtcttaatgcattttttaatcatagaaaataagttatagcgtagttttacatagttaacttgattctatttatgttttgacacaaattcctgtcccaggagctaccattactgctgctgaggtctattgtaaagtaaggtggaagtttgtgatagccatcccggtcagggctatgaagaggcacagtttgatacaagctgctaaaagtgagccatgattccattaagctgaatattgatatgtatatataaatatacttctttgccctggacaggacgaaaacaaacagaaaatattttttgagacacatttctaaacttttcacgggtagaactggcacatctgtccattaagtcaataattgggtaatttaacattgttctaagaccacagatggaactttcattcccgccagtggcaaggatcttatagtagcaaatgtcctggttgagcctgtaatctaattttgagtcattgtagcaaagctatgtctatcatgaggatacagacatctgcagtttttttctagaattcttgtgtattttcttcagtgcctgatggtgatcctggataatcatattcagccagtgacaccaaacaaaaataggaagtcacatctctcatccatcattccttctgttagtttagtaagaacccaagatggctgaagatctgcatttatagcttgaaatgatcaagtcatttttaccttgatgttctaattttttgcaagtagaaattgccaacaagtttttagcaaggtagcttaggtcatttttatccctgaatgaacttttaatattttttaaccaaaaaaatttaagtaagggcttataatacaagtactaatgtaagctaaacatctaaactgcatgctagaagattataattgagggataattttatcatgaggtaatttgcttctcaagaatataatcttcagaggtaacatgctatacagtagaaaacagtatagtgctaattttggtactaattaatatatgctattaaatgtaagcagttttaaatttgttgtatagcttttaatctcatcaattttgggggaaatattataatgtctactttaaagaacattgacaatgtttataaatagcttgtgtattcagataaactgcatgctaattcctgtgtatcagcctgtaattatgtcagtcactaattggtgatttctggtgattggtattttccaaatgaagattatccataaaagctctcagaatatcacctagactttgcttgtgttgacaacacaagcccatgcagatttcttctttttttttttttttttttgagacagtcttgctctgtcacccaggctggagtgcagtggcgcaatcttggctcactgcaagctccccctcctgggttcatgccattctcctgcctcagcctcccaggtacctgggaggcgcttgccaccacgcccagctaattttttgtatttttagtagagacggggtttcaccatgttagccaggatggtctcaatctcctgacctcaagatccacccacctcggcctcccaaagtgctgggattacaggcgtgagccaccacacccggcccgatttcttcatttttaaaaagcaaatgaaatacttcattttaccagttggcaggtttacatcttttcttatttgtaaaatgtatagaggttgagtaatgtaaacttgacactcttgttttcatagggaaccatttatgatttgaagatgcaccgaaaacataaagtgatctgtctttaatacccacaagttcaaattgtgtgctcctggcctccaagacattctctattgccaccgcaataccaacctaagtgatagttgtgattctttctatgacttgctcatttttgtatttcagttttgtttttatttttctgaaactgacatctgatatatctcttttcttggtagatgttgtgtaccatttacccaaacgtactgatggacagttccatagtcctcattcccaagacattgatagctcactccttcaggagccccaccctcttggagatgtcactaccatgggaataagaataaatagtaccatactctttgtattttacttcaagtataaaatgagttaaattggctgatgttgggctgggcaggcaacttaaccaccatttagagcattgttttatggacagattagccagtcacttacgacgtttgatatacagcccattattaagttgagagctaactgtatagattgaactatcaggttgttcacatacggtagtgccatttgttttctcatgcctttgagagagagcgagcaattttagatgtcatattttctgtagctgccattcatttgagcactttctgtgtgtcagattctatccttagcatctcatatatattatcttatttggtcctcaaaacaatcttatgagataagtatttgtgatatacccatttatagataaggaagctaagtcctgaaggggctgaataacttgtccagaggtcccatagctagtaagttcttgagccaagaattaaactcaactcttttggatcccagtgcttgtacactcacccagtgttatatgctactttcagcttatgagtaggcatacatcctaaaaacattaaagtactatattgatgaaatgtttaattttgtttgtgttgatgtatgttaactaaacatagaaatattttaaataattcactttgttctctctgtacttgccagtgtgagcacaccaagtcacaatataattagccctttccaatgttttaaccacctgaaattttttaccctttgatctaacttctggcttaaaaaaggtgaagaggatgaaaagttgccaatcaactattctgtgcttagaactaggtttagttggcaaacaaaatgcagcagaccaagaagcattagatacactttccagagcatggcagttgaccctaagaggttgcagcagttagagagaggagagatttgggaagggctggagtctggctattggaaattggcatcaacaagggccagggcagatgggctataggtgggagtttcataagcaggtagaacacaagaaagagtggtgtgacaacctgcaactggtgctaatcttaggaggcaggtggtgcatgacaagatatatggaagtatgtggtgtgggatccagccacagagactggagtttagggtaaaagctattctatggggaggaggcaaaagggagacaaggtgtcaaacacagaggaactagcatagaagaagtaaaagaattagtagtaataataattattatatttatacttaatatttgtattaaatgttactgacattctattttatgccaaggcactaaggatccagagttgactaaaagtatttgtcatcctggaggaatcactgtcaggtaaaggagaaaagcatgtaaacaaatgacagtgtagtgtggcgtatgtactaatatatccaaagtctagaaataacagaaaggagaaatgagcccaatctaggagtcagagaaccttacggagaggggtataacagaagagtagcaattctccatctaaatcaaagacagtagaattgaaacattctggatgtgaagaataacattggtaccagtccaggatgtaaaagataaatatcatggtgtattgtttcatacaaataaacaggtattagtaaatcaagaagtctgagagatggaggctagatgaaatggtatatgataagatcagagaaggtaggcctgaagggttttattttctatagtaggaatcttggattttatcctattggtgatggggagtcattgaagaattttaagccaaaaatggaataaacagaattttattttccattgacccatctgaggatggcatggagatggattatatgggggaactctagaggcaaggagaccagtccaattctgaggctattgtagttgtctagttgaaagatggtgcatgtctgggctatgtcagtggggaaggaacagatgaagttaagagatagaagataaaattgatagaatttgatgattgtttgcatgccaaagataaaagggagggagaacttttacagatagtaaaaacagagatgtaagacaaaaagaccattaggggaacggaagtatgaggtaatggctttgtctgatctaggtcctgcttctacaggggttgcgtgtctctagcaaaggagtatggtgagtctccgggatggagagcaaagacaggcatctgtaatgtttaatttccaaatagccataataaaaaatgcagttagctatagttaccatgctgtacattagatccccagaacttatagctgaaagttcatacccttaaaccaacagctctacactccccagcccctggcaaccaccctcaacttttttagattctacatataagtgagatcatgtgatatttgtctttctgtgcttggcttatttcacttagcataatgtcctccaggttcatttatcttgtcataaatgacaggattcttcaattcaaatttgacaagagagcagattttaagtattcttactacaaacacacacacacacacacacacacacacacacacagtggtaactattagtggtgatggacgtgttaacttaattgtggtaatcattacacagtgtatatcaagtgaccttgtacaccttaaatatatatactttttgtcaattaagtatttaaaaacttaaattgtctatagtaattggcatgtccaagaacatacccttgaaggttttttattctgttaccctgtcatactaataagttcagcttaaatcttgacatttttacttatgttattattagtaataatgaaaatagctaccatatatgtcggcttaatctctgatattttatagataaggaagccaaagctcggaaattgagaaagcattccccaaatcacataactgctaaatcgtagagccagtatttttactgaggctatcttttcaaaacccatgagcttaaacaagtgctatagtccttaaagtccagggaatggaaattctatcaaaaagcaaatagttgaacaaacagtgaagagttttcttcatttgaacagtgacttgttaaaattactatatgctaaattagactataccagtatcacatgtgggcttgtattagtctgtcctcacactgctataaagataccacctgagactgtaatttataaacaaaagaggtttaattgactgacagttcctcatagctggggaggcctaaggaaatgtaaaatcagggtggaaggcaaaggggaagcaaggcatgtcttacatggcggcaggagagcaaagaaagcaaagagggaactgccaaacacttttaaaccatcagatcttgtgagaagtcactatcacgaggacagcatggggaaaagtgcccccataatccattcatctcccaccagtccctccctaatacttgtggattacaattgcaaatgagatttgggtagggacatagagccaaaccatatcattctgccccgacccttcccaaatctcatgtccttttcacatttcaaaaccaatcatcccttcccaacagccctccaaagtcttaaaactcattccagcattaactcaaaagtccacgtccaaagtctcatctgagacaagtcaagtcccttctgcctatgaacctgtaaaatcaaaagcaagttagttacttccaagatacgatggggtataggcattgggtaaatgtccccattccaaatgggagaaattggacaaaacaaaggggccataggccccatgcaagtccaaaacccagccgggcagtcattaaatcttaaagctccaaaatctcctttgactccatgtctcacatccaggccatgctgatacaagggctaggctcccacagccttgggcagttccaaccctgtggctctgcaggggataggcactgtgcctgctttcatgggctggcattgagtgcctgtgacttttccaggtgcatggtgcaggctgtcagtggagctaccattctggggtctagaggacagtggccctcttcttacagctccactaaacagttccctagtggtgactctttgtgggggctccaagcccacatttcccttcagcactgccctagcagaggttctccatgagggctctacccctgcagcagacttctgcctggccatctaggcgtttcctaacatcctctgaaatctatgcagaagctcccaaacctcacctcttgtcttttgtgcaccctcaggcccaacatcacgtggaagctggcaacgctcggggcttgcaccctctgaagcaacagcccaagctgtacctttattccttttagccatggctggagctggagcagctgggatgtagggtaccatgttccagggctgcacagagcagtggggcccacccagcccactaaaccatttttcctcctagggaagatctctgacatgccctggagacattttccccattgtcttgtctattgacatttggctcatcattgctcatgcaaattgctatagccagcttgaattcctccccagaaaatggttttttcttttctcccacatggtcagactgcaaattttccaaacctttatgctctgcttcccttttaaacataagttccaatgtgaaggcatctctttgtgaacacacatgactgagtgctttcagaatcagctgggtcacctcttgaatgctttgctgcttagaaattttttctgccacataccctaaatcatctttctcaagttcaaagtttcacagatctctagggcagggagaaaatgctactagtctctttgctaaagcatagcaagagtcacctttgctccagttcccaataagttcctcatctccatctgaggccacctcagcctggacatcattgttcatatcactatcagcattttggccaaaaccattcaacaagtctctagaaagttccaaattttcccacatttacctctcttcttctgagccctccaaactgttctaacctctgcctgttacccaattccatagtcacttccacattttcaggttatcttttagcagtaccccactcctggtaccaattctcaatgctagtgcctcttacactgccataaagatactacctgagactaggtaatttgtaaacaaaaaaggtttaactcacaaggccacatggctggggaggcctcaggaaagttacaatcatagcagagggtgaaggggaagcaaggcacatctcacatggtggcaggagaaagagaaaagggggaactgctaaatacttttaaaccatcagatattctgagaactcactatcacaagaacaacatgggaacagccgcccccataatctagtcaccccctaacacgtggggataacaatttgagatgagatttgggtgaggactcagaaccaaaccatatcaaggctctataagaaatcatataaacaatattaaggaaattgtatttctattgatatatagaatgaatgtatttcagttctcaacaatctgaacacttgataatgaacctgatgaggtactgccatccttgaagagtggacctcaatacatgtatagaattaaagggagaagtcatagaattctgaaaacagacttacggaagttcatgtattctgattaagtactgtagcctgtttaagcaaatttttaaggataaaacacttatttttttttagttaatgccagaaatgcacacacattttaaaccgatttccaaaaacgattttatcttttcttccttggccaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatttttacgaataagtcagtagtgttttttagtatcagtagtgatatttgtttgtaaattatttacatattgggaaaggtcaataatgaagaaatgaaagaatggaaggaaaggtgtggataggctcattggtatttgaatattctgtctgtcaagtaactagagtattaggctaattgtctacagacctaatttaatcctggctgtcctactgatgatatttggtaaattgtttaacttctgagcctacgtttctccatatataaagtggaaatagtattactatgcctactatatgagaatggttatgaagacaatgcaatgccatgtttagaatcggtttgccagaagaaaattgttttagaattttcccattgacttgatgaatctcaaaagtctcacgcaggaaataattgcttgctgtcagtcaacttccaaacaaaatagatcacagtgtttttattgcattaagctttttaaatgaaaatttcttttttaaagtagtattttatagtcttacagaccagtaaaaatagtaacaagtagaattgtggttttgaaatattactaaggaaaacactctataaattgttttattccttttctggtaggtaaacctgcaaccaccaaggactccaaattgtgtatgacagttggtaagccctaatatacactacataaaaacgttagggctgcctgtaatcccagcactttgggaagctgaggtgggtagatcacttgaggtcaggagttcgagaccagcctggccaacatggcgaaaccctgtctctactaaaaatacaaaattttagctgggtgttatggtgggcacctgtaatcccagctactttgaagatgaggtagcagactcacttgaaccagggaggcggaggttgcagtgagccaagattttgccactgcactccagcctgggtgacagagcaagactctgtctcacaaaaaaaaaaaaagggggctgtacataggcagcaaactaagctgcagtgatgttgcctatatttaaattttctcaaatggccaagctctgatggtctactttatttgagcaatagttgagacttataattgcctataaataaacaaacaaatgaactatttgtttttttttctcacaacatctggcctatattgtctgtcaggaagccatggctccaatgtaaagtacatagttcttacatacttcaactgcagctggtccctgacctcaccaggtttcagagatgttcttaaaggaagccagctgtggcaggtcacagattcatgggaaatggaaagaaccaaggaatatagctcttgcctcacctttctacccactgcagatatagttcaagccagagtaatggaagaacttaacttactagcctctcaggctgctcctatccctacctcccagtgtacagcccctccccatctctttagtcccctttccctcacttccccttttataatgtcacacaaatcagggacagtaggatcacattataacctactttgtcatagggattcgatttttcttatatcaaatcatgtttcctgaaac

SEQ ID NO: 13126 - DNA, 10467 bp, Human; identical to SEQ ID NO: 12269
  misc_feature (1)...(10467): n = A,T,C or G

SEQ ID NO: 13127 - DNA, 32010 bp, Human
tcgggaggctggggcaggagaatggcgtgaacccgggaggcggagcttgcagtgagccgagatcgtgccactgcactccagcctgtgcgacagagcgagactctgactcaaaaaaacaaaacaaaacaaaattagccaagtgtggtggcatgcacctgtaatcccagctactggggagattgagggaggagaatagtttgaacccaggaggcggaggttgcagtgagctgagatcgtgccactgcactccagcctgggcgatagagtaagactgtctcaaaaacaaaaacaaaaaccccaaaactcctgtttcttggagatatgatgagggttcgatgagctaatacatgcatgcaaagagctcagagcggtgcctgcacataggaatggctcagtcaacattagggattgtttctacaaatgtttactgagcccctgcagggagttgggcattgtgcaaagccctcacggggctcatgttctcagggcaaagacagtcccttaggcagagaaatgtggaatatgcagagtggttgggagggctgtggagaaaaatagggcagtgataagaggtagagagtgggttctaccttagccagggtgatcctggaggacttctctgaggaggtgacatttgagcagggacctgaaggaggggagagagtgaggcattcagatccctatggggaaagtactccatggagaggagtcagcaagtgcaaaggccatgaacttggagggttgggggtgtgtctgaggaatggtgaggaggccacggcggttggagccgcctgaggaagggggacaggggagatgtaggtggatcatgctaggctttgtgggccttggtgtggacttcggcttttactctgagagagaggagagccagggagggttgtcagctgagaagtttcatcaactcccttaagttttaatattaatattatatttatttatttatttgcgatggattctcactctgtcacccaggctggagtgcagtggcgtgatcttggctcactgcaacctctgcctcctgggttccagtgattctggaacttgggagcctcagcctcccaagtagctaggactacaggtgcgtgcctgcatccagctaatttttgtttatttatttatttttgagatggagtcttgctctgtccccaggctggagtgcagtggcgcaatcactgcaagctccacctcccctgtgtttaagtgattctcctgcctcagcttcccaaatagctgggactacaggcgcccgccaccacgcccagctaatttttttgtatttttagtagagatgggtttgcaccatgttggccaggctggtcttgaactcctgacctcaagtgatccacccgcctcggcctcccaaagtgctgggaatacaggcgtgagccaccgcgccccgtcctattattttttttagaggtgaggtctcgctctgtcacccaggctggagtgcagtggcacaatcatagctcactgcagccttgacctcctgggttcaagctatcctcccacctcagctttccaagttgctgggatcacaggtgtgcacccctgtgcctggctaaattattttattatttattattatttttaatagacatggggtctcgctatattgtccaggctggtcttggactcctggcctcaagcaatcttcccaccctggccttccaaagtgttagggttacaggcgtgagccagggcgcccgacctgttattgttactattattgctgctgctgttgtgattcccgtgttaagaagagagacagactggggagcagcccaacgctggaggtggaggcggaattcgaaccccaggctggacgctggagctctcgcccgccgtgctaaggcgtcttccccactccccacaagggggcgccagaggccgggcgcccggttttgaggggggcgcctcgtcccgcccctccctcctgtcctccctcccgtcctccccgctccgggccccacccggctcagacggctccggacgggaccgcgagcacaggccgctccgcgggcgcttcggatcctcgcgggaccccaccctctcccagcctgcccagcccgctgcagccgccagcgcgccccgtcggtgagtgctcccagcaccgcagctgtcgcctcccgacccccgcccaagcctgccctggttcctcatgcctgacccctgctccctgccaccctgtccccagtctgtaacggtctccccaggtgtcccccagtcttcaccagtccccccagtctgtaaccatgtcccccactcttcccactcctcccactcttcctcccactcttcctccagtctttcgcagcctctcacactcccccagtctcctccatcctcccccaacacccctccctatcccctgggctagaagagatcctctctgcagggtctccctccacgccctcatccatatcagctaacttggtccctccagccactcaagagcccctctcctgcctcaccagctccatcggccaccgctgatagcattctccccagctctctctcagggccctccctgcctgggacaccgcccagagccctctccctctgcccacatcccagatcctgcctctcttttccattcttgccactcctttacgaactccttttgcttttatctcccctactccctggccaccccttttaagtctcatgattttatggattttagcatatttgatttgcagttattttgatgctcaaattgccccatgtttggccactgggcacccctgcaagctgggtcctctgtccctgtaacatgccctatcggcctttgagcacttcctcaccttctgacccaggctcacttgttcttccctgcccccgccctggaatccaccatttctctaaggagtcccaggttcttttagtggggaatggtatttagagactcccatctcaccaaaagttgattctttgaaaagatcagtaaaatcataagcatcaacggggagcaatcgtttttgtttttcttttttaaaaaaagcaaatacccacacctgtggctgatatcgggaatgaaagaggggacatcactacagatcctacggtgaataaaaggctagtaagggaagatagagaacacagtctgggtgctggaggtgctcattgctcctgggttggtcatggctaacctccctaactcagatctttagacctataataggattgcaacctctgaggtcaggctgcctgtgtttgagtcccagcttgagcattttccagctaagtgatcttgggtaatttattgctgtcttcctgagcctcctttgccttgttaaaaaagcagagatgagccggcatggtggcacacacctgtaatcccaacaatttgggaggctgaggtgggtggatcacctgagctcaggagttcgagaccacccagggcaacatggtgaaacccatctctactaaaaatacaaaaaaaaattaactgggtgtggtggtgcatgcctctagtcccaactacttgggaggctgaggcaggagaatcccttgagccccagaggtgaaggctgcagtgagctgagattgtatcactgcactccagcttgggctacagagtgagactccatctccaaataaataaataaataaataaataaataaataaataaataaataagaaagaaaagcaaagcaaagcagggatgataatagacctactttacagggttataaatgttaagtgagttagtacagtacctggcatgcagtgatcataaatgttgcattatttttcttgttaacacccaacagccctcatgacctgggtgcacccaggcaaccttctcagctccatttctcactcctcctctttgtgcccctgtgtctggccacctacccagatgtttcatggctcccagtacaccaggacctttcacatccccagacctttgcacgcaccgtcctctctgcctaaatccccttgtcttgcctgctcttcatggagcagctcaaaagtcaaccctgccctgagtcttactggtgctgtggtctgtttctcatgccctcctctggatgtctggcatgtgtctgggtccttactgggggccctgggtgggtaggggatgatctctggctcatttctgggtccacagtgcctgaagcatggagtgagtgatttcagtgaaaaggtgtcaaatgatggaagggagaagggaggaagaaatgaatgaagcgattaaggaatccgtttcttccaggcagcttctgcatccttcgccttgtccatctcttggtcttccactaccaccatcaatcccccttcttcaaccatgtcaccattaatctttctcctccttcagctggttcgctacgatctccctattttttttgaaatggagtgtcgctctgtcaagtgcagtggcgggatctcggctcactgcaacctctgcctcctgggttcaagtgattctcctgtctcagcctcccaagtagctgggactacaggtggccaccaccaggcctggctaattttttgtatgtttagtagagacaggattgcaccatattggtcaggctggtctcaaactcctgacctcaggtggtccacctgcctcagcctcccgaagtgctgggattacaggcatgagccactgtgcctggcctttttttttttttttttttttgagatggggtcttactctgtagcccaggctggagtgcagcggcatgatcatagctcactgcagcctgcagccttgaactcctgagctcaagcaatcctcctgcctcagcctcccaaagtgctaggactacaggcatgcaccaccatgcccagctaattattttttttgtagagatgggggtctcactattttacccaggctggtcttcaactactgacctcaagcaatcctcctacctcagcctcccaaaatactaggattacaggtgtgagccatcgcgcctggcccaattccattcttcctcctgccacctgccatccatgctctgtgaccacatatttgtgaccacaaatatctgtgctcctcctcctcctccacccatcctgtcacccagacagtctacactcagacccctttcttcctccttggctgggccgcctatgctcatgccctctccccctcccacaggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggtgtgccagccgcgagcccagggcgcatctttctttttctttttgttaagacagagtttccgctcttttcgcccaggctggagtgcagtggtgcgatctcagctcatggcaacctccacctcctgggttcaagcaattctcctgcctcagccacctgagtagctgggattacagacacccaccaccacgccaagcgagtttttgtattattaggtacagttggggtttcaccatgttggcctggctggtcttgaactcctggcctcaagtgatccacctgcctcagcctcccaaagtgttgggattacacgagtgagccactgcgcccggccctgggggcacgtctttctgtcccaggggtgcatcttgctgtcccccttctctgtcccctccctgactgtgtttccctccttctcagccccaattcccttctctctacccagttcttcccatgcctgtctctgctctcttatccaggggagcacctaggctagtgaagtcagtatgcctggttcaaatcccggccagctgggtggcctcaggcaaatgacttgacctctctgcccttcttgtagcctcatctgcaaaaatgtggatcaatcaccttgggccaggcccggtggctcacacctgtaatcccagcgctttgggaggccaaggcaggtagatcacttgaggccaggagttggagaccagcctggccaacatggtgaaaccccgtctctaccaaaaacacaaaaaattagctgggtgtggtggttcgtgcctgtaatcccagctactcgggaggctgaggcagaagaattgcttaaacctgggaggcggaggttgcagtaagccgagaccgtgccactgcattccagcctgggcaacagagcgagactctgtctaaaaaaaaaaaaaaaaaaaaagggatcaggatcaccatggtctctatgccatggttgctgtgaggacttggaatagcacctggtggccgggcgcagtgtctcacgcctgtaatcccagcactttgggaggctgaggcgggcagatcacttgaggccagaagtttgagaccagcctggccaacatggtgaaaccccgtctctactaaaaatacaaaaattagctgggtgaggtggtgcccacctgtaatcccagctactcgggaggcttaggcaggagaatcacttgaactcgggaggcggaggttgcagtgagctgagatagtgccattgcactccagcctgggcgacaacagcaaaactctgtctcaaaaaaaaaaaaaaaaaaaagaacagtacctggcacaaattaagtgctcactgaacatgagctgtggctggttataactctgagatggtcctggttgccctttttctgtccggtgtctttcttcgcccataaaggatgctttgccatgcggtcccgagtccctcttcatgttttcttcgtgttttccctccttctgtccttccctgttgacccctgaccctccctctgcccccaggttcatgtgtgcccagctccctaatcaggtcctggagagcatcagcatcatcgacaccccgggtatcctgtcgggtgccaagcagagagtgagccgcggtgagtggggccagaccctggggtctgagggaggaggggctggggcctggactcctgggtctgagggaggagggactgggcccggactcctgggtctgagggaggaggggctggggtctggactcctgggtctgagggaggaggggctggggtctggactcctggatctgagggaggaggggctgggcccagactcctgggtctgagggaggaggggctgggggcctggactcctgggtctgagggaggagggactggggtctggactcctgggtctgagggaggaggagctggggcctggactcctgggtctgagggagaggggctgggcctggactcctgggtctgaggtaggagggcctggggtctggactcctgggtctagaggaggaggggcggtgtctccgctgggacttgggcctgtgtcctctggccctggctggcggggcagccgcagggagctagtggaagctgtgactgctccatgctggctcgcattgatgggtgggggaggtgtgtgggtgaccacgtggtgggagcgggcaggagccgcacgtctgggcaggcaggaaggatgggaagggagagatgaagagggacagggattccgaggcagtgagacagcgacgcagggagacacaaggcctggagatgaggcagagcctgggcaggggaggcagagcccgggcaggggaggctgggccctgcgagctcctggctctgcgtctgggccacagatggggccgagaaggggatgggaagggaatctgggtgggggccaaggccaggcctggaatttataaacagctgtgcaaggagagtggcggggggtggattccagccggggcctccgggcgtgctgagccctcaccacccctgcccagcccagctcagcatctgtggtcccccagccccacagatctgtgtcccccaccccccatggccttggaggcccagaactggggcaaaggaggctgctatgtggggcagagaggatgggaggccctggcgagaaggctgggcctggggtggggtggggacgctgggggtgaccatgtctctggctgccgtccagaggccccacgggagaaaggcaggaggcagctgcagaaacgattgggaggacacgctgccagctgagggggaggaattcctggggctcccaccccagggcctggacctgggacagcgggagggagaggctctctcagccagggcaggggtgccggcaggggggttcaaaggccatgggtggtgggggagtggggaacggggtctccctccctggccttgaggatagaggaagaggaggagagagtgtccagctgttggtgtgtatatgtgtgtgtgtgtgtgtgtgtgtgactttgtgtatatcttgggaaagtgtgtcattatgagtgtactcctgggtgtggtggttccacgcatttgtgtatagcagtggacgtgcctcattgtggccatggctctgaggttgtatgactttgaattgtgtacatgcctctgtgtgtgtgtgtgtgtgtgcgcatgtgcctataattgtggctggaagactttgttttgtttgtttttgagacagagtctcactctgtcgcccaggctggagtggagtggcgcgatctcggctcactgcaacctttgcctcccgagttcaagtggctctgctgcctcagcctcctgagtagccaggactacaggcgcccgccgcacccatgtccggctaatttttgtatttttttttagtagagacgggatttcaccatgttggccaggctggtctcgaactcctgacctcaggtgatcctcctgccttggcctcccaaagtgctgggattacaggtgtgagccaccatgcccggcctgctggatgactttgtgtgactctgaagggctgtgtagggctatgagagactttgtgggatagtgtgcaactgattctgtccctatatactgttatattgtgacgtgtgtgtgtgagagagacagacataaagggcaacttttgtctatgtgtctatgtggatttagtgtgtatcattgtaggtgtgagtctgacattgtgtgcctgtgtgtgagatggtctaggcatatatgtgtatctgggctgtgggctgtgtgtgactttgtgtggctgcatggggcggtcagggctgcggggattttgtgggactgtgtgtgactacctgtgattgtatctccggatacagttgtgtgcttctgtgtggtgttgtgtatgtgagaatgtgtgtgtgtgcaggagtgcatcttttgtgtaactgtgtgtgattacgtctgtgtgtgtgcctttggatttgggagggcatgggaggttatgtgtgtgcgactgtgtctgtgtgggtgtgcatgcatgtgtgcctctgtacctgtgtgttcgtgcaggtctctgtgtctatgccgtgtgtgcatctcacattatctttgtgattgtgtgaccacaaacatctgtgtaggtcccagattgtgaacacgggtatgtctgggagcctgcatcttgtagtaattggctatgtttgtgtctggatgtgctactgggggtgtgtgtgtgtgtgtgtgtgtgtgtgtgtgtatgcgagctcatgtgtgtggctgcctctgcatgtaagatgtgtgaacacacgcatgtgtgattgtagcatagtaaagccctcaaatctgggctctgctacttttatttatttatgttatgctacttttttttttttgagatggagtcttactctgtcttccaggctggagtgcagtggtgcgacctcggctcgctgcaacctccgcctcctgggttcaagcaattctctgcctcagcctccggagtagctgggattacaggcgcctgccaccatgcccggctaatttttttgtatttttagtagagacggggtttcgccgtcttagccaggcaggtcttgaactcctgacctcgtgatccacccacctcggcctcccaaagtgttgggattacaggcatgagccaccgcccagcctattttctgctgcttttaaactgtgggaccttaggcaagccacttaacctctctttgcctcagttttcttacctgcaaaatgggaataatgggctgggcgcagtggttcacgcctgtaatcccagcagtttgagaggccaaggtgggcagattacctgaggtcaggagttcgagaccagcctgggcaacatggtgaaaccctgtctatactaaaaatacaaaaattagctgggtgtggtggtgcttgcctgtaatcccacctactcgggaggctgaggcagaagaattgcttgaacccaggaggtggaggttgcagtgagccgagctcatgacactgcactccagcctgggcgatagagtgagacttggtctcaaaaataaacaaacagaaaaacaaaacacacacacacacacacacacacacacacacacacacacacacactgggaataataatactagcggcctcatagttgtcctaaaggttaaattagttaaaacatacaaagcacttagaaggtgcacacttgtgtgtgcacacagtaggcgctatggaagtgccaacaatgcctgttttcgctgggtgagtgccgttgtgggcccaaggttcctttttgccacgtctcccatcccacactgactcaacctctctcccttcttccctccccgccccatgagacacactttccgaatctgggccagtatgtgtgtttgtggagacaccgggagggagggggggctccagttgctgtccctccagtgacttggcccttcctcccccaaaacaacggcccccaaccccatcccggtccctgcgttgcccgcaaggaggctgcttcctctcaggcaggatgggtgcaagcaccagctccccggaggagcataggggcccatgggactcctcttctgtcgcctcttacctgtgtgtcttgagtaagtcccctaacttctctctctttttttttttttgagacggagtttcgctcttgttgcccaggctggagtgcagtggcaggaccttggctcactgcaacctccgcctcctgggttcaagtgattctcctgcctcagcctcccgaatagctgggattacaggtgcccaccaccacacccagctaatttttttgtatttttagtggagacggggtttcactatgttggtcaggctggtctcgaactcctgacctcaggtgatccacccgcctcagcctcccaaagtgctgggattgcaggcgtgagccaccacgcctagctagtcccctaacttctctgtgcctcagtttcctcatctggaaaatggggtcagaacagtgcccacctcctggggttgttgtgaagagtcactgagtgagctctagctggagggcatgaagtcagtaaatcagggctagctccttgttctgccagttaactcttcgtcctccgggttcccactctgccttccctcctcctggaagtcctccttgacccccaggctgggggttgggtcaggcactggccctgggctcccacagctccctggatccccctgcccaccctgggctgaccactcaggggccaggtctgtgtccccagtgggctgagagatgtaaggacaaagctgaaactgcctcagcctccacacacacagcagggaccacagagggtgcttcccagtgggtgacatcaccatgacttgctgagtgcttaccgtacatccagcactgtttttaaaaaaacagtttcattgaggattaacgtacacgccataaaaactcaaccattatggccgggctcagtggctcatgcctgtaatctcagcactttgggaggctgaggtgggcggataatgaggtcaagagatggagaccatcctggccaacatggtgaaaacccatctctactaaaaatacagaaattagctgggtgtggtggcacctgtaatcccagctactcgggaggctgaggcaggagaattgcttgaactcgagaggcagaggttgcagtgacctgagatcgcgccactgcactccaacctgggcgacagcgagactccgtctgaaaaaaaaaaaaaaaaaaaagctcaaccatttttttttttaaagagacaaggtcttgctctgtctgcaggctggagtgcaatgacgcaatcatggctcactgcagcctccaactgctgggctcaagtgatcctcttgcttcctcctcctgagtagctgagactacagatgcatgccaacatgtgtggataattttttattttatttttttctgtagagacagggtcttgtcatcttgcccaggctggtctcaaactcccaggctcaagcgatcctcctgcctctacctcccaaagtgctgggattacaggtgtgagccactctgtctggccacttccatcatttttaaatgtacagttcaatgccaggcattattttaagctctttatatatattagctcatttatattcttttaatcttcacaacagtctttttttttttttgagacagagtctcactctgtcgcccagactggagtgcagtgatgctatctcggctcactgcaacctctgcctcccaggctcaagcgattctcgtgcctcagccttctgaatatgtgggaccataggcatgagccaccaacaccgggctaatttttttgtatttttagggctaggctggtcttgaactcctggcctcaattgatctgcccacttcagcctcccaaagtgctgggattacaggtttgagccatcacacctggcttcacaacagtcctatgatttgcattttacagaaaagaaaacacaagttcagagaggttaagctacttgcctaaggtcacacagtggatgggggcagaggagggactcaactccaggtcttccagacagctaagtcagggggtctcaatcgcttctctctgctctcctcagcattgcttgttggtgaataaatgagtgaagaagcaaaggtgagaatgagtggatgaaggagtgaatgaggaaatgaatggtgaaaggaatgaatgaatgagcatgggaacccatggctgggatgggtgcttcataagagcaagaatcttgtctgtgtgttctctgcggtatcccaggctcccaggacagggcttggcacacatgagactctcagtaagtattgctaaataaatgcaaaatatttaacttctcagcctggccaacatggtgaaaccccgtctctactaaaaatacagaaattagccagggtggtggtgcatgcctgtaatcccagctactcgggaggctgaggcaggagaattgcttgaacctgggaggtggaggtggaggttgcagtgagccacattcatgccactgcactccagcctgggcgacagagtgagactctgtctcaaaaaaaaaaaaaaaaaaaaaaaaaaaaaaaaaaaaaattatcatctgctatggcaagagcacagctatccagcatgaactctagttgctggatcgtggggagatacaacaggtcctggggaggagctggggtgatagaggcatgtggcaggcttgggggttccatagaagcacagggggatctcttagcaaacatgtcagtatttttaacaacctatatgtacataccgacgcacacctgtaataactgcttaatgaatgagcaaatgaaaaaatggaggccgtgaggctgggcgcggtggcccacgcctgtaatcccaacattttggaggctgaggcaggaggatcagttgagctcaggagtttgagactagcctggcagcccgggtaacatagtgagatcccatctctactcaaaaaaaaaaaaaaaaaaaaaaaaattagccaggtgtggtgacgcgcgcctgcagtcccagctactagggaggctgaggtgggaggatcacctgagctccgggaagcagaggttgcagggaggcgtgatcccgccattgtgctcgagcaaaggaaaagggggatgattgccccctgtagccagatggcttgaggggctggggccagagcgaggggggaaattctgggcactggagagccagagcagtagtgcccactgagggccttggctattttgcccagacaggatttggacagccaacaacgtgaacatctttacagtccaatatgcaagagaatgggatactactgagaatggctggagggtgggggtctgatttctgccccttgcgcccctgtctctccactcccactccaggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagtgagtagtcctgagggctgggcgcgcattcttggaggaggtttcctcggtcctctcctaccagtgctgtgagtccctgacttatcagggcccaggttagttagttctcttgaagttgggtcattctggcacagagtgaagccgggaggaagaactgtatggagagactcattcctctgcctttggatttctgtgtcaactccgtgtcaccctggcttctctgtcctggtatttctatttcttcttcctcttcctcctcctcctccttctcttcttcttcttcctctttttcttctttcttctctctttcctcctcctcctcttctccctcctcctcctccttcttctctttcttcctccccttcctccttccttccttccttcctctgttcctctctcccttcctccctcctcccttcctccttccttacatcctctttcgttccctcttcttccttcttttttaagagatggagtctcgctctcttgccctggctggaatgcaatgatgcaatcacagctcaccacagccttgaactcctgggctcaagtgatccttcctccttagcctgccccaagtagctgagaccacaggcgcgtgtcaccacgcccagctaattttttattttttgtagagtcgaggtcttactgtgttgcccaggctggtcttgaactcctgccctcaagtgatcctccccttttggcctcccaaagtgctgggattgcaggcatgagtatgttgaatttttgaacttcctataaaatatagacagacaaatactcattattctaccctctttattttttgataatttataagattgtggttcaaaggtttccaagttcattggtttattccacaaatatttctttttcttcttcttttctttttttgagacggagttttgctcttattgcccaggctggagtgcaatggcgtgatctcggctcaccacaacctccgcctcctgaattcaagcgattctcctgcctcagcctcccgagtagctgggattacaggcattcaccaccatgcccggctaattgtgtatttttagtagagtatttttagttggtcaggctggtcttgaactctcaacctcaggtgatccgctctccttggcctcccaaagtgctgggattataggcgtgagccaccgcgccaggcccacaagtatttctggaatgctttctgtacacatggtgctggggctggggatggagggaacagacaaggttccagccctcctggggctcatctttttttaaatttaattaattaatttatttataagctagtcaaatttagcagtgggggtggggagttgcatgccaactttactgacactaataagttctgataaccaaggccaggtgcggtggctcacgcctgtaatcccaacacttttggaggattgcttgagcccaggcattgaagaccagcttgggcaacatagtgagacaccatttctattaaaaaaaaaaaaaaaagttctgataacccactaccattggaccagccccggggcttatcttttgatggagggagacagaataagtaaacagacataaaataacaatgaaggctgggtgcggtggctcacgcctgtaatcccaacactttgggaggccgaggggggagcagatcacttgaggtcaggagttcgagaccagcctggtcaagatggtgaaactgcgtctctactaaaaatacaaaaattagccaggtgtggtggcgggcacctgtaatcccagctacttgggaggctgaggcatgagaatcacttgaacccgggaggcagaggttgcagtgagctgagattgtaccactgcactccagcctaggtgacagaacgagactctgtctcaaaaaaaaaaaaaaaaaaaaagatgaatttattacatcttaggcgcttcacagcacccgtctcccatgactcttgtttgattgtggccacagattgtccccttctctcactcctttcctctgtcctcatctcccattcccttcccagcgtcccctgcacttcacgctggtggcctcagtcctgtgcacttgctgctccctcttcctggaaacctcttctgccttcttccccctcccacctggccatccacaaggctcactccctcctcacccctttcaagactctgctcaaatgctcccttctcaggaaggctgtccatgccctcctttgaatgaatataacttcccccatatgcgtccttctttaccctaaccctgttgtcctttcctttcctttcttctcctctcctctcctttctctctttctctgtttctctttctctctttctttctctttctctttctttttctttctttctttttttttttttttgagacagggtctccctctgttgcccaggctggagtgcagtggtgcgatatcagctcactgcaacctccacctcccgggttcaagcgattctcctgcctcagcctcctgagtagctggggttacaggcgtgtgccaccacacccagctaattttttgtatttttagtggagacggggtttcaccatattggtcaggctggtctcgaactcccgacctcaggtgatccgcccgccttggcctcccaaagtgctgggattacaggcgtaagccaccacacccagccaatcagggctctttgaattccttcactgatttatccccagtgcccggaacagaattggtgctctgtaaatatttattgaatgaatgacattgaacaaacagttgcattgaacaaaatctcctctatgcctggcctggtgttgggtggtgcaggagacacaacagtgaccacgatggttccagtcctgtcctgctggggctcccagtcctaaataatgaaggcagttccagggctcagtcctcactggggctcctggagaggagacagatccatccccaggcaccgatgacccagtgtggtcagagctggggcggggtagctggggcaggcagagagggcttctttggaggagagggcatctgaggggaaatgtcagtgttgaacccagtgtagacagtgtgctaactcaattagaggctgaggatgtggctgagatcagaggtggtgtgggctgtgtccgggaatctgtgctttgtccctagggcactggggagccatgaaaaagttcggagcagggaaaggagataattagactcaagctaccttttggagggtggattcaaggcaggagagtctaggagcctggagaccaggcaaaaggcttggaggttcctggatcaggacaggccttggggagggagaggagaaaggagagcgcgggtttcagagcgattttggatgtcagatggaactttctcagggggaggctgccagggtggaggcggggcaggaagctgggcaggcagggaggccaagaaggttctagggggtggaggagcctgaggtgttggtttaaggagcagcgagagtgggtgagtcagagcccccacccccaccccaggaatcctccttcggagggagcggcccactgtggaccaggctgccactcctggaaccttcggaattcaccttgcgctcctctgcccaggcggctctgcagtgtctctctctctctttttctgtctctatgtcagtctcctttctacctctctctcagtctctttcttctccatttttactttttcttttattctaactccctttccttttctttctcgctctgcctcctcctgtctctccatctctcccccgctccgccgccgccctctctctgtcttcctcctggtcttgcttagactcccccaggttcgttcccgcgggtcccttggcgggagctggagcacaaggcccagggacagaggggtgggtccgggccagacacctggtgcccccgccgggctgggggcggctccggaaacccagacaaaccccggagtcagggacccagccccggcccagcccgccctctcaccttatctcttcctggcaccttcccctgcttcctctctggaaaagccatcagcgccctcccgcctaccctcctttggtccctacggagccgcccttcggccctgccccctggctccattggcccgctctcacaggccccgcccccagcccggccacacccctgccctgattggtccttcagaccattaggcactccctccccctcttcctgcaggttcatccatggctccccagtgccgttcaggacacaggagcatgggatttagggtccgctgtgaccaaggctcactgcccctcctttgccccgtgtcgcacccccacccctgctcctcacatatgagtccgccacacttggtcgtcaccaacaatagccatactgttaacctcccctcatgctctcctccaaagataccaggccttcctggactctctgggaggaggcattcaccctcctcccagtgcctcagtttcccatctgtacgatggagggtgtggacgaatcctctggctctaagtcctttggctgaagtgatagctgttagaaggggagattttatgatgctgtgatacgtaaggccaagatcttgggagggtctgattctatagacgccaagatgccctgaaccttcagaccacattctctgcagtggcccagtgacattcattcagcagttgccgatcgcatgtggtactcctctaggctctggggatacagcagggaacacagataaattccttttctcatagaattactttttagtggggaagcaaacattaaacaaatcaatggttatgaagaaaaatgaagcggaggaaagaggggctggcgagggactattttagagcgctctgaaggagaggaaggggtaagaggaaggggtgagccgagtggcgatcgggtggaagagcagtccatgcagtgagaacagcatgtgcaaaggccctggggcagccatgcacttgatgtgtttgaactgagagcctaacggggctggagacagggtggtggtggaaggtggaagagatgaagatttagaaccagtcagggaccaccaacgttctcagcagtctaaatttgtgattctttaaaaaaaaaaaaatatatatatatatatatatatacatatatatataatttttttttttttagatggagtctctctctatcacccaggctggagagcagtggcatgatctcggctcactgcaacctctgcctcccaggttaaagtgattcttgtgcctcagctttccgagtagctgggactccaggcaggtgccaccacacctggctaatttttgtatttttagtagagatgggttctcaccatgttggccaggctggtctcgaactcctgacctcaggtgatccgctggcctcggcctcccgaagtgttgggattacaggcatgagccactgtgcctggcctaaaagaattttttaactagtcttttttattgaacatttaagaccatctcatggaaaggcattcatactttatcagacatgattctcccacacctcaccccaccagctcccagggcctcttttctagaggcaacccccataagtagtttcttgtgtgtctttccagatatactgcattttttttttttttttttttgagacggagtctcgctctgtcgcctaggctggagtgcagtggcatgatctcggctcactgcaagctccgcctcccgggttcacgccattctcctgcctcagcctcccgagtagctgggactacaggtgcctgccaccacgcctggctaattttttgtatttttagtagaggcggggtttcactgtgttagccaggatggtctcgatctcctgacctcatgatccgcctgcctctgcctcccaaagtgctgggattacaggcgtgatatactgtaatcacgcccggccaatatactgcattttgtaaaagcatttatttattattattttgttttgagactgagtctcactctgtcgcccaggctggtgcaatggcacggtctcagctcactgcaacctccacctcccaggttcaagtgattctcctgcctcagcttcccatgtagcttggattataggtgggcaccatcagcccggctaatttttgtatttttagtagagatagcatttcaccatgttgtccaggctggtctctaactcctgacctcaggtgatcgacccgcttcagcctcccaaagtgctgggattacaggcgtgagccaccgcgcctggcctatttattcatttttttagagacaaaggctcgctgtgtcgcccagactggagtgcagtggcgacatcatagctcacttcagtctcaaacctctgggctcaagtgatcctccctcctcagccccggcaattcactgggactataggcgcgcgccagtacacccaactagttttaaaatttttttttagagaccaagtcttgctatgttgcccaggctggtctcgaacttctggcctcaagtgatcctccccccttggcttcccaaagtgctgggattataggcatgagcaatatttaatttgtgagcttcctataaaatatagacataccaatattcattattctgctctccttgtttatttttcgataatttataagattgtggaccaggtgtggtggctcacacctgtaatcccagcactttgggggaccaatgtgggcggatcatctgagatcaggagttcaagaccagcctgaccaacatggagaaatcccatctctactaaaaatataaaattagctgggcatggtggtgcatgcctgtgatcccagctactcaggaggctgaggcaggagaatcgcttgaacccaggaggcagaggttgcagtgagacaagatcgcaccactgcactccagcctgggcaacagagtgaaaccccatctcaaaaaaaaaataaaaaataaaaaataaaaagattgtgtttcaaaggttctcaagttcattggtttattccacaaatatttcctgagtgttttctgtacagattgtactggtgctggagatggagggaacagacaagtttccagcccttctggggctcctttttttttttttgagacagtgtcttgctctgtcacccaggctggagtgcagtggtatgatcatggctcactgtagccttgacctccccggcttcagtgatcctcccatctcagcctcttgagaagagaagattaataaatcaagacattaggccaggcgcggtggttcatgcctataatctcagcactttggaagactgaggcgggcggatcacaaggtcaagagatcgagaccatcctggccaacatggtggaacccagtctctactaaaaatacaaaaattatcatggtggcgggcgcctgtagtcccagctacttgggaggctgaggcaggagaatggcgtgaacccgggaggtggagcttgcagtgagccgagattgagccactgcactccagcctgggcggcagagtgagactctgtctcaaaaaataaataaataaataaataaataaagtcattatttgcaccactgcactccagtctgggtgacagagcaagactctgtctcaaaaaaaaaaaaaaaaaaaaaaaatccactgtccatttgggagaaaaaaagagtgaagaaagcaaaaagcgaataacgtcttagtattgttcttaaaataattttgaccacaggaacccccgaaaggatcttgaggacccctgggtttccctggaccacacttcgtgaattgctgctgtagggctttgtcggcttcggtagaaattttgaacttcaataagcaaatagagagttatgagcagcatcccctgggctcatgttccttcctgaaaaatgccctcttgggccactgctgcatggagcaagggttattggggcaggatggggagctgggagacctgtcgggccaccttgggtgtctccccaggcaagagaggatgacgctcgaatggacatggtggccactgaggtggagagaaatgagaagcaggggagaggctgggcgtagtagcgggtgcctgtagtcccagctactcaggaggctgaggtgggaggatggattgagctgggaaggtggaggttgcactgagccgagattgtgccactgcactccagcctgggggacagagccagaccctgtctaaaaaaagcaaaaaagaaaaggaaagtaggggagagagggagagacataggaggaggcaaaagggactcattgataggttggatgtggctacttaacaggaggaagaatcaaatatcaaatcaataatgatttcaagagctgggtaccgtggctcccgcctgtaatccagcactttgggaggctgaggcaggcagatcatttgaggtcaggagtttgagaccagcctggccaacatggtgaaaacccctctctactaaaaatacaaaaattagtggtggcgggcacctgtaatcccagctactcgagaggtagaggcaggaggattgcttgaacccaggaagtggaggttgcagtgagccaagatcatgccattgcactccaccctgggcaacagagtgagactccctttcaaaaagaaaaaaaaagtgatttctagagccggacggggtggctcccgcctgtcatcccagcactttgggaggccgaggcgggtggatctcttgaggtcaggggttcgagaccagtctggccaacatggtgaaagccagtctctactaaacatacaaaaattgaccaggcatggtggcacgtgcctgtaatcccagctactcgggaggccagggcaggaggattgcttgaacccggaggtggaggttgcagtgagacaaggttgcgccactgtcctccagcctgggtgacagagtgagtgagactccgtctcaaaataaataaataaataaaaataaaatttctagatttctggcctcaactgggaaggcagggctggggatgcccttttcagagatgggcacagctgagggcgacacagctctgagggctaggctcaaattccacttagggcatcctggtatggagctatccaggaatgttgacagggcaattagctctgagtcctgagctggagggagaggcttaggctggtatgcagattcgggagtggacctcttggaggggtgtttaaaactgggagggactcagctcacttagttagcagagaggaggagcccagggtgagccccagcaggaggaggccatgaggctcacagtgtggcacctccgcctgcagcacctgtaacttgtcagaaatgcaaattcccatctgggcagtggctcttgcctgtaatcccagctacttgagaggctgaggcgggaggatcccttgagcccaggaatttgaggctgcagtaagttatgatcgcaccactgcactcctggctgggtgatagagcgagaccctgtctccaaaaaaaaaagaaaaaaaagcaggccaggcgcggtggctcatgcctgtaatcccagcactttgggaggccacggcgggtggatcacctgagattaggagttcaagaccagcctggccaacatggagaaaccccgtttctattaaaaatacaaaaaaattagccgggtgtggtggcgcatgcctgttaatcccaactacttgggaggctgaggcagaagaattgcttgaacccaggagttggaggttgcagcgagctgattgcaccactgcactccagcctgggcaacagagcgagactctgtctcgaaaaaaaaaaaagactgggcacggtggctcacacctgtaatcccagcactttgggaggccaaggtgggcagatcacgaggtcaggagtttgagaccagcctgaccagcatggtgaaaccccatctttactaaaaatacaaaaattagctgggcatagtggcgcatgcctgtaatcccagctactcaggagcctgagacaggagaattgcttgaagccgggaggcggaggttgcagtgagccgagattgtgctactgcactccagcctcggtgacagagcgagactccgtctcaaagaaaaaaaaagagagagagagagagaaaaagaaataaaagaaatacaaattctcatgccccagcccagaccaagtaaatcagaatctctgggagtggggcctgcagcctgtgttttaacaagctccctggtggaccctgatgcaggctgaggtgagaacccttcccacaggttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggtgggaagctgcccaggagggaatgttgggggtgggtgatgggaaggttggtttctggaagctctgagatgggacctcaaaagccagagggatggatggcaggttctggaaagcgcctccctcaaatagttccgtgggagcatggttttatgagtcaggctaggggagtgaagagaaaacccaaaataacagtggctaaattaagatagagagtttttctttctttcctccataaaaagtcccagaaagtgatccaggactggtttggtgctttacagagccagggatctagtccccttctgtcttatttctcttccatgcctggcctccaggcccaaggaacttcatggtacaaaagggctgtgaaggctccagccattgtgtctgcgttccagccagcaagaagttgggaagggggccaggcatggtggctcacgcctgtaatcccagcactttgggaggccgaggcgggcggatcacgaggtcagcagatcaagaccatcctggctaacacggtgaaaccccgtctctactaaaaatacaaaaaattagctgggtgtggtggtgggcgcctgtagtcccagctactcgggaggctgaggcaggagaatggtgtgaacccgggaggcggagcttgcactgagccaagatagcgccactttactccggcctaggcaaaaagagcgagactccgcctcaaaaaaaaaaaaaaaagaaaaggaagttgggaaggggaagaaaagagtagtctctttaagaacactgtttattttattttcatttatttatttgagacttaaatatttatatttgtaaaatataaatatttaaaatatacacagctgggtgcagtggctcatgcctgtaatcccagcactgtgggaggccgaggcgggtggatcacctgaggtcaggagttcgagaccagcctggccaacatggtgaaaccccgtctgtactaaaaatacaaaaattagctgggcatggtgttgcgtgcctgtagtcccagctactggggaggccgaggcaggagaatcccttgaacccgggaggcagaggttgcagtgagctgagatcacaccactgcaatccagcctgtgtgaccgagtaagattctgtctcaataaataaataaataaaataaaatatatacgtttaaaaatttatttatatattttttagagatttatttatatatttttcagagactctgttgtccaggctggagtgcaatggggtgatcatagctcactgtgtacttgaactcctgggctcaaaggtccttctgcctagcctctagagtagctgggactacaggcacatgccaccatgcctggctagcttttttttttttttttttttttgagacagagtctcactctgtcacccagaccgaactgcagaggcgtgatcttggctcactgcaacctctgcctcctgggttcaagcagttatctcacctcagcctcccaagtagctgggcctgcaggcatgtgccaccacgtacagataatttttcatacttttagtagagatggggttttgtcatgttggccaggctggtctcgaactcctggcctcaagtgatcctcctgccttggcctcccaaagtgctgggattataggcaggagccaccatgcctgaccaagaacactttctagaacagagctgtccagcagtacgttctacaatgatggaaatgtttcattctgcactgtccagtatggtagccactagccacattcaaatggaatgttaacgtgtatttcttttttctttttttttgagatggagtcttgctctgttgcccaggttggaatgcagtggcaagatcttgactcactacaacctctgcctcccgggttcaagcaattatcctgcctcagcctcccaagtagctgagattacaggcatccgccaccacgcccagctaattttgtatttttggtagagatggggtttcaccatgttgtccaggctggtctcaaactcctgacttcaggtgatcctcctgccttagcctcccaaagtgctgggattgcaggcatgagccactgcgcccggcctgtatttcattttaattaatgtaaataagcacatgtggctagtggctgccatactggacaggctaacagtagaagctgcacatgcaacctgtgcttgcctcagtggacttgaacttagtcatactctggctgccagggaatccaggttgcaacctaggatccccaacccttcagagtcgtgatcagctggcctctctgccttggctcaggaaattcacatagggctgtgaaaggaatccattttcgcagagactgtcctggtgcagtctgggccacttagagtagcccgtgtgagaagcagtgtgacgccaagcccacccctacaccccaaagtgacttcttcggtggggagggggtggtcccaggaacccctgatgatctgatcatctcaaatctcacctccaaatttggcagccagccactcagtcctttctgtgtggtgtggtagcactgtgacaggaattaagctttcttaactttcttttttctctccccccctgcacacttttttgttttgagacagggtcttgctctgtcacccaggctggagtacagtgtggtgctatcttcgctcactgcaacctctgtctcctggggttcaagagattctgtctcagcctcccaaagtagttgggactgcaggcgtgcaccaccacacctggctaatttttaatttttttttttttttttttttttttttaagaaatagggttttgaggccaggtgcagtggctcatgcctgtaatcccagcactttgggaggccgaggtgggcagattgcctgaggtcaggagttcgagaccagcctggccaacatggcgaaaccccatctctactaaaaatatgaaaatcagctgggcatggtggtaggcgcctgtaatcccagctacttgggagtctgagccaggagaatcgcttgaacccatgagacggaggttgcggtgagctgagatcgcgccattgcactccagcctgggtgacagagcgaaactcgtcaaaaaaaaaaaaaaaaaaaggaaagaaaagaaaagaaatagggttttgccatgttgtccaggctggtcttgcactcctgggctcaagtgattctcccacctcagcctcccaaagtgctgggattacaagtgtgagccacccaagcctgctgagtttttttttttttaacttttaatgttgtacgtgctggctgggcagctggagttgggtagagggcggttagggttctaggctggtgtggatgctctgagaaagctatacttgatgcgaaaatattgaaatccttctctgctagctggcaaagggccgctgctctcactcatcagaggggccccagcctccccaccctccagtaattctggggcacaggagaaagcctctgggaccttgttgcccaagtatcttctcattggtgggtgcccgagcggaacaggttgttcagatgttcaaatacttctgcatgtgtcagtaaagagctgccactctggctgggtacagtggctcacacctgcaatcccagcactttaggaggttgcggtgggaggatggcttgagctcaggagttcgagaccagcctgggcaacatagcaagacttggtctctacaaaaaatttttaaaactagttgggcgtagtggcgcacacctatagtcccagcgaattgcgggggctgaggagggaggatcacaaaaatttagctgggtgggtggtgtgtgcctgtggtcccagctacttgggagactgaggccagaggatcgtttgaggctgggagttggaagctgcagtgagctatgttggcaccactgcactctagcctaagtgacagagcgagaccctgtcaaaaaaaaacaaaacaaaacaaaacaaaaatggctgggcgcggtggctcatgcctgtaatcccagcattgggaggctgaggcgggcgaatcatgaggtcaggagttcgagaccagcctggccaacatggtgaaacgctgtctctattaaaattacaaaaattagctgggcatggtggcgcatgcctgtaatcccagctacttgggaggctgaggcaggagaatcgcttgaaaccggaaggcggacgttgcagtgagccgagattgtgccatttgcactccagcctgggcaacaagagcaagactctgtctcaaaacaaacaacagtaaaaaaaccccacaacagctaccccctgagcttctccagtgtcctgataccaccttgcagcctgagggcctcagggatggcgccgcttgaattctgggtgcccctgtcccccaccacaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgccttggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccatgtggcagtcaggctggcttgggacagggatcgcccgccctcccccagggaaagagagacctgggcaggatttggggtggggggaggcccccttccgtgctctcaggggcggggtggagtccgtgactcaatgcagcgaggcctggtgactcaggcctgggctgggggccagaacggcatattttccgaggaaaagtgactctggggccctccccccgggacatcccttcctcccacctcccgcggcgggggcctgggaaccaagccctggggcgcgcgcggggtgtgtgtgtgt

SEQ ID NO: 13128 - DNA, 31314 bp, Human
ttgtattttcagtagcgacggggtttccccatgttggacaggctggtctcaaactcctggcctcaagtgatcctcctgccttggcctcccaaagtaccaggactacagatgtgacacactgcacccaccaacagtgttgaggagtactgggcaagtattttggaggatgtggctcaactggaatttgtctagtgtttttttcatgattagattgaaagatcccagaagtaaagagccattttaatcacatgacttatcaatgttgaggttaacctcaatcacctagatgtcaatgtcaggtttctccactgtaaatttaggctttttctcccctttcttgtaccctcttctttgaaaggaagtcactatgcacagtccatacttacagaatggggaggtatccttcaccttcttgagagcagagtatctacgcagattatttggaattcttctgcacaaactatttgtctattctcccccctttatttatttgttctatattcatctatatgaccataggctcatggatactttatgtttgggattataatccaatactactttattttgatgctcaaattgttccagctttggccattgggagttctttcagttggctcctttggcataccccctaattttgtgtgtgagcacacgtgtggaatacttccttcctttctggcactacaaagttatactgaggtgagctatgattgtgctgctgcactccagcctgggcgacagaccgagaccctgtctccaaaaccaacaacccaaagagtgagaccctgtctcagaaaccagcaactcaattttctgggacagcaggaggtgtgtttgagcctaaacttttttttttagagacagagtcttgctatgttgcccaaggcgggacttgaactagactcaaactcctgggcccaagcgatcctctcgcctcccgagtagctgggattataggcacgagacaccgcgcccatcttcgaatctgaatttttttttaacacgctctcttcagctattttttttttttttctgagactaagtctcactctgtcgcccaggctggagtgcagtggcacgatctcggcccgttgcaacctccacctccccggttcaagcgattctcctctctcagcctcctcagtagctgggattacaggagtgtgccaccacacccggttaatatttgtattttagtagagcggggtttcgccatgttggccgggctggtctcaaactcatgacctcaagtgatccgcccgcctcggcctcccaaagtgctgggattacaggcgtaagccaccgtgcccggccctcttcagctattttttatgaaaccagagttagagaacctcttaagtttttgtttgcagtctctcttcaccggtctccccaaagcagttccagtactggccgacagagggagcaagaaaaagcagaacggtttccttttcccacaaacgcctttccaagtgaagaaaccggcgagaccagccgcgggggcgggactaagttctgcgcagaactgtcaaacccgggcgtgggccccgagctgtcacgtgagtgtctgcggtcagctgactgtgccagagttccgcggggagggcgagtgggggaccccccgccccagcgcgagccgagggctcctgctgattggtggaggaggatccagcagcaacaccgtggggcggggcctcggcggggggtactgccattgccttccacagggtcacgtgggaggtgaggtacagagcgctggggagagagtggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttgggtgagaaccgggctgaggggtcggccgggacctaggctgagaggacgaaggagtcacgctcggaggtggcgggttagggcacgcagagctcgggccgaggggacggagaggaacctgcaataaggtgacatggcctgaggcggcagaggggacgcaggctgagggccaagagcctgggccggggcaacacggtttgaggagagacggtctgacatggcggaagggatttgggctgaggacacacggaccgaggcgacactatcttgaggcgaggaaggggacccaggccgaagacaggccagcgggcgggggagaacctggaccgagggagtacgtcctgaagccttggaggggaccggcctggggggacggagggagtccgggagagaagccaggtccagaggcttttcggagctctaggggagtctgtttgaaggctctcaggcggcagtgatggggcctggggctgaggacgcctgcccgagggactgaccttttcaacccctggagcagtggatttgcgtgggccctgggcggtgagggtgaaggctgaagggggctgacaccaggcagaggggctcagggctagatgatcctaggagcggtgagccgcgtctgaagtgtggggggtgcatggggtgagtacggccctggttagcagtgactagtttaaggacagctgagcggaggaacccgggatgatggagtcaagactgtggaggtctcagcactttgggaggccgaggtgggcagattatctgaggccgggagttcgagaccagcctggacaacatggtgaaaccccgtctctactaaaaatacaaaagttatctgggcctggtggcgggtacctgtaatcccagctactcgggaggctggggcaggagaatcacttgaacccaggaggtagaggttgcagtgagccgagatcgagccactgcactacagcctgggggacagagcgagactctgtctcaaaaaaaaaaaaaaaaaaaaagaaagaaagaaagaaaaaagcctgaggaggcctgggttgaggctggagactcctgggtgggggaatgcgtggtggtggcttggccaaggagatggagggataacagggagagacagggggactgagagaaccaaaacgggggatcaaattcctgctgtgtgatcctcgagtaatagggatgacagagacatgctgagaagagggatgggaaaaggcctgggagacagaactaacacatatgacgtggcataaaactcacgttagctcctaaaagctgacacgaccatcctgtgataaattgtagtggcttagaagtgccaagagcccaagtagctctgccacttacttcatgactttgggtaaattgtttagtctccctgctaaaggagatcacaaatcaaacctacctcccatttgctatgagtgttagaattgagcctggcgtggagttacatctctgagagtgttagctgttgttaatgtgacttccagaaggaaacaggttcggagcgtgcagagagctgatgggggttcaaggtggacgcccgagcggagaggtctgggaggggtcaggagagggagagactgagaaacatgagtgtgctaagaggagctgaaagggaacagaaaagggatccacgaagacttagtagggttgagaggagcatgaggctctgggcagaggaaggagaagggagtttggcagggggcggtggtgtgggaggtggtgggatctgtgctgatgggacgacccgaaagggtcaaggggaggttgtggaaactgagaggagacctgggaaaggactagtgggcttgtagagagaacagtgtgtggtggccactcagaagcagagcctggggacggtggtgggactgggaacatctgcagaaggctggagaagggggtttgggaggagggcctggggatgggaagagactgtggtaggagcctggcagaggctggtaagacacgaaggagagggatctttacaagagaggaaggaacaggaaaagggctctaggccacgccccttgtttgaggttggataatgtttagcaaaataacttgaagaacatgatggcgaattgcctggtgtggagaaacatccggggctgatggactggattgattaggtgaaaaatgttttattttagaggctgcgaggagagagagggtgtgtgtgtgtttctttttcttcacaaggggagaagttcaagtgctgtgtttgggggtggggccacgagctgggtttttggtgatagttttcctgggtggctctgggtgtctggtccctttggcccagggattagtgggctgttggactgtgtgcttggagggagcagctaagtcagccccaaggcatttgctacctgattgggaaggcaggatgaacagcaaacaccaataaagtggaattacctactgtaaggaggggctcgatgatgtcattcctgtgactgtctgagctcagaggaagcagcgtgaaccagggggaggctcttggtgaggagtgagctgggccccaaggaaccccaggacttgctggggagtggggccggggagggtgctctaggcagcagggatggtgcaacagagatctaccgtgacgggaggttctgcctggaaagacagggaactgagatccagagggatcagaaatggcttcctgggggagaggccccaaccctggggggatgaacatgagttctggggtgctctctggcagggagcagcactccaggcaaggattattatggagcatgccttaggaagatggaacacagggagttccacgttagaccataaaggtggaagcggcaggtgaggccagacaaggaaggtctggtgagcaagggctgggcctggaggaggcactgaagatctccgaggaggctaagggaggcccatcctggcgagctcctgtttgccttctagaaaggactgcagcagctggtgtgggggagagtgacagcaggaggctgttgcagtgccggtaatactagcagatgctggttattaagtgctcgctctgactcagaccctggcctgggccaggctcaacctgctgatggatggtatggatttagtccttacaaaatccccgtggaggtagagaaacttgggggcttagagaagttgacttatttgcccagccccacagtaagtgggagaagtggcattcaaacccagttctgtgtgattccagagccttctcacttagcccctttgctgtgctaccacggtagtttctcctcaaggttcatgaccatctctgggcactacatttaggaaggatgttggcaaactaggtgtgttggagagctgccaccctcttaactgtcctcccatggctgttttctccaaatatgtgaaaaaaagagctggtgtgttcatctcagttccttccagctcccagaggagctgacctggtgctgtgggagtatgagtgaggttagggcagagggcagggaggatgggaggctggcctgaccggagcttgtgtgcctgggagctgggagcacagccagaggccagcttgggaggacctgcttggcgggcgggaatcactcaggcacctcctcctctctgatctgggtttgcttgtgttcaacatttcataacccacctttattcaaggtccttggtagctgccgggactggagaagggagcgttgcggctcagcttgtccttggtgcctctcccttcccctttgggaaccccagcaatgacagcatcccacattgaggggcctctgcccctgtcaaagggcaagtcagagagcccgcacctgggacgcaaggcgatgggtgtctgtgctgtcgcctgccttggtgctcagatgccacccttgctcttcattatttctgggctgccagacgctagggggctttgatgcaccagcagccactgaaggcgacagcaccagccagttaggagaagctcaaagccatacctgttcctccccttggtgatgggggcgcagctcaaacttctgctctggaagcaaaaagacggagacttcctaactacagcacagtgagccagcagcagaaggggatggctgagtccaggcacactagttcctcctccctgctgcgtgtctcctggggaatccagagtgcctgctgtgccgtttggggatcctgcaggttctgaatggcggctctgttccctggggcttttcctcatccctgatgtttcccagccacctcccctgtccccaaaatagccaaaataaaaacttccttcctcttggatacaaacgtgtagagggagtttcttcatctgtgaaatgaaaatcatggtaactgtttcctcaggtggttttaaggataaatgagacgatgtgtgggaagtggtgggagcacgttgcctggctctgctaatgtttattaagggctcactgtcatctttattagtaggtattgtcattggaagttgagctagaagtgctggagaaataggtggcagagggtgttctgtatacaaacagtgcattcctaagatcagatcttgacaaatcagttcctgtttgaactacctgtaggcaataacggcgggaccctgggagggccagcttgtctgtacagggcctgcccagggccttggctgagactggtgtgggcacgagcttccagatttctctccagaccgccttcctctgcagagcgtgcagaaaccccggcgccatttccagtgggcaccctggtgaatcacagtgccctgccagctgccaagatccacaactgaaaacttggcatctcttgcccagtctcagagtggagtctttcctgagggcacacaaggtttctggggaatccgagagttcctggctttcctgatggataggactttgctgcctggccatacaaacatttccgtctcctttttgggatggggctactgagaggcaagggtctttgagaacaccttttaagaaaaaggaagtacattcgcccttggtctgtggtgaaatgtaatcccgttggggtgcaggagggcatccgtataagaaaataagaaacagggcgcctgccaggctgtgtgccgtgtggcaggtgagatcctggctctgagctcatctcgaagggccgtgggcctgtatgtattttgagcattgtgcagtaaggggtggggcatgggaggccaggactctggaagccgaaggaggagcattacttagctaatctgggatggagatgaagcccatgctgctattctgaagtagggaagcgtgcctggaatcggtcctctgcggggcctgatgagagggatgctctcgtttactgaacgcccgtggtgtggccagctctctgctgggcacgccgtggggtgctgcctgcaagattgctcgtgcttcagcagccctgcaaggtgtggagtcttatgcctagttacacataaggaaacgcaggctggcacacgatgagctggcgctgaggccaggcctgtctgactactgtcagcatttattttattttattttattttatttattttattttattttattttattttattttattttattttattttatttttaccaccacaagaaactctctagaattcccattcctgggtggcaggcacccctttgagcgtatttctcttcctttgtgtaatagcaaccattgagcaccttttccattctgcgctctgtgccaagtattgactatgtgtcatttctaatcctcacaaagactcctcccaggccagattcattgtctccattttatttcatttttcattttttgagagacagggtcttgttctgttgcccaggctggagggcagtggcgcgatcatagctcattgcagtctcaacctcctgggctcaagtgatcctctcacctcagcttcccaagtagctgggactgtaggcatatgccaccatgcctggctaatttttagtagagttggggtctcactgtgttgcccaggctggtctcaaactcgagatcaagcaaccctcctgcttcggcctcccaaagccctgggattgtaggtgtgagccactgtggccagacatgctgccattttgtagataaagaatggaatctcagcactttgggagcagaggcaggaggattgcttgagcccaggagttcgagaccagtgtaggcaacacagggagaccccatctcttatttaaaaaaaaaaagcctcagggataactagccccaggtcgaacacttagcaaagtacctgaaacggacttcagcccaggtctcgccaccccaaagtcattctctttctaccccttgtctttgcccagacaggcatgtcacaagagggtcctgtggcgatttcagagctgggcagttagcctgtgacactttattctttcaccgttgttaactggggcttgtggagagatgggaaagcagagctgggctcaggccccgccctgcaggaactcatactctgcttggtcaggcaaggcccactgcagagtggcgggaggcagctggtggtttcccgcttccaggtgatactggtggcggtgccttcaggatgctgagcctctggcagctcccagttccagtgcagtcagtggactagcagggctggtggcccccggctccctgtgccagggtggaccctgcaccacaggcagccttaactttttctgacgttccttctgcctgttggcttgttactggcaggctcggtagggggctggcttaattcatactcctttgcctagaggatgctccacgcagctccagcagagagcagcctctgctcgtgagatgagggaagcctaggcagtacaggctccctggcttctttaatctagaggaggggtgggggcaggcagggaccttgtcctccctccttattttcccaaggagccttgggcatggggaaggaagccttcctgatcactgagtgagaggcaagggcaggactggatccccagggccccagtcctctttccaagccctgctgcttcctggcagggtaagcttggacaagccctccgccctctctgagccccagcttcctcgcctgtaaagcaagggcagcacccaaagggctctcgtgaggagctgtgggctccttccaggggagtgcctgggaggcagggaacgccatgcgccagccgtgattaaggcacatggtctcgagagccgtgcaggaggtgggcttacagggaagacacaggcatgtgacgggccctaggacaccttccccactgagggtgctgactggagacttggggcagtgggccttaagtctgaggaggaaaccgtaggcctgtggctgtggcttccacagaggcaagagagatagagtgagtccaggacccgaaatgggggcctgactttgtccaccctgcctcgtgaggtccttcgggagctgcaggtggtgggtctcagggcatggtgtatttctggcagccaggaagtgcctggtggatggaggaaggaaggagggggctaagactctgccctgcacaaccccctggcccaggtcccatcaggcatctgtgtattcctggcagtgcccagccttccatatggcagtccctgaggttggtggctgtgtttgggagacctgagactccttcctccgccttggagggggagagagcaaagctgagcgggtaattatagacagccctgcatcaggcagcccaaaccagttccctctattcccggagtggctcagagccgtgggatgggaggagtgaagcagaggcagcttgggggaggtcagtgggggagggacagtcagctgtcacatgcgctgccacccaggccctcaggagaggaggcccagctagattttcctttcgtgtactgttgttatctcctggcacgtaataaatgctcggatacctgttccccaggtgaataaatgtgtatgtgaatggcttcttcaggatcttccactggaacctaggcacgtcactttccccctttggggacttcactcccatttctaaaagaagaggatgggaccctggagatctcctgtcatcccctggccatggtaatgggcaagaccgcggggtgcaggggaagaaggaggcaagcctggggcctgagcaggtgttaatccctctggcctttccaccccacagaatcattgaccccgtgcagggttggctgtgcttagcctgggatcacagagtttcagcccgggcagctggtaggctttgtgtccgtcctgaaataaacccggctgggctgactctgctcattgttgattgcccgctgtgggccactcagtgacgtgggtcatttctgcccatccagggtctgtgctttttcagagagtgcatggagctggataggacttagtcacactcaaaaagaagggaaggctgagctgggggacctgtggggtgggcagacctgtgattaaggtctgaaaatgtccctttaagagaacattccagagaaggtccttctgagggttttttgcagccaggccccaaaggacccttcaggattctcagccagaaggttttgaaagtttcttacctctccaaggccaggaatgggttctaaagaagtcattccaggctgggcacggtggctcatgcctgtaatcccagcactttgggaggccgaggcgagtggaccacttgaggtcaggagttcgagaccagcctggccaacgtggtgaaaccctgtctctactaataatacaaaaattagtagggtgtgatggcacacatctgtaatcccagctactcaggaggctgaggcaggagaattgcttgaacccgggagttggaggttgcagtaagctgagatcgtgccactgtactccagcctgggcgacaagagcgaaactccatctcaaaaaaaaaaaaaaaaaaaagaagtcactccaaacaaggcccaaggtgtgttgggctggctgaggtgaggtgggtgagggaagacagagtgcagcagggcgagtgcgggaagaacacattgctcagggccacttcccagggacagcagagggtgggggacagcatcagcacagccccagaaggcagagggtaggcttttcatctggcaagatgacagagaggataggaataaatagattatttacctggtgtgatgtggattcaggaggccaggatccctggcccaaccagcccgcccaccgtgggggcatttatttgcctgctgacattgccaggcctggccgctgatctgatcgctggtggctgctttccaggtagtcggtctcagtcaatttttccttctcaaactcacctgatcagctgaattacctgggccccccaaaccccaattgttaaaaatctcatttgcaggccccatccagaccctactgagcgaatcccaaagtgtgtggctgtgggactctggtttgatgaaatgagcacttcatgtggctgaaagggatgggcaggttggacacactgaatccgcagtgcagagggaaggaatgctcacatcccagctcccaaaattacctttgagcccctccacagctggggttggtgtggacaagttcccaggtataatgttgggccagttgacacagggtgtgggatgggatggtgaggatgatttgaatgggaaagtacccactcctcccttttctcttccttaaaaataaactaaacactagttatgccagtgaagagaggccctgaaatccatttggtgggactccagagtgtgtggattttattctactgattatgtagatattgggagtttgagcagttacagagactacagacctcgcgggctaagcctggttgtattattaagggcagaagaatgcagtgggacttacgggtttgaggtactaatgaggtcccccaagtcaagaggaggctcattatgtacatgtggaggtcaagaagccagagtgaagctgcccaaacagggtaccctttatgttttcaaattcctgtctatctcccagtgtatccctactgttggacaataagtttttggggggttttgctgttttaaataatgctatgctgaacatccttgtaacttttctgattagtttttttaggataaattgctagagatgtaattcattgctggaccacagggccaaatataaatcctaatacttaaaaatatgtgtgtgtgtgtgtctgtgtatgtgtaaatgtatagatatatacacacatatatacacatacacatatatacacatgtgtatatatgtacacgtgtgtgtatatatgtatatattttttttctcgaaaagatgtacaaacagttaaaaaaaaattcagacagtacaaatacgggatgtccagtgaataagtctgcctcccacacctggccctccttctgcaggcttcaccttaagagaaaaatgctgttactaggtttttgtgtatttgcccagaaatatcctatgtttatataaacatgtatgtttctattattttcactctctttctcttttttttttttttttttttttgagacaaggtctggctctgtcgtcgtccaggctggagttcaatggtgtgatcttggcttactgcaacctctgcctcccaggctcaagtgatcctcccacatcagcctctctagtagctaggactacaggcgtgcaccatcacaccctgctaattttttgtattttttgtagagttggggttttgccgtgtggcccaggctggtctcgaactcttgagctcaagcaatccgccaaccttggcctcccaaagtgttgggattacaggagccatgaaccaccacacccagcccaccctcttttttttttaaacacaaatgggaacatcttatatctacactttaaaatagtgcttcccatttctttgtatggctgtgtgatatatatgcccagtcctgagctggtaatgacacactccagggctgcaaggtctttattgagcaaccacagagtgcaaggcacaggattaaggctgcctctgcgaaagcaacacgatgtcttaaactgggctagtcccccagaatgctttgcagtctcccggggaaaggggatttgtagcgtgcctgggacccagtgggcccctagtatcccaggcaggaagtagaagaggctgtcagaccctggggttgtggtggggtcaggaactcttcgccccactaccccagcaagcacccagtatctaccccagtactcccggagggagctggtctgcccgaagtgagtgtgccattgtatgcaggggcgggggccacagactcaagaggcctgggggaagctggcttcacaggtgaagggtgaggggtaggggcacgtctgtgcccggcactggagcagaatgcttgctttctcctggatagccgactagattgtctcctttttttctttcctttttccccagaggctcatccaaaatagaggaagcatgcgaaatctacgccagagcagcaaacatgttcaaaatggccaaaaactggagtggtatgtcatctccgctagagctcctccaaggtgctctcctcctccctcagcttccactcacacaggcctgcccgagaggttggccttgagggccctttctctttgtatgccctctccggcatcggaaagccactggcctgctctcttgttttgtgcctgctgggttactttatactctgggtcatggggccttggtgaaaggacagagaggatgggaataaatagattattagacctagataaacccatgtggattgatgagctcttagagtcctccttaaattcagaacttcaggtttcctggtaacttccttagtgcttccatcagtgtctaaattctaggctgggggaggatgttcaggtgattccaataacaacgtgaatcatggctgctgtttgttgagtcctaagtgctcatcatttaattgcgttagcacagcagccctaagggtcagtctataaatatccctattttacagatttggaaactgaggcttggcttagtctcttgcccaggatgccagaactagtaagtgacagaaccaagattcagaaaccaaggctctgactgcagagcctgagtgtttaacctgccccagtgaggcaggatagcttcacagaggagaggggtggggaggagccccttgggctcagggaggctggagatctgtttggagctccctgcaggcccaagaagtccaacaagccagtgtgttgagccctttcgaggctcatttcatcatacatctttcatgtcaccaagattgaattaaggaaatacggcaagagacccagtgtttgaatgcagggaggaacttctgactgtggaggagagggaacctggtggtgggaccatggaggcagggtgcagaggtgcacaataaaattgattatcatcgtttttgagaatgttgttggtttccccaaaattcaaagagttattcctgagttttcacaaaatacgttgtgaataaagccaaatgttttttgtatttttatgctcccaaacttagaaaattcctctagagaaaaaaagcttattttttaattacataggtgttgcttttcccctaaaatttgttacctctgcccccaaactcttcaaagaaaagccctaggccatttccccccggtaatatccccttttcttgaaatttttttttttttttttttttttttttttgagacagtcttgctctgttgccaggctggagtgcagtggcgcgatcttggctcactgcaacctccgcctccctggttcaagtgattctcctgcctcagcctcttgactagctgggattacaggcacgtgccactacgcccagcttatttttgtatttttagtagagacagagttttaccatgttgtccaggatggtctccatctcctgatctcgtgatccgcccacctcggcctcccaaagtgctgggattacaggcatgagccaccgcgcctggccgtaattttatactcaaatttggaactcttgaaaataatgaaatcatatagtgaaaacccggaaggctttgtcttttctgctgctcaaaacttaagaggatagggccaggcctcctggtcctcttccagcttagaaactctgactcagattcagctggaggagaatgaaggggagaagcctcagagctgagctggaggtggtcagctgcacgaggaggaggagagatgctgctgcctcccaaacgtcagttaggagatgtgtgggcagaatggcttgggacccacagaagctgaccgtgtgcagatgagcacaggatggatgaggcttcaggcgcggtctcttctgccctccgcccatgggcactggtctgcatgtattcattcttgctgtccacatcctgtttccctctctggacatgcagctcctggagggagccggctctgtgttgtccgaccccaactccatgagcctcacaattcatgcaagtgccttgtccatggggatctgcagtgaagggaacagaatgtgaacagaggcagaggagttgggagaatcaggaagagctttggggagctgtggaaaaagaaacaggacttggaaaggggagtagatgggaagatgttatgtggtttaatctcagttgccccttgcttcccaaaatacccctccgaagccaccccatgatttcagcctgtactttgccttctagtggtggttctgggccctgtgcttcgaggctcccctggggaggactgcccaggccgggaggtgcaggaggccacctcactctgttttatatcctttccaactcagctctatctgccttctccttggatctttagaagtggtggccctggaaatgctggcatagctgggattagggacatggtgttttacctgggcttaccctggctctctttccatatacctggggctcagggccttcccccgaggcagcttcctgccgccctcagagactgtcaggtgggccaccaggagcctcagcgcaggagccagcagacctgagcgcaggagccaggagacctgagttctaggcctcggtctgggctcgctcaggtcaccctcgtcctgtcttggggactctttccgcattctcgagagcccgacccacctcccagggcagtgtctctgtggcttcataaagtgtggagccccactgaggccaggactgcccttctcttctgttccagctgctggaaacgcgttctgccaggctgcacagctgcacctgcagctccagagcaagcacgacgcagccacctgctttgtggacgctggcaacgcattcaagaaagccgacccccaaggtgagggcctctgcgggccacacgggctggctgtccggagcgccatcctagcaccctgcattgattcctcaggtttcctggcggctctggtttttccagtggccgacatgtgataggctggcaggggcgtgcctgaggcagagtgagcgttgactttagaactggctctcttccttccagttggcattcgcgccctgctcaagtctccgcccccctatctaccgtgtcggtggtgtcggtgcagctgatcaccccttcccaatcccggagcatttgggagtgggagttccattgcagacccaccgcctgccggggagagaggaaaatctgttctgttgtcagaattaacatgcagaagggagcggtgtggggggcggggaggattctgagaccagccaggtaggagttgctgccgaaaaaggagcggaaattagcccaacctggcttccctacatcctggggaggaattagagagaacagagcccgagatgtagttgccagagaacaaattacttaaaatgagagcgtgctagggacagaaacccagtttggggctgactcatggtgagaaaacagttttgtccccctgggtgcctcccgaagaggaggtccagcccagtgtttgcttgcatgtggcgggaattttaatttattttttaaaatgttggtgccaggtacaggttgctaattagaaagcacaggcagtttttaaaaatgaccatctattgtcactgtcatctcaggggaatggaaaatatatgaatctttaaaaaataaaaagcagctatataatcttggaataaaagcctgtccttcccaagagaagacaggtttgcagcagtgcagggagcttcctccatggatcagtgagcactggttcacatggcgtgtttgagaactgctggcatacccctttgtcgtgatctgacgtgttagttcccagatgaggatgaatttgtgttgaccagtagctcttctctgtccttagactgaccagttgctcctcagcagctgggcatctcatgcgttggcctcagtggtcacatggtggggctcaggcctggcaagaggccgaggagcagccttgtaactgggtgggccatggggcttgcctggctggtagcactgggccacagcaggctgcgtggttgatgcagtgatgacccagggagaccctgggttggttttaagcttgattcaccacatggagtctccatgccttccattaaactgccccgccaagcctttccttctgctccctgggaaactggttggcctagaggtgctgtcttagcatctgtgacgttcagctgctgccccatctggagtgactggaaggacactctggggcaacactgagcgccaggctgccgaacagagagtgccatttgctctttcagcagacccctcacttcctgcagacaggccctgcctggcagtgggatatggtggggtccctcccctgcgtttgatctgagcttttctagctctccagcgagactctgcagggtgtgggcctggagtctggatgtggcccctccctggccttaggaagctcagaaggtggctgaggactccgaccggtaggaaagtataaagatgatgttacatccagggcacagaggccaacttgcacagagctgaggctgggggcgtgaatttggctatgggagatctttcaaggaagaaagggggcagttctgaaaggagagcctcacctgggtagagctgagagcaggtgccgtgtccagagccctggggacgtggtgttgagcagggaagggtgttagtgcagcttccagagctacagcctaaagatacgcacgccagccatgactcccagtggggcaaggggcacattggcatcaagggcagtggctgctttgtgtctgaggctagtcaggcctcacacaaggccaggtgcagtggctcatgcctgtaatttcagtgctttgggaggctgaggcaggaggatcgctcaagcccaggagttcaagaccagtctggacaacatagtgagatcctgtccccaaaaaaaagcctcacagagaatgtcatgtagcaactgtgtgtggctcagcagcgcaggtggtgggtggtctgggaggaccctgcctcccctgtgatcctgggcaagtcagtcttttgggcctctgtttcctcgtctgttaaagcagagactgctgtgagatgatgcagtcatgcccagcgcggcacctggtgtgtgataaacttccagtcaggacacccttggctttcatcagtccaggggcccctgcctgccctgggctccccacagcctctgcccttggccgggtgccttgtgagacagcgctggaggcccgatttggaaccttgcctggcttccccaagcaggtggccggtaccctggggccgtcctcatcactggtctcctcagcagcctagaaggcctctgtcttgggtcagcacttctagggcttcctccaggactccctccagaaggacctgcccccaagtggcagctggagtgtgcctgaggcccgactgggctcccgaattcctctccctctcgcagagggtggcctgctgccaccttggtggctctgggtggggaagggtgatgctcatatgtgttattggttcctcagttacccaaccatggctgctgctcagggcagactcgggccagcgaggcctcttcccaggcctgcctgatagttgggggtgggggcagtgtgtgtacctggggcagagaagcgacctggcccctgcttgtcccccacttcctccccagctgccatttactgggtttctactgtgtaccagatgcttggcatcttttaacccatttgatttctttgtgcattctgtgatttgcccccattttactaaggaggagatgaccaagtgtaaccaggaagggcttcagagacgcagaagtcaggttgggcgtcgctggtaggagtgactgcggggatgggcggtggcctgggccatagctccccaacttgggctgtattgctctgagcccctttccagccctctgtgggtgggtacaggaggggccaggccacagaactgggtgttgctctgcctgtccgagtgcacaaggcctggtgacctgagataagagtagcagtcatgagtgtgtcagaagctcgtccaggagccagctgtcccaggtgtctgctggtggcccgccgctttccagacatggaggggacttaaccccgtgagtccatgttgctgcctggggggtaagctgtctccctgctgctactgcaaggactgtgccatgctgacggcgggtgctccagagccagtgccagcaggcccaggtggcagctgcagatctcactgctcactgcggagcagcagcctttgccgcctcagcccacagggtgccaggttggtgtcctgggtgttccggccaggagagtgaaccagtgagcagcccggggcctccatgtggagactgcagccaggtggggcggggcaaggcgggcctctcacctcactccagctgctgctctcctctgcagcgtggcccggcttagccgttgcttctgggtccgccgattacaggatgtatgtgtcttcaaactgccggatttaggttgtgttctctccccttcctcctcatctgccccctttttgccaccgtttccactgtctgctgccacagtctcggtctgtcagccctagaacctggactgagtgctgtaccttctctcagtcccttttagatccccagaggtctttctgaattggacaaaacctacagaccccactccccagaggagtgcttatggaccccactgtttacatgtcagaaggaggggttggactccctgaaagcccagccacagacctgagacaaagagcctctgtccagatgcctccccacggagggagtttggagtcccatccagaccgtgagccccttgagaggagcccagccccggcgcttcttggtagcaccctcttctcaggcgaacatggcctgggtgaccatggagacccccacggtgaccaggaactttcagatgcccaggctgaagctcagagcccatgccctgtggcctgtccaagctccctgcctttccctctccccaacccaggcctccctccccacaacacccctgtcctcctgagatgtgctaaaatggtgttcttaaaaaataccccctgagagctcatttctgtctgctagaaaatgcctcccactcatgcttttctctctcctccaaataacttgtcaaaaaaaagcctttcccaaatttaaaatcttgcaagagatagtacaacaaaggtagcccagttcttcctcagtgccatcctggtgtgttcaggttttttggcaaaacctttgaggagctggtgggtggcaggactaggttaaagggactgagcagagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatggtaagggctgcttgcttgtcctgacacccccgggtcccactgcattgccccagccttgcgtcccctctttcagcacccccagcactgttcttattctgcggccaaaccacttggggagggggaagtgggagctggggggattaggtcacctgagctggcctgggctggctgggtcttcacccagctccccaccagcctgacggccccctcactccacaggcagtcatggttttcattcatagaacttaggttattgagctgggcagggtggctcatgcctgtaatcctggcatgttgggaggctgaggtgggaggatcttttgggcacaggagttcgagaccagcctgggcaacatagcaagacctcctctctacaacaaattagcctggtgtagtggcatgcacctggggtcctagttcttgggaggttgaggcaggaaaatcgcttgagtccaggaagttgaggctgcagtgagctgtgatcacaccactgcactccagcgtaggcgacaaaacaagaccctgtctcaaaacaaaaaaagaaattaggttactggagagtgtgtgtccggcacttccccttgcccagccttcccgcaagtgtcacatttgataagcatcttgcagcaggccacagggataggcagagcccacaggaggctcagcacctgccctgcccccagggcgcgttgccaacgacagatgcagaccagatgggcagctgccaactggagccagagtgaagggtcccacccaggccggggctcctgtcagtgctttctctctctctctttttttttttttttttttttttgagacagagtttctctctcatccaggctggagttcagtggcgtgatctccactcactgcaacctctgcctcccaggttcaagcgattctcgtgccctagcctctcgagtagctgggattacaggcgtgtgctaccatgcctggctaatttttgtattttcagtagagatgtggtttcaccatgttggccaggctggtctcagactcctgacctcaagtgatccacctgccttggcctcccaaagtgctgggattgcaggcatgagccaccgtgcctggccagctcctttttgcctctccgcttgccctgtctgtctcagccctccaaccccaggcagggacacgagccctaccccttgcgttcagggcagtgctgcagggatgactgtgattagaacaataatagcagctgccatttattaggccagacactgcagggtggtttaatccacagccctgtgaggttggcattattgtcatccccgttccttagtggaggagaggggctcagacaagtgacatgatttgcccagggacatgtggctacaagcaggagtcactgagacccgaaacaaggtctggctgagcccagggccttgccctttcctactgccctcagcaagggggtggcgttggaccagcccctggtgcagagcagttaggcaagcgcctggacactgggtggaggcggatggaaggtgcgaggccccttggaacctgaggcctccctggggagctctgggtgtgcctgggggaggctgacagataggtgttggcctgggggcagagctggtactcttgggcagaggtctcaagccctccctcccatcctggtttctccagagccctttgccaagtggctctggactggtccttccgcctctctggctgttatcagaggcttcctaagggccagggccttggccaagtgctcgtgctcacattctctctggtgtcacaccatctgtgccctcgtggatgggatggaattaggctaaggccctggagtggcttgtccaacatcacccgctcagcccagcacgcatagccaggcctctagtgctggggccctcccttctcactcctgtgttcccccacctctcgatcttcttcacacctcaggtcttcttcatacctcctcacaggcgtggctgaggggtgggaacttgaagggtcataggtcagcaggcaggcacgcaggaggtcatgagtcgcaggcagccccttcctgtgtcccctccagggccgattcacgattgcggccaagcaccacatctccattgctgagatctatgagacagagttggtggacatcgagaaggtgagtggcagcagggccctgcatgggctggcagccaggaccagtgctgctctctcttcttcccaccaggggagtcctctggtgtctgagtgccgagaagggggcatggggcgccggcagagcttggagaatggggtctggctgtgtcccaggcaggcagggcggagggtgtggaagcttcacggaggcctcctctcccttccctgccctcccctggaacccatcccccgtgtctccccaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccacccctcccccggctcaccctctgcctctcccccgacatcccttgccatgtcatccccccaccctgtcttcagcctggctgaatgttctccacctacgactccatgccgtgccagcaccgtctctctccctggctgtgcccctcccacacccctcgcagagcttcctggaggggcccagagtgaggctggctaaagaacccagagggagggaatgggaagaagtgccaagaggcccagggtggccgtgggcaccccaccccatggcccgatggtcctcatccacagtgggagggagggagtgtcacatggggtccccccagcgtgcacggagccctgggtgatggccgagaaaaaggcaggcagctggccccctgggagagaggggcgggcgccgcctctcatgttcccaccgcctgccgccgctctgcccaccgccatgccagcctcccgttggtcctgacagccaggctgcctccttcccactgtctcaggctctcagaaggcccacgaacacctggctacagcctccacccccacccagccaccatcacaccctgatcttggtcgctcacgcactggccgctgacctctccaagctggtccctggctccctgcccttggggtcctgggttaacagggcctcacctcgggacatgaaccagctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaaggtagcacaccccacgcccgcaggaccaccgcaccaggccaccatgtgcttatctccaggccaggtcccgttgcccccgaagagggacgtgctcctccctcacgtctggcccctgccagccagcctttggatgagaagtgtggttctcacagctgtgtttctgtgctggcatcacctgcccacccagccctggaggcttttgcgggtccagctcctgcctcacttagtgctctttccttcatgggtgcactttttgaatcctcactgcaccccattaaagtcagcaccattgtcaccgcgtcttatgggtgaagatggtgaggctgggacgagagtcccttgtttgaggccacatgactagggacctgcagccccagtgttccagatctttgtgactcctgctgtcgtggctttagctgtagctcacacatgcccacctattttcaggacacttggcaaaagaggggccaaagagggcagtgggagggggcgtggccagcgggaaggagctggagggttggcgctagattttgcttggccggagtttttttaccattgcctggcagaagcacggagtccaggatttcctggtgtccctggctcacggcctggggtggtggccccacacaccccacacacacacaccccacagagccctgccctgctgtgggcaccggtggtgggcaaaagcttgggctttgtcagaccaggttcccattcccaccccatgtctcaccgtgccctgggcaggtcactgcccctctctggatctgtttcctcactttgaaaagggggctcaccgtcatttgaccctctcagggtcctcaagaagcaccagccccaggcctggcatggaggatgtgctcatttgtcccctgccccagctgagccaggtgggaggaggcagtgggtgcctatctggggaaccttccccctccacccacctctccctgcagccatctctgcagccaggctggtgctgagctcagctacgggaaggtactgacagacacagagccaggtgacacctgaggctgggggaggggtgcaagagctgactcaatatcacccgacatccccaagtcccctcagctgctaggccagtagctctgaggaccctcttgttactaactcatcttctcccttccctgctgcccagctggctgtccaaaagtatgaggagctgttcccagctttctctgattcccgggaatgcaagttgatgaaagtaagtgctgggtgctccggcctcccccttcccgaacctcagacgggggtggctggggctccaggtgggacaatcgccaagacttgtccagtagttctcagagggtgtctttgttttgttttgttttgttttgttttgttttgtttggccatttgagtctccattttccagatgaagaaagtacaactcggggagtgctggagctcaggatggctaggtggacacacacacacacactacacacaccacaccacaccacacacaccaaacatacactacacacaccacaccacacacatcacaccacaccacacacatcacaccacacgctacacacacaccaccccacacaccccacacacactacacacacaccacacacagcaaacacatcacacaccacacatatcgcacacacactacacacacacgacacacccctcacacaaaacacattgcacagtacacacaccacacgacacacccccccacacacaaaacacactgcacacacaccacacatgacacaccccacacacacacattgcacacacactacacacaccacacacaccccacacacacaccgaacacaccacacacgcaactcaacacacaccaaacaccacacgtgcccctacacaccacaccccaacacacacaccacacacacacacacctccaccacacaccacacccaacacacacaccccccatacccacacacacacacattctgtgtgatgttctatgttggtaaggttgccctgagagcaagccgtttctgatgaatagggcagcaggatcgcaacacgcccgtacccatccccagtttaacccacacggattgaccctctgagagtcctcaggaagccccagccccaggcctggcatacagatagcgtgtcctttcatctaatccaggccagacctcaggtcagcataggcccctgacccctctctgccatttgcttgcagaaattgctagaggcccacgaggagcagaatgtggacagctacaccgagtcggtgagtggccagcatggggggccaggccccttcacggggatgggtctcctaggaaagctgcccttctcagacacgctctccatgacattcacccatttcatctggcccccagcccactgtgaagttctttctccagtcaccccagaaaccttacaagtagcgccaagaggcgcagggagtgttctccccattttatagatggtggcactgaggttggggaggtcaggaggctcggccttggcccctcagggacagagctggtgttcagagccacatctgtctgcctctgaagaccagggttccttgagtcccccaggtgagtgtgtgagactcacagtgggcgccttgggcacccaggaggcacagacggggagggaaggggtgagaaggagagtggagctgaggacatgggagaggtgccagcttccctctgcctggtggagccgcccacgcggctctctctcccttccctttctctgttcccagcattcccgggcttagtggtgtccggctcaggtcctgattcactcctctaatggcacatgtcaagcatttctccctaggtgccccttgggaatggaagcccctaactgaggacagtgaaaatgccatcctgttcctcctgccccagacagtgggtggcaactcagccaggagctcagggaggggatgcccagcaggccgtggcttctctcccccgtgtcccatggcactcaggagtggccttttccatatctccaggcctcagtttcccacccattcagtgaggatgctggacttttttttttttttttgagacggagtctcgctctgtcgcccaggctggagtgcagtggcgtgatctcggctcactgcaagccccgcctcccgggttcacgccattctcctgcctcagcctcccgagtagctgggactacaggcgcccaccaccacgcctggctaattttttgtatttttagtagagacggggtttcactgttagccaggatggtctcaatctcctgacctcgtgatccgcccgcctcagcctcccaaagtgctggtattacaggcgtgagctactgcgcccagccatggacctttttttttttttaaagctacaatatctttctcccccaagggaaatgatgtgcccagcatagtcaagacagacaagagggagctcccatggctgagttggggcctcaagccctccctctactcctcctcagagaccaggggtgacagagacagatcttgaaaaccttgggacaagtgcccttgggctgcagggttgggaacggggggagcatggccagcctatcacctggtgtgccctcaggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtcccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgagtctctcttcctcctcacctctgctacccactctgcccctgggccagtcaccagtccctctcacactcctggtcccccagactctgggcgagctcttgggaggtcaggcgcatgcatccttgaaacacgtgtgggctgggtcagtttctaggtgggggagacccagggacggtgggcctggggaggagctctggcttgggagtcccagagcgcccatcttgatctttctctgggttcttggggtccaggggccttgatttcctcaactgggatgcacggtggtgatgccacccctcagagccagtgggagggtcgaatgtgacggtcctcatgactgctttggatgagaatgggtggaagcccaccgaatctcccatgtccacatttctctggcaggaaggctgaacgccccggtgacagttgttccatctgtcacaggacgggggaggaagcggctttggtgggcagagtctgaggcccgagtgggtctggggagtgggggaggagatagcaggagcctttgcccaggaaaggtgggcagaaaccagctgcctccaccacactccacaatgtgcatgttgggggccctgtctggtacacatgtgctttaccctgccccgcgcagggcccctcgctacagaggagacagctgaaggaggctcagtgcccaggcatgatgggaaaatgtcaggaagtgagcaggggcagtaattgcacagaggaggggctgcctaggaaaccagggtggactcctgggagaggggctccagcccagaaagcctagagaagtgcaggtgaggttcaaattccttgacacctgccctgctcctctctcccctgcagcttctcccacagctccagtccactgataatggcagcaaagacttctgagacctgaaattgatgaccatgtctgcccccatcatgggtgctggctgaaggatagtgtgagaatctgtttctgtcatccatgacctaaatcagtgatggtccgccctggctatgctttaaagtcattaaaagtatccagacttggggctgggtgctgtggctcatgcctgtaatcgtagcactttgggaggccgaggcaggcggatcacttgaggtcaagagttcgagagcagcctagccaacatggcaaaaccctgtctctgctagaaatacaaaaattaggcatgatggtgcaaaaataaaagtatccagactggggccgcactctgataaattgtggtttgactgaggtttcctaccctttgggggtttttgggtttgttttttttttgagacagagtctcgctctatcgcccaggctggagtgcagtggtgcgatcttggttcactgcaacctctgcctcccgggttcaagcgattctcctgcctcagtctcccgagtagctgggattacaagcgtgcgccaccacgcccagctaatttttgtatttttagcagagacagcgtttcaccatgttggccaggctggtctcaaactcctgacctcagttgatccgcctgcctcagcttccaaagttctggaattacaggcatgagccaccaggcccggcctgttttggtttgttttgttaaaacttcataggcagttcaagtgtgcagctaggattggaaacctcttaacaggatgattccttcctaacctgtaacttcattttttcattcatccgctcaacatgtggcttataggttactagggcgggaagacgcctgaaggaaacgcactgctgaagtggcactagacccacgtgccactccctcagcgaatattcactaagcacctgctgcatgccaggccctgggaatacagcagcactgacggcattcccagactgccctccaggaacttctactctccacatccagaaatctggaatcatcacaaattccttgccacctccgttatccagtctgcctttgagaactttccatcatgtaagagctgtctcttacatgctcagcacatagtttgtgatttttgacacatattt

SEQ ID NO: 13129 - DNA, 18917 bp, Human
tggagctcggcggccacccctaatccgggctggaatcctctggcaccggacgcccggcggggctccaaggctcctgggcccacgccaggccccggcctgaaacgcagcactgctggaataaaacacgccagagaagcagggcgctaggctcgcctggatttggggaaacgagaattgtcatgtcttctccctccgtaggttggtgttaatgaaaaacccccttttcagcatggactaaatcccgctaattctatttagggagcagtgtctactccgggccgggaactgctccggtttccaaccgcagcctcccgtgagggtcccagtgtggagggccggggtcatcccctcactctgggatggctcccaacccgctgacctggcctccccgtcaggcaccctcacagctctgtcagactcttcatgtgatcagcgctcctgggaacattagtttagggtgttttctgctgctgggatggtggcccgggagggaccctcctggtgaccctgctgggcctggccctcagtttccccagccgtaggctggcagcctcgaactgtacgagctccaggccacagtttccccagctgtaggtcagtgggccagggactgtagggggctcgggcctcagtttccccagctgtaggcgggtggcttgggcctcagtttccccacctgtaggcgggcggccttggattgtatggagcccgggcctcagtttctccagctgtaggcggatggccgtggactgtgtgtggcctgggcctcagtttcccccgctgtaggcagatggccgtggactgtgtgtggctttggcctcagtttccccagctgtaggcggatggccgtggactgtgtgtggcccggacctcagcttccccagctttaggcggttggccgcggactgtgcaaagtccaggcctcagtttccccagctgtaagcgggcggccgcccactgtacaaggtccaggcctcagtttccccagctgtaggtgagaggccgcggactgtacaaggtccaggcctcagtttccccagctgtaggcgggcggccaaggactgcaaggtccaggcctcagtttccccacctgtaggcgggcggccgcggactgtacaaggtccaggcctcagtttccccagctgtaggtgagaggccgcggactgtacaaggtccaggcctcagtttccccagctgtaggcgggcggccgcctactgtataaggtccaggcctcagtttccccagctgtaggcgggcggccgcggactgtacaaggtccaggcctcagttttcccagctgtaggcagccggccgcggactgtgcggggcccggacctcagtttccctatctccgcagtcgggattcgctgttccggggcgaacaaagaacggtcgggggtgaccccggatcatggcgcgcccgcagtatctgtggccactgtggaaacagccctggcgtgtccgggacgcgacgcggcctttccctccccgcgcgatcacccagatgtgagcgctcagtttgaatcggactttttggccatgtgcccacaaccaacatggagccctgagggtttcctgcccgactccaagatggcgatgcgactccctttgccctcacggcccaggcgggcgggtcctgcccacttgcaagatggcggcagcctgggcaaagcacgcttcccgccgcctgactcgccacgtacccactctcaagatggcgtctcccgcaaagccacgcgccagctgactggctcagacgccgtcacgtgatcccattttctccccctcccccgactacacaagccgtttccgccttcggccttgaggaataaccgcctcccccaataggcgcctgcgatttctctgggtcccgcccccgggcggccttctggccagtgggaggtgctggcgggggcccgcggggctctccccgccccctggctgcagcgggagccaatgggcagcgcgcgcgggggacgtgtgcgggcgtctccgccattttgtgagtctataactcggagccgttgggtcggttcctgctattccggcgcctccactccgtcccccgcgggtctgctctgtgtgccatggacgggtgagtcgcacgtcgccccgcgccccaccgccctccccgcgccgcagccctgcccccgccgccgcgccggcctccccggggccgatctcgccccctctcgggcgggagggggcggcgggctctccccttcctctccgcgtggcgggcgcgggtgcggggcgggtcaggggcttcccgggggtctggccgcgtccccatcccccgtccggcccgcttccggcccccgcgcgccccgtccctagcgcacgcggcctcccgcgcccctccccctccgcgcgcgtccccgcacttcgcctttgccccgcctcggcggcgcgcggcccttcccgcttcccgtccggccctcgcgcgcccggatggcccttcccgcctcccgtccgctcccctcgtgcgcctgcgtagcccgtcgcgcgtccccgttggccccagcgcgcgtgcgcggccgccatcgggggcgcgcgcctttcccgccgcccggactctgcccccggcgcagccccggaagcgcaggcggggctggggcggccgccgggagggaaagctggcgccggggcctcgccgcgggcccgagtctctgcgctccccgccctacccctgccccccgtgcgccccgggccgcggccaaggggtttcggtgatctcgggagagaagcggccgccccgagggtctgtcctccgccccggggccggaggggcctctccagggacccccgcgggcgccgtcatggggaggggccttcccggctctcgggccggggcagcctttccgggcggctttgctgggcgggcttcccttgggagaggtgggagccccctccagaaaggccgtgtcccgccgagcgcttcctgcgcgaggccctccctgggaataggaagcgggagaggctggagatgtttcgcattctttccgttttcctgagaagtttttcttgggttcagtcacttttaaaagtctgttaaacgtggtccgtgcagtctgtggtgtcagaagaggcgcagccctagagtgggtctggaccccttagcatgcgtgcgggcaggtgggtcctgcagacggcgagacgagggctccccgctctcggacccagcaccgcgggctcgggggccgcgcactcgcctcccggagtgaggcaggaggcccggaggctgcccttccgacggacgctccgagtcacttagggcctcgccgggagttgcagtggccgggagaagccgtggggagctcactgttgggtcaggacctggccggggctgaagggagggcctcggacagtccggctttctatccaccttccccccggggtgtcccgaggagggagagtcgggtcgggcggggctcgggttgatcagtaactgaggctgtgttctggtcggtctgttaatttttattgacggtttccacggccgcctcctgctctcctcggtggatcgggctccactctgctgagaggcaccctcttgggggcccacccctacccgggtggaagctctggcccaggcctgtgagtttgccagtttcagcctctccgaggcgtttccaacttactggaaagcacacagcagcccttgaaccctctcagcggcatctagcattcctcggggcttccgatgggggtgtctttgtcttggaacgtgtggggcctggtccagaggtggggcctggggtcctgctgggagggaggggcgccaaaggacaatggtggccccttttcaagttgcagtcaagtggacggctcacttccctgcccttctgagctttctctagcggggcctcgtgcagccagagggagccctgcggaggtggcagctgcagggacctacgggctctcctggcccggggacagctgggtgctcctgctgctgagtggccaccaggctaacgttgtctcctttctttctctctacagcattgtcccagatatagccgttggtacaaaggtaggcacttctcactttgcttctccgtgacgctcctctgaccttgtgccgaccccgggggccaccccccagcgctgttgcgttggctagagggcgcttttccattcctaaggggcactacccttggtctggaatctggagttgggcggtagggtttgaaccccgggctccagtgcccgtgagttttgggggcttgggtttgctggccgcccctcaggtctggaatctgagctgctcttcggttcttgctgtcagcagcgagggctctgtgtgccccaggcctgcctttggaacttctgcctctagaggctggaatcgtgccgttcagtgggaaacctcatgttgtggctgcctgggagactcttggttttgataggaaaagagccacctggctgtggaggggacctggatagaatccagcctatttgagtggctaggatgggcatttactggttgattttgacgttaagtttttttgtttttgtttttgttttttatttttgagatggagtcttgctttgtcaccaggctggagtgcagtggtgtgatcttggctcactgcaacctccacctctcaggttcaagcgattctcctgcctcaacctcctgagtagccgggattacaggtgcccaccaccatgcccagctaatttttgtatttttttttttttttttggtaaagatggggtttcgaacattgttggccaggctggtctggaacacaggtgatgcaccccccttggcctcccacagtgctgggattacagttgtgagccgccagacccggctgacattaagtatctttgatggcatctggttagaacagcagcaaactgtcaaaggtggtgtttggggcaagagaaaaatgaatgtgccacgtctctggggtgtgcgaatcttgcagccccatggagggtgaggccagggctcagcatgtgaggaaagggggtcagaacctggagaagaagaaggtcctggggaggcgattctcgagggagctgtagtcctcgcttagctggggtagttggttaatgattctgctggtcattgtgggttgagggggctcccgacttcagggcttgtgccccgagagcctcccgcagggcgagcccacagtggtggcgtcctgagccagcagccagttggtttctggtcagtcagcagtggtgcctgggccaggtttcggtttttcccaagtggactgctgtctttacgcgctgcctgccccgatcttcctggagataaaacctgtttgttcagtgtgggaggagggagaggtactttcatctgaagcatttgcaacaatccctagatgtgtctggcttgcaggcagtcgtctcttccctgcttctgtgggcctgctttccagctggagtggccctcagcttccatcgggtggtccttgagccctcctctgcagttcctagggggctcctgggctgggacgttgaagcccagccaggacttgaagcctgcgggagggattttgccacagggcagggttagggctcctgctgggtgcaggccctggtaggaggacggggtagtaccctgacccagatgataccccccctcccccccaccaccagggagccctcagctgacctgggcccacacctggctacgctgtcctttagcccaggacagagcaagctcttgttcagtgtggggttaaagacacctaggaactgtgctgtagggccccagctgcagactggaagtcctggggcgtttcctgtcaatctgtgtgcttcaggacaggtgccctgaagggaccctcctggggtacctggcagctgctgtgaaggcagtggaggcgctaggcccagctcgtgtctcctggttgctgccctgtggagcctcggagcctccaggtgtcccttccgttctgctggggcgccgttgagctgagccaagccggcctgtgccgcctgggcaggcatggagtttgctgccgcagacagttgtgggcaatgccaggccacttgcccatgggaatgagattagggcttcaggcaggcggccaagaggaccgctcagaggaagcggccccgcccaccactccagtcaaagacagggtccaagatgccctttttaaggtttgtgcagccagcacatgggagccgcatgggcgcttggccactctccagcttgggggaggaccagccctggtgtcctggacggggtcggctcctgggctcccccagcctctgagctggaggggagagcagacaggaagcgacttcctgtgggaggcgaaggttggaggccctgcgtctcaggtgcacccatcctcccttcctcccgtcctcccttcctccggtcctggcactgctgtgttttctgatcgcgtggtttccacctgaggcggctggctctgacccctttcccctgggcctgcgcagccccgccttgtgctcatagggggccccagactctgaaagcgagaggactcgagggtctgttttcagtatttggcttcatctgtgtccggccggaacctcagggccgccgtgacactggacactgttcattctctgaccctaaagtcttggggactgaacaggtgccatttgggtgggcgccgggcctgtggaccctgagtgattcctggttccggcccttgtggctgctcgattgcttgtttggtgacgccctgagtgcttgtgggattggtgggagactcagggctgcagttagaggtctcattggcaagggccagtccctgttccccatcctccttgagcaggtgccggagtctcccgaggctcttgccgtccgcgtcgggaggaggcagctgtggggctttggaggctcgggcagtcttccttccaggaagctcttgagccagggccagggcaggagtggagctgaacgtgggtggaggggaggcggccttaagagaagaccaagcgcaggctcggggaggccagcgttggtgggggctctttggccaggtgtgggggcagctccttgaccaggcatgggggtgtgtggagctgggggttgtctgaggggggacagggtgtgatatccactggttctttctgatgcgatggccctgggcccttcagcaggtgggggcaggctcttggcctcaatcctgatacgggagatggaggctcctttgttccctgggatggccctgtcctggggggcctgggcgttgctgccctcagcgcctgcagaggctcgctttgcagaccaagcgcctgtgctccaaggtcctcagacccgagctttgttttctgtgtaactaagggccgtaaccaacgtctcctccaatttcactctttgaataaacgtgtgtcttcaatccttgcagcgggggggatgtctgccgtcctgagcctaggatcagtctagtgcaattcttagaagttgatccaattacatagaaataaccagtgaatagattgtttctggagagaaaatggacaggtcagaagtgatggagccgctgtggagctcccccggccctagtcacggccgcgataccagcggatcactgggcgggaggccgtgtctctagtcctcagtctcgcgtgtgcagagacggaggtcgggtttcttttccgggctggaaaacaggagaggaggggctcctgcgagagtgagggaggcagcgctataatttggttctcttgcgaggccaccagaagtgaggacggctgcctgggccctgccgtgtgctgctgggggggctggctccatggagggggtcctctgccctgctggctggtggctgaggccccaggcctgtgcccagggccgccggcagcacagtgaggccacgtccacagcagagttggccgtggagatagtgtacgtggtgccctccgtagctgagagcctcccagccccacactggctgagtacccagggcttccagaatttggaaaaaggagcagtgttttggtcgtggagctgtggggtgccgtgcgcgtccatgggctgggtctgcgctcaggctgccctgccgtggaagtgtgggtgtgggtatgggttgggggtctgggaccccaggcagcccaagtgggagcagggccggccggtggggaagggaggctctggcctggtgggaagtgcagctccgcgttgtcccttctcttgcagcggggatctgacgagcttttctctacttgtgtcactaacggaccgtttatcatgagcagcaactcggcttctgcaggtaaggccgggactcggcccagggcaagacccgtgggtgtctttccctggaacaacgttacgttcttgttctgggactctactttccatctccaactgcaggggcccatggtccacgctacagacccaggtccaagttctcgctgcagagaatttccagggaggcgctggatggatggtccaggctggcacttggacctgtgggcgggttgtcaggagctgtcgggagcaggggtcctgactgtgcaggtcttggcctctcgcgctgctggttcacatgcaccctcctggggctcagggttggtctccgtagcaggcagggctctagggggatagcagggaccttcctctgtgggctcctgcgagttggtgcctgcatctcatggcacccccttttcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggtacctgagccgcgtttctccggggtgctcacaccgtgcaggcggggacgaggagggcccagcgctcactgcctccccaacaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcggtgcgtggccccgcggcggaccccagcagcccggggacctcgggggtgggcccagccgcaggggccggggactcacggctgtgcctcccacagcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccaggtgaggtggtcccatcaccgccagggcaggtcggctgctattgctgtgggcacaggcacacgggaggggcctggcagggctggtgggcaccgggcaggagctcatgctgtggcccgggacctgcagattttctccaagttcggcacagtgttgaagatcatcaccttcaccaagaacaaccagttccaggccctgctgcagtatgcggaccccgtgagcgcccagcacgccaagctggtgagtggggctcccgggacggcgcccgccctggccctggcccggcgacgtctcacggtccctctcccctcagtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtaagaggctgcccgacgcggcgccagtgtgcagagtggtctattagggccgctcagtccggagccccggcggcacgggcccggccctgcaccagggtgatgcacctgctgctctctgcacggccagcacagcacggtccagtgtcccccacgtcgggaccacggccccccctggagcagcggatctgcccgcgaaggctctgccggggccgcccgccggccgggttggggcccatcccgcagcacagcgcccgctcgcggtggaggttgtgggtgcgatgattagtgtctcatttatttctaggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcggacgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggtatgttatcgttcacacttttattaccttgttttcattaattgagatgattttgatgccctgagacgtattatgagtttgcggtttggcactctgatgctccgtggcatccgcctcgttttatggtttgctttcggtttgcgaattttatttggtcccgtagatacgtacgcatggtttatcgccctgcatgcttttcagagttagacctgtcggtggcatatgccaccgtggccacccgctggcagcttacctgtcctggatgctatgactttgctgaacggagctgctcctgttagcgcgccctgtggctgcgagacgcagctccgcagtggccgataaagcaaacccggccgggctgagccgggccttgtgggggtgcgcggggccggggctgacggggagatgggcggggcaggcagcaggagactcaggccccatccctgggcttttgaaggcgtctacggtgacgtgcagcgcgtgaagatcctgttcaataagaaggagaacgccctagtgcagatggcggacggcaaccaggcccagctgggtaagaggccggggcggccccggggtggagggggcaggggcgggggctgcgttccctctcgggcgcctggtcacgcgggtgctgctcccccagccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgtgagtgctgggccggggggctcatggggccgggggcgggcaagggctctgcttggctgtcctaccgcgtcggtgtgtggacttctggcgtttccagagtgcaggtcgggcacctcttaccccaaacctgaagtactgcaaggcctggagcttgagccgagggctgctcaagggagggggtcgttggacactttggaggttttggctcaggggatgctccctgtgagaatgtataatgcacacatttatttatttatattttttgaggcgaagtcttgctttgtcacccaggctggagtacagtggaacgatctcggttcactgcaacctccgcctcttgggttcaagtgattgtgccacctcagcttcccgagtagctgggactgtaggcacccacaaccacacctggctaatttttgtatttttagtagagacggggtttcaccatattggccaggctgatcttgatctcctgaccttgtgatccgcctgcttcggcctcccaaagtgctgggatacaggcgtgagccaccgcgcctagccacatttatttatttatttatttattttacttattttgagatggagtcacgctctgtcgcccaggctggagtgcagtggcgggatctctgcaagttctgcctcctgggttcatgccactctgctgcctcagcctcccgagtagctgggagggactataggtgcccgccagcacgcccggctaattttttgtatttttagtggaaacggggtttcactgtgttagccaggatggtgtcgatctcctgactttgtgatcaacccgcctcggcctcccaaagtgctgggataacaggtgggagccaccacgcctggcctaatgcacacctttataatcccagtactgtggggggccgggcaggggattgcttgaacccaagagttaagaccagcctgagcaataaagtgagacctctgtctctacaggaacaattggttaaaattagctaggagtggtggtgtgcacgtcaggtcccagctcttccggattgggaggttgaggtgggaggttcacttcgcgctcaggaggttgaggttgcagtgagctgtgattgcactgccagactccaggctgggcggcagagtaagaccctgtctgtaaaaattacataatgcaagtatttggaaatgcaggtacatctggccccaagcatgtcaaccagtagtaagccctttgatatttaacacgttacttgtgaaatgttatcagaaaatcaacaaggggcctggcagagtggctcacgcctatcatcccagcactttaggaggccgaggcaggcagatcacctgaggtcaggagttcaagaccaacctggccaacctggtgaaaccccgtctctactaaaaataaaaaaattagcctggcatggtgttgcgtgcctgtaatcccagctacttgggagactgaggcaggagaatcacttgaacctgcaggcggaggttgtggtgagctgagatcacgccactgtgctcccgcctgggcgacagagcaagattccatctggaaaaaaaaaagtggaggagcgtggtactctgtttctgcaaacttgtagatgcctggtttcgttagaagctgcttcagaccattgtggacatgatttgataccccatttctgggctcctaaaaggccctacgccttccccggctactctgaaaactagtctggggaaagcctcgcggacctgactgggcgcccccacccccacgcggccccaggctcacgcctttctcctcccacaggccctcagtctccgaggaggatctcaaggtcctgttttccagcaatgggggcgtcgtcaaaggattcaagttcttccagtgagtatgaggcgggctgtccctggctctccccaggctgccctgcggccggccctgaccccctgtcttgcaggaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgcccgcgccctcggcccgccccccgcccgcccccggccccgccgcgctagtcggggaagcggcgcgcctgcatcttgcggaagtagccctcggcctccgcctccgcctcgcgctccgccagccccaggccgcccgcgtggcgccgcagcgtggactcccggctgcccgggcccagcgccccatcggccgcgcccagcgggggcagcccctcgcccgtggccaggttgacggtggccacggccccgaaccgcggctcctcctggtccacgtcgctgaccgacgagccgggggacacgcccgggggcttggccccgccgcggaagccgcgcgccaggtcccccagctcgtagccgccgtcggcctccgccttggccccgccgcccgccgccttccactcccagggcgcgccgccggccgacaggtgcaccacggggtggtgcggcgcgtgcgcgtcgatggtcacgatgctggcggagtcgcggtccgacggcgaccggtactgcgaggagtcggagctggcgctggacgacgacgccgtctcggccgccttggggcccggcgcgcccggagccttggacatggcgatgacctgcagcagccgcggagggttggccactgccgccccgctcttctcggccatcatgagccacttggcgcgcaccccggcgccgcttttgggggacaggccggcccccgtctgcgcgccctcctccgggatgtgcaccagcggcggcggccccgcgcgcggtgggaggatgacccgaggccccagccccggccgcgcctgcacggtggggtagagcgagggcggggccgggccctcgtcctcctcctcttcctcctcctcctcttcctcttcgtcctcctcctcttcctcctcctccgccatgggttcggcgggcgcgcgcaggtgcccggggctggcgtcgtcgggcagccccaggccgcggccctccaggctcttctgcttccactcgctgatgagctgcttggagcgcgaggcgtccagcggcacgtggatggtcatgtggcggcgcgcggggtcgtccagcgagggcgcgctggccctgggcagcgtgtggctgaaggtcaccatgttctccttggccatggggctgcgcggggccagcaggtccacgtccacgctggcgcgcttcaggctgcccagcgaggtcttctcgcgggccacgggccggggcgcgccctccagccgccctgggggccccagctcgtcggtgctcaccgacttattctgctgataaaccgagtcgtggccccgctgcgtcagggcccgcagcgcgtccttggcgggggccggggccgcgggcttctctgcaggtggggcctggaagttgcccaccgcgtggcaggcctgtcggggagaggggtctgggggtgaggcctggggctcagagggctcctcccctgtgatcgttggacttgccgcggggggctctggaccgggggtgggggctggcaagctcttgtccagtgggaccggttcccaccccaaggttgctgacccagcacatcgggcaggtctgagcccacgggattctgactccagcattccaagggcgagacacttcagcacccatgccttccccctaagaccccttcgggacccacgtctatcccctcagacaccctgggcacccgtgcctcccccctagagcccctgggcacccatgcctcccccctcagaccctctgggccagccccccgccagaacccctgggaaccatgcctcacccctcaggctaccagcctcccctgtcagaccccctgagcctgcctcccacct

SEQ ID NO: 13130 - DNA, 18917 bp, Human; identical to SEQ ID NO: 13129

SEQ ID NO: 13131 - DNA, 18917 bp, Human; identical to SEQ ID NO: 13129

SEQ ID NO: 13132 - DNA, 14918 bp, Human
  misc_feature (1)...(14918): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacagcgagactccaaacacacacacacacaaaagatatggcgcgtctcattcattcacaagttcctcttcaaaggtttggctcgttcagcgccctcgttcttcgtttcctacttccaaggccaacctgacttcctcaccctctgggcctccccgtctgagtctcagtaaacaagtttcccgccggtcctgatctgcagagatggcacctgccacccactctgcacatccccctcccgtcgccacgggctcttcccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaaggtaaccgccagcctctcctgaaacagaatgggatccaaatgggatatttgggggcggcgagtcggtcccgcaaagagaaaccagcacttagaaaatttctcagcgagaccactttacttgtacggaagggggctgcctgcgtgggatgcaatctccagagcacacgggacaaaggaagggagcttctgttcctctgtcctttccctgttggctggggttggacgcccacaatctaagctgatcccggttggctaaaacttaaaacttttttaaaatagggtaaacgcgccacctgcgaggaaagaagaagggggtaaggttgattgacaactttagacctggaagttgagtttctgaagaggaacttacttgtcccaaccaaatggtgcacaggacgtttatactaagaaattattcattttctgagatccagattcaagtgccctttaagtatttttatttgggcggaggaggtcacttcctcccacctaatttattaatacgttcatatatatatatatatatgtacatttttaaaggcagagatgtgcgtctcgccatgttgccgcgtctggtctcgagctcccgggctcaagcgatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctggtgaggagcgggtagggggcgggggtgcggtcctgcaggggccgggaatggaggccgcggtgccgacccgaagccgacgggagcctggggcctcggcgcggggcggcctggggtgcgaaaggccggccccgggggcttcccgcgccagcatggagcttgggggtgaagtcccagggtttgaggggggactagaggttcctcccggcgcggcctgccgggctcccccgggcgctccggcctcgagcccggcctctgtgtgtgggcgtgaagctccctgcttggaggcgggagccagggggtcctggccaggccggtcttggtcaggggaggtgggcgtcttgcttttcggtcacctggggttgggggtgacctgcttcctgggtgagggcgtctgcgaaggcggttggaggtggcccgcccgccggtcccatcggccaggagaagggagacccaaagcctgggtgagcgtcccctttggcctggagccaggggtcaggggctggttggtgcctgcccaacccgtcctgctggggctggactccgcaggacctggggaaagcggcctgggcgtggaatctggagacgggtccaccctgcctgcgagtgttagggtcagagaccctcccctgagactctctggggcccccgcaagggcccgtgcggcctggagcgatcatcttggcgctcccttctggaaaaggggcttttgtcctccaagagcacatggaggctctgagtgggtcagccctccggatcgggaagggattaccgttcttcacgggatttagccctggcgtcttgcctagggcgtgcacctgcccccgggtgttctcccagactcttaagacctcgcaggctccctcgaggggccctgcgtggaagggaaggcggaatctccctctgattctgcctggattcagcacccagaatgaggtggtctctgaacgcccctcctcctttacaggcgaggaaacagccctgtgggaagtcgaggttccaaggtcacagtgagggggccctggccacccgattcagcgcaggaaatagtgagaaagtcgtttttagccgactctgacccgcattcggtttccagtgctgtcttaggagggccgtgtgttgagggtgggcaaacgtggtttggagagcgcatttgggaaatggattgaggtgtgtttttccgggagaaaagcatgacatcctttcttgcttcatagaaaatttcttcctttgttgagacccccatttggttctgggttaaagatttatagtgaggccgggcgtggtggctcacacctgtaatcccagcactttgggaggctgaggcgggtggatcacctgaggtcaggagttcaagaccagcctggccaacatggtgaaaccccatctctactaaaaatacaaaaattagctgggcgtgttggcgcacgcctgtaatcccagccactcaggaagctgaggcaagagaatcgcttgaacctgggaggtgaaggttgcagtgagctgatatcatgccactgcactccagcctgggtaacagggagactctgtctttaaaaaaaaaaaaaaaagaggtcgggcatggtggctcacgcctgtaatcccagcactttgggaggccgaggcgggcggatcacgaggtcaagagatcaagaccatcgtggctaacacggtgaaaccccgtctctactaaaaatacaaaaaattagcctggcgtggtggcgggcgcctgtagtcccagctgctagggagtctgaggcaggagaatggtgtgaaccagggaggcggagcttgcagtgagccgagatcgcgccattgcactccagcctgggcgacagagcgagaccccgtctcaaaaaaaaacaaaaaaaaaatttattgtgaccgatgtgttgggaacaaggtgcagagctggagggtctggcctcctgaagggtcaagagcaagggcttcgagcctctgtcctgggcattgagccgtagggggccttgggcagaggctggggagggggctccttcttccagaggctttgccagctaactcctgacctacgtctgagatttcgtcttcctggtaaccaaagtggccctttatcgaatgtctcctgggcaagggcctggccccagcactgcggccagctctctggggagacacagataggagcccatgggtgaggtgagcgcggaagataagccgcccccgccagccctgtggaaacccagccaggcctgactgggtttcaagcacagcacgaggttcccacattgagctaatttggacagccaagtgggtgaaagacctttggtctctccctgctgggtagggtggttcacagttttgttccttttgtgcatttgtgcaggagactgagaagggtttcttctgagcagaaagcttagcctggggcttactggccagagctgcctgcagcctgggaagcaggtggagtctgcagtgctggcagcgccgccgtgcagcggtgtagccgtgtgtgcgcgtgtgtgtgtgtggtgagaaaccccacttttgctggggactgactcgtgaagaccacaaggtctgggcaacacagccttggcccgtgtggggtggacactgctgtttgctctgtgaattcgtgactgtgtttgcctctcctgaaacttgcttcaggggcgtctgcgggttggtggggcacagccgggtggggtgagtgcccaaggttggccgtccgcgtctcctgtgggcttgtcggggaccggagggccggggtgtgctagctgggtcccgagggtggagggcttcacccccgagcctcagatgagaggagtgggagtgcctggctgcggccggtgggggtgggtgggggaggtgcccgaggctgcttcccagagctgttctcgctggctgctgtctgagcactggggtgggtggggaggagggcgggtgggggcgggcagccttatcctgcggggctgcttgtgtacaagtaccacgcggcctgcctggccctgagccctgggcaaggaggcggaggctgtttttagatgaaggtgactttacttgagaacatgggttacgtctcatgtggccagaatcgaattctaacctttctggggctgtggccgagggtcaggcgccgtccctcctcctgctgctcatgggtggaggctcctggtgcggcgggcgagatggggtggtccgtggggtgggggcgctctgcattgtccccgaggagcctctatggaggctttctcttccggacgcccccccacccccagtgacacgtcaatacacagacaccagcatcatcagcatccggagggacacagggttgttccatccaaagccttttggtccctttgggagcgatgctgcccgctgagaagctggcggacccagcgggagcaccgggaccggtgcagatggcgcctgggagcccgggactcctggaaaggtggctgggggcagctcggctgcgggccccacctggtcctcctcactttcctgtgtgccctgccctgcctggaggtggggtgaggtgagtcaggggccagccctctcctagcacccctgggtgaggaggatgtggagcccagccctgcaggtctggaggatgaggagaggggctgctgcagggcaggaaggagcttgccagctgggcagcctctggctgtgcttcctgccctgactcacctcgcccagctctgcacatagctgccagtgttgcagtctgggaaatcttaactcccaagaaatgtaggttaccaggaggagatccctttgtgaaaatggcactgccagccaggcgcggtggctcacgcctgtaatcccagcactttgggaggcccaagagggtggatcacgaggtcaggggttcaataccagcctggccaaaatggtgaaaccccgtctctactaaaaatacaaaatattagctgagtgtggtggcaggcacctgtaatcccagctacttgggaggctgaggcaggagaattgcttgaacccgggaggcagaggttgcggtgagctgagattacaccactgctgaacagagtgagactctgtctcaaaaaaaaaaaaaagaagaagaggagaaagaaaatggcgctgccaaaacttgtcaactgcgcctgcccagagctcacctgaggtgctcagacgtgaacattcctgtccccgtggccttgggggccgtgacctgtgcactgccacgcagcctcggagccgtgtgcacgcatatgcacgtgtgtatgtgttgtgtgtgtttgcagacgtgtgtccttgtgtgtgtgtgtgtgttgtagcggtgcctggggagtctgacctcagaaggtgctgtggggagggctgcaaggtcctggcgggaggaggcactccccacgcttccccttgggctgggctgttcctggcaggcgagtgctaggcacagtgtgaggttctgtgtggattctgctgtgctccttggcagctctgggggccttcccttgcatttcgaaggaaggggaggcgtgtggctggaggtgagaggccctgaggccctgcctggctcccagcttcccaaatccgcctctctctgggtcgccgccctcagagattgctgaggacacgagctttccacccacgggctgtcctaacggagccgggctaggggcttctggacagaggccgcctgcccctttgggctttggggtttgtttttctcagcagctcacccgggtctctggggtcagggtatcgggcagaagtcagaggacggtgcgcttgggacctgagctctgggcagccctcggggctcaggactcctggctcttctgcccagtttcatgtgttttgtgttttgaaaccacgtgtggtcccacagttgtgccctcagaagccgccgtggctgccgtgaggtagcagtggacgggacgcccacggtctttcccatgccatgctgtttccagccgggccccatcactctcccacaagctgaaaggaagtggcttctccaccagccctggctgggagtcctgtgggcgaggccttccccaggagctgccctcccaagtgccccaggcactaacaagaccccacgcgtgctctccccacagccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacgtgagtggcgggcacctccctccccgcctccctcagtttccctcctgtgccgctcgcctcccggctcctgctcagtagaacccagacgcctcctcccctctccgtcccgctgtgccccgttgggcccaccgcctggacggaggggcccggacctgaagggggtgggctcgccgcctgaccaccagcgctgggcggcctggctcggggcaggcagggctctgccctccagcaggtgggtcctcgtcctcccctcgaccctcgtgccatccgttccgtcgtttctgcttccccgggcgcctgcccggctccctccctgagcgtccatactgcaagcctgaggggccctccaagctcagcccaggcttgcaggtctcagaaccttctgtgtccttcgcagcatctcgttctaagggattttcaaatttcaattcctagcgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcccagacccagccctcaggactgggtgagaggcctagactgggggtcccggacccagccctcaggactgggtgaggggcgtagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagcacacctgcaggtggggagggctgcctttccccacagcactcagaagatgcacgtggccggggctgatgagctgccccgagccacccctgggggtcactgagggcagggctggcagcacagatgcccctgctcggggcctgagtggggccagtgctgacaggctgtcctctcgtcctctttttcatggcggcggtccttcttcagatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctctcctggctcctgtctgtgcctgacggggttgggttttccgagagcaggtgcaccctgggctctggtggtcacagcaggggtgcgtccagtactgggatttcacatgcgaggacgggtctgctgagaccgcagtgggtgttgggtggctcggggcatgggctggacagggcctgaggctgtcagccggactgggaacttggaaggtggctggggccgaccccgtgcctcagagccacacagaagagagtgggcactgacctgagccttctctgagcctgttactcctctcggcatgttttgggcctgacaaaggctgaggctttctgctgcctgccctgcagctgcctgcacccacccacctgggcgggctgcttgggcaaggttcaggggtggtcctggctgctcctggagagtgggtgtgtgaagctggtgcccagaggctgagggatgcccagcccctgcccgcccagcacacggaacagatgtggttgcagggctggagagcttgggggaccaggagcttagagcgtggaggttgcaagttgcaggaccagtaactgggtctggagggaggtttgcagcggctgtgtcagccctgcaggccgagtgtggcactgggccttctgctggtctgagcgggggtctcagggtggaggtcagcaaaagaggcttagtgggggcttagggagcctgggtgggttcccagagaagctaggaatcagatgggaagatgggaaggcagtgtgtttccgtgttgggcaaatccagcgttttcatgccacggaagccaagaaagggctcacggcctccggcctcacagggctacgcaaagggggagttgaataaacacggtgacgggccccgggcggcagctgctcccggcactgatcctgctgggccagcggtggacttgcagggcccacatccggagctgcccactggtcctcgtgctgcacagccttggaggatctgaggctggctcagggtccctggcagcaactgccctgctaggtgggggctgctgggttccacagctgggccctccctgccggctgccaccaggcggcgctgcacgcccacgctgagtggggcaggccctggagcccctctgcccgggcagcctgacggcccctcctcctcggctgagaccgcagagtcccaggcatcacccactgaaagtgtgctcagtgacctgtgaatagggatgccacgtctgcgtgcagacattgattaggcgcctgtggtatacctggagctggagggtgtgcgtggacaacaggcagaaaggtccagtgggatggaggctgccaacaggacgatggggaaggggcgcgttggggacatcgccgggcacgcggcccaggtgggcccctggctcaggtctccccccacctccctgcctgggctctgtccatctttctgccgcaccctcagccccaggtgtgggcccaccgtgcttgtggacgcctcatgctctgtaccgggtgggaggtgtgggagttacaggtcagggcagccttgggagacgggcaggtttcctggggtgcttaccggcagatggggcgcctgggtccgtgcagggtcgtccgcccgagaaagcagcccctcacccctgggcactaacttcatcttttttctttgcacacagaaacgtaaacctgattcacaaaagtataaccactcagcatgtagctttgtacacctgccctcagcatttagtgtcctcgttcatccaacaagcatctaataagcactggggtacgcagtggtgggtgtccgccccgtcactgggtgtccagcgtggggtgcggaggtggatgtccaccccgtcggtgggtgcccggcgcggaggggtgcggaggtggatgtccgccccgtcggtgggtgcccggcgcggaggggtgcggaggtggatgtccgccccgtcggtgggtgcccggcgcggaggggtgcggaggtggatgtccgccccgtcggtgggtgcccagcccgatgtc

SEQ ID NO: 13133 - DNA, 9843 bp, Human
agcccaggccggagtggccaagccacggcggggtcaggtcttggccaaggtcacactgtccagcccccgcacatcctcagtgagaacacagggtcccatccctgccccactccccaatcccgggagagtcccgggggaatgccagaggccaaggccaggtcgagacggcggggtgtcccccgtcagtgagaacacagggtcctgtgcctgccccactccccaagccggggagattcccgggggaaatgccagaggccaaggccaggtcgagacggcggggtgtcccccctcagtgagaacacagggtcccgtccctgccctgctccccaagccggggagattcccgggggaaatgccagaggccaaggccaggtcgagacggcggggtgtcccccctcagtgagaatacagggtcccgtccctgccctgctccccaagccggggagattcccgggggaaatgccagaggccaaggccaggtcaagacggcggggtgtcccccctcagtgccactaaggcagaacttggcccctggccactggctgctgggggacacaggctgggcagctaaggtggaggaaagggtacaggtgtgtcttctgtgggcacagatctcactcaggccagagaaggggctgtgccgtggggctgctggacacgtccgtttccacctgcggggtgggcaatgccggcacagcgagtggccagacacaggcatgcccagcagacacccaaccgctctccaccacctcaaccttctgtattttcctgaaagcatttaccactccttgaagttatagattaatttgtctctgcattttgttgtccaaaccaggagctcggtgagggtgtgatggggtctgccttggtcaccgtggcaccccagcaccccgcagggtccctctggccaaaagagatgttcactgatgccctagaagcaggaacagaggggctcccctgcgctcgccaagggcgcctgacaaatctggaggcccccatgacagaatcagctccagagtaggaaatgtgtctggctgcacgaaagccccctcgggcgcagcgcctccaggcccacgcagatgtcgctgtcatacattgttggaaacgcctctgctggaaacagtgtttgctgaatcttggagggagaggaaaaaacctagtaaacattcttgttgaggtgatctgggggaatgtctgcaaaggcttggagggctgatggggcagagctgcccaggggcccaggacaaaggccaggcgtgcgcgcgcacacacacacacacacacacacacacacgcagtggcctccctgggggccgtggctgggcgaggcctgctgttgtccgagatgctggaaggagctgtgtctctgggtctgtcccggccgcaccccgttctgtcccacacccaaccactccccacccacaggccggctccagcggccaggtggacgggtgcgcggcccgcgctgtgagcagggaaccatatccagctgaggttttgggtgtgtggggcgggtcgggaacaaggaggccgggttggggggctcagaccacacttggaccatgaaagtgaccacatgcaaatcacagaaacgggatgcagggatccacagacgtgctcctcttgggtccccgttacctcaccgccacccctgaaactgaagacccccaaacccactttaattcctggagacggcccctcgatccacccaaaaggctgccaccacctcgaacccacacccctgtcccggttccgccctgggtccagccacatctccccaaatgcattctctggctccggaaggggacccgggcgctcgcccccaactgccccccgcagcggccgggcccggcgcctgcccaccccgcgcgggacacggcctcgcccccgccactcccgcgccgcgccccgccccgcgccccgccccgcccgcggcccgcgggacctttatagggagcgccggccgcgcgctgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtgagtggggcggccagaggggcgggcggggcgggccacccacgtggggctgcgcggaatgcggccggggggacgtcggggggcgcggcggcggcggcgggggcgagggcggtgtccggcgcaagctggagccgggaaggtctgaaggagggtcaccaagaggtcagcagagcagaggtttctaatcacaatgaccgctgacatttattgagcgcttagtgtctacctctcccctccctgaacctgtgccatcccgatagtgccggagctctcttcatctccgtcttccagatggggaaactgaggctcagggtcacacagcctgtagcaggcaaagccagggttctagccgcgaccgtccgggtcggtcctggtgccgagaggtagtgctgggtgtcgggagccaggccctccagctggggctgagagctttcccgggtcctgggtagacggggcatggagtctcacacctgggacttgccgggaggtgccaggcaggagacggccccactcctggcctcagtttcccctcctatgatgggtgccaaggtgctgcgttccacaagctggtccctggcagtgtctgtgaaccagcaagcgctctgggatgggggctgtggccgttcctgcccccagggacgggggaagaaatggggggctctctggctccccaccccccatccctgcagccccaccccaccccagccctgcgccaaagggagagcagagccccctccccgaaggccacgtccctggggagacagtgagctcatgcaaggggaatgttcccaagttggagtgagtaagaggcgggccaggcggtgggggggctgccaggcgcggggctccgcgtgccctcgccctcgggtgctgtctagacagagggcagaggcgggagaagcggctccagggcctgctgaccctgacatgcccagtgcctggtgtttggtggtgtttgaggggttgggcagggtgccagcccctggcctgggggcttggagggtacgggaagggacctcctggggtgggtgggggttggtggtgaggctgtgggggggggcacgtggagctcagaggggaggagacatttccagggttctggagccagggtggggacacccatgtggttttctgccccttcttcctgggtgggggtagatcattccgtgcgtaactactcagcaccacctgcatgcatctgtgggcgggccagaagctgggtgtcaggagtggcccaggagagcaccccgttccccggcccgcaggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaaggtgagacctcaggccagaagcagggcagacgtctcagctcaggaccagccacaaacagtcatggtggtcgagggccgaacgtccagggactgagcccgtcacaggggtatgtaggaggctgcagggggatcccagcctcagagagggactggggggacttcccggttcccaggctccagcctcttgcagctcaggactcaggaagagaccacgtggctccagcctttgctggggctgagctctctgcctgggtggctcttcccacctggtcgataaatgtctggcttgcacctagctcctgggaaggtgggtttgccattctggcctgtgaccccaaatgtccacaccagggaccttcactgcagactccagggtctgcggtggggttacagctgcatgtttaacaagcatttgcctcgggaccctgttttgagaggatgcctcccacatcagactaggggctcttggttggcgagtggcacagaacgaatgaataagattctccgcactggaggatgatggttttttttttttttttttttttttttcctgagatggagcctcgctctgtcacccaggctggagtgcagtggtgcgattttggctcactgcaacttcggcctccgaggttcaggtgattctctttcctcggcctccccaggggctgggactgcaggcgcgcgccaccacacctggctaatttttatgtttttggtagagacagggtttcaccacattggccaggctggtctcaaactcctgacctcaagtgatctgccagccttggcctcccaaagtgctgggattacaggcgtgagccaccatgcctggcctgttggggcacatcttgaaggaggtgggcattagagctggggtgttgggggatgtctaggagtttgccagatggggccggtatgggagagtggatcaggagagaacatggcttgaggttaggtcctggtgggtggggtcaggcagaggagccaaggggaggctgaagctgagggctgcagacccgaaggccaggctgaggaactctgctggcctctgagatgtgattaatcccagatcagcctggctgggtggtcctgaactcactgccacatacccctgctccctccagacccccctctggcttctgggagaaggacagtcttcaaaaagtgcctggcctgggcatgagacggcccaggaccccccacccccaacctcatctggccctggggacggaactcaggcccccttccgttctcgctcgcataaaagccaccctggccgagcatttccagatgtgcctgtgagccgctgtgccggggccgcccaggtgcggcccacatgccctgcaagggctgcgtggcgggcgctggccatcccctaaggagtgccgcactgccttggaagtggggctccctcgtcagccccactttacacacagagaaactgaggctggcacataaactcaacagctgtgttcagaggccctaccagacccccagataacagaaagggggttggtcatctgggtcctggctgcagctttcaaactgaggtgcttgggcccctgcactcatagctgcgacccggcctcagtttccccatctgtaaaatgatgacttgggaagatgcgataagcctaggaggcgatgagcattcacattgaaagcgggggcggggaccccagagagagcttccctagcaggacctcaatatccctgtctgagcagcggggctgcggggcagctcctggttcagaggcctagggctgtggggggccccctcccctggaatcgctccccaggccaggagggccgtccagcgccccgccctccccgacgcctcctgggggaaggtcctggcagccccagactcgcgcctggcaagggcggaacaccccaggctgacgcagctggggcccctccggccttcccagaagagcgcgtgcatcgggagcagacgtcagccagctgcaaggaggagcggcccggggctgcgtagctccgctggaccccgattccgggcagagacccccccccgccccggcccgcgcgcaccgagcccagcccccgccccccagcgcaggcgcagcgcggacctcggccccaccggtcccgcgcccggaccctgagccctgcccctgggaacccgagggccccgactccgactgaccctgacctgggacggcgcccccgcctccgccctgcagaaggggcgcagggaggggccccgaggccttcgcgcggccccacgcccgggaccctcccgcgcccggccccacgcgcgtgtcctctgtccgcagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcagtacgtgggggcgtggtctgtggaggggcggggcgggacctaccggacctgcgcgtcatgtatcgaggctgctgccgcagtaggcgggggcggggcctggggcgggaccacccggacctgagcgtgacgtatcggggctgctaccgcaatgcgtgagggccaggcctgcgggggcggggcctgctggaggggcggggcctgctggaggggcggggccgctgccgcagtgcgtaggggcggggcctccagcccaggacaggtcacatgggtggcggtggggcctgagtaagggcgtctttatacttccgagggagtatcacggggtagggtcttttgtagggttgggatttggaaaatagtgggcctctgggggctcacactgggcaagaggtatgtggcatggtcagagcgggagcgtgactcagagaggggcttgtgggtgtaaccagaggggcatgatggaaccaggggggtgagactgggtcatgtaaggggcggggctcttggctggggcgtggttcctgggtggagatgggcggggatttgtgggtggagtttgggtgggcggccccgcagtcgcggaggggcggggctttgggtagcataaggggcaggagctcacgaaagaggtgtggctcctgggtacaatgggaagggcagggcttgtgggtggagcctgaggggtggaatggagaggggggctcacgggggggcgggggggtgcttgtgtctcctaccagagggttttcgcatcttgggggttaagggtgggtcttggggccaagagccctgcggggttctcagcgagatgtcccctgaacttcccctggcacccggcctgcagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggtgcagacgcagggcgggggcacaggcctgtcctgggggccggagaaccccctgccctgcgccctcaatgctcttatcgacccttgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccattttggggtgtccaggcctcagtttgtctcctctctcaaggcttcaggccgcccccacggctgtgggatgggcagcctggggcctggggtgccgcatgggtgctctggaggcacgggaagagagacccagcattagtccttgggcagcctctggccgcctctgggcctcagtgcctctccaggcagtggacaagcccgggaggggctgaggcagagcgggaggggagggagagaaaggaggtcttttgggagggcacacaggatagacaagatggcttagggcagccctaagacaccagctggcttgggacccagaaatggaggcccggccttgaatgacttgggtgtaacgatagcagtaataaaaataacaggattagggcccgggtggggtagctcacccctataatctcggcgctttgggaggccaaggcgggcgggtcacttgaggccaggagttccagaccagcctgggcaacatagtgagaccctcatctctacaaaaaaaaaaaaaaaaaaaaagacccaggcatggtggcatgctcctgtggtcccagctactcaggaggcggaggtgggaagatggcttgagcccaggatgtcaaggctgcagtgagctgtgttggcaccactgcactccagcctgggtgacagagtgagactgtttctaaaataataataatagcataattggccgggcgtggtggttcatgcctgtaatcccagcactttgggaggccgaggcaggtgaatcatgaggtcaggagttcgagaccgacctggccaacatggtgaaactccgatctcggtgagccgagatcgtgccactaaactccagcctgggggacagagcaagaccccatct

SEQ ID NO: 13134 - DNA, 31467 bp, Human
  misc_feature (1)...(31467): n = A,T,C or G
gttctcgtgccgtgcgggtcccgcctcctccctgctcccagccgcgagccctggggctctggcgacctgcccggcctgacatcttcccagggtgaacataaaagaacccccttcagctggagcacgcatctgcctcggggcgggccacagcctggcactgccaactgtgccgcccgcccggcctctcccgcaccaccttgggacaaacagctgtcctgcccgcctatgcggaggtggccggcggggccggcgtgggggcgcagggatccccagggtgtggggcagccaggccgaggcgagagacacggtcgggctcagcccatccactgtcagccgggcacatgctggccctccctcaagtaccactgagtgcctcctgggtgtaggaagagggccatctctgccccggtggcctcgaggtgcagatgggtggggggcacccggcacacgggacatcgtggctgagaggacgtcaggccaggtgccaggagggtcccaggagggcctcctgcctccaggtggggatgttcagcctccacttcttcgagtgtgactgtctgtctcctctctctcacttgccagcttcctcacctgccccctcccggctgtctggtgggctgggtggctagggacagaggcctcatgtcacctggcaccaagcagcacccacgcccagccggcttcggcccagaagcagagccttgggaagcacctgtctcagagctggggactggaggcactgggggcacagctgcacccggagtccgaggggtcggggaaaggaggcaaccccggggcagggggctctggtacccgtgcgaaggcgctagtgggctttgggtctccctgtgaccccaatctaaagcccaccagacctagaggagacccccgccgcacggctccccagggcactgtttgaggggtgggtgggaaccccacaccctcgggtggcttttccagttttccttgtctggctgggcttggcctcagtttcctcaaatgcagaccagggagaggagtgcctgagtctcccagaacggcgcccaagccggcctgcccctccccacgcactcaagggtctctgtccagggcccacaggcgacccagcaagggctcctgtgacctttagaaacaccctttcgtcgtggaagtcttcaaacctcacagaaagcaaggaggcgctggccgtggcggcctctcccgtctcccaggcccgcgtccaccctccccgcgccggtgccctccggacagaggtggaagccgcggcgcaggagaggcggctccggccgggcagcggggcccggtgaccttgggcgcgtccttacacgtcgcgggcctcagtttcccctcctggggagaggcccgcgcggggctccgaggcctcgggccgcgtgaccttggggcgcccccgaccccgcggcccgagtttcccggcgccgagcggaggcggcgcgcggggagggggcgcagccgaggcgggtctcccgcccccgcccctcccccgcccctcccccgccgcgaggctccgccccccgcggctccgccccgccccgcccccgcctcccccctccctcgggctccggccggcggcggcggcggcggctccgctccgcactgcccggcgccgcctcgccatggacgcgcgcgggggcggcgggcggcccggggagagcccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggtaccgcctccgggagggccggtcggcgcgagggggcccggggagccgggcgcgcggggagccgtccttggagcgcctggggagggcggggcggcgcgccgggccggtgacctcggggctcctcggtgacctcgggcgtgtccgggacccgccccggagtgaccccggcgcgcgaggctccgcctctgggggggctccccgggtgaccgcggagcgcccccctcccacgcaccccgacatcctccgccctgcggcgcggcgggtggggtgggccgcagggccagggtctgagcgcagaggggcagagaggacgaatagaggggaacgtgggccccagagaggcggcggagcgggagggaggaggaacgaagggcgcccgggaaggacgcgccccagggaggccgggggagagggggttaagcggctcccacggcgtccacccgcgccccgcctgcgaggaggcgcgcccggggccgcgggcctggaaagcgtgcgggtccccaggctgtgtccccgggagccgctccacccgagccgcgggcggtgcgcgcatgcggcggtgggtgtgtagacgccgctgtggatccagccggctaatgcgtggaaggctcggagcagggccggcgcggggccaccgccactgatgtttgcggtcgtggttcctgggctgtgcgtgctgtggccggagagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctcacacacgcgaccatggagggatgcgtgtgtgtttgtgtatccacgagtggggtgtgaggtggggtgtggagggtgcaggtggagggtgtaggtggggcccgccgggctagcgaggccgggcgcgcgggacgggcgcggtttcagcaccacggacagcgcgccggacctgggaagcctgcggttttcccgcctgtctctcctcctccaggcctgggcgccccaggacagcccccacggaccctggacccccggaactgggcagggaggctgtggggttctctcttcccctggattctctgcacccctagtgcttgactggagaaactgaggcctggggcacatgcgtcctggacagagcctggaggaaggccctggaatcctcctcccaccccaggccttcctgagaggtgaatacagctttgaccagaagcctggatttcgagacaggccaggggtgggaggagccccgaaatccccagaggggctgtgtccggcccctcccaccctgcctctgtgccccaccgggagagcttggtcagcatctgggctctggcctgcgaaatgtggacagtgagcgggaaggactggacttccagggctgctggtcggcctggccccacttccagtcgggcagtggcaccccctgaccggagagggacgcggtggagagggagctgtagaacgtgcccactcccctccgtcccctccagcatgaccttcgacagagatgggtgcaccgcagcgtgggggctggcaggtggaggcccacaccagccactccctcccctgggcagctccagcgaccccctggctgcagaggggcggtcggtggcctggggggcaggtgggcagatggctgatcccggggcttggggggaaggccggtggtaggagtgaagccctctcatccttccaccctccttgggcgtggtcgcctggaggcctgggcaggctgtggccccgctctgtgctctgaggcatagagggctcagaggcccctgtgtggaccaagtgcagccccaccccggcagatgagtgttgaagtggaactgagcaggcagggaatggggttagcggggcctgtcttcgggactaggggagtcacggcagtcagattttaaaaaaggatttcgatgttgccaagctgggtgcacggggcccctaggaccctccccaggcttgggacctgtgccagtgtggaatcagtgtggaaaaagacccccaagaatatctcaaaagctccctaagcaggcggccggaccctgctgtggagggtgttttggggcagcccacagcaagcgaaggggcctctacgtttgcagctgactcaggagcctggccccaactggcttcgggcccaaggcctcctgtgcctggctgggtgtcttgggtcctcgctgggcccctctgcctcagtttccccaattgcacggtggggatggtatgagggagaaggatggggtctttcacagccttgccagtgtctcagcctcacgtctcacactctcttcacctccccttcctgctgagagagtgctgtgctccttgcccagcctgtgccccccaggcacgccctcaccccggttcttcctcgctgcccagctgtctccgccacgcccaagtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcggctcacgcctgagatcccagcactttgggaggctgaggcgggcggatcacctgaggtcaggagttcgagagcagcctggccaacatggtgagatgatcccgtctctactaaaaatgcaaaaattagctgggcatcgtgacgagcgcctgtaatcccagctactcgggaggctgaggcaggagaatcacttgaatccaggaggcagaggttgcagtgagccgagatcgcgctgctgcactccagcctggctgacagagtgggacttggtctcaaaaaaaaagaaaaggaagaagaagtgcagttggtctattgctgaagtctctggggctgtgggtggctctacaccccggcctgacgtctgaaagtccccagaggcatgctgggcgcttccctggggtgctggtggaagagcaagttcaaggacccaagttcaaggttttgggttccagaggctcaagttcccttccttgtaggtgatcacggttggtgcctgaattggaacaggcgtgaaaaccaagaaggaaggggtttggccttatgcaacccccagggcttcggcagggtcttctgtgcctcccagagcaaaattaggtcaaaaataagtatagttcattcctactcccttcaccccagccgccgctgattctaaaggccacacaggtccacttgggaaagcctgagtcgtgcaaaggagggtgtctccgcaggagaggggcaggggctggaggtctctgcacgagaagggctggggctggagggtgtctccgcaggagaggggctggggctggaggggacacgaaggcccagggaggggcggtctgaggaggtcgcgttctccgaagcttgctgtcatccaccctccctgcccccggtgtcaccgagggggctgggcagacctggcggggtggagacctgggcagatccggggtttgtgccctgggagctctggggggcacagggcaggtgtcgggtggagagaggctggcggcttcctgactgccctcggtccagttccagggctaagtgccctgtggccgccctgccgtctcctgctgctgctgacttgcaggtctgtgtttctgaattgtcttcagctggggaggccccgtgtgaggggagacagacgagatgctccccaaagccaggatctgttatgtcccctggggtccccgagaggactggtcggggaggagctgctccaagaccccaccaggacaggcggcccctgggccccgcctcagatggctgagtgggtcagcgggagatcagcctgggggtgcagctctgcaaatccgcagtgatgaatcccagcattagggcgtgggaataaaccccccattatcctggggggatggccccgggggcagggcgaggcgagggtttgtctggctctggtcacggcaggaaggcccagcgtgtgcaggatggtggggtgtgcatggacccatatcccaggtggcggtggcctgccctctggtctgcgtggaggggtcaggggtcggggtggccaaggcctccccgctctcttcagggccttccctatgttccctgctcgaaaacggacatctttgtccaggcactgtggctcatgcctgtaatgccagtcctttgggaggcggaggcgggaggatcgcttgagcccaggagttcgagaccagcctgggcaacatagcaagacccccatctctacaaaaagttaaaaaattagccaggcgtggtggcgtgcacctgtagtcccagctactctggaggctgaggcgggaggatcacctgagcccaggaggttgaggctgcagtgagctatgatcgtgccactgcactccggcccgggaaacagagtgagaccctgtctcaaaaaaataaaaaaaacctaaaaacccacatattcaagtcaccttcatcagccccccactcacttgggccgggccctgcctcaccccccaccccacggttcagcctcgcaccctgtgcgctggccgcctctctcctgccagatgcctccccgtccccctttctggcctcccggctgtcagcatgggcctctccagacatcggtccttctttccctgtcacctctacctcctccctggctccagccctccccagtcatgtcccctggtcccgaggccgcccaccggccttgaagggaacccggagcatcaacctccgcacctgctgcccctcttcagccactgccctcccctcaccatctcatccacccacacgccacctcctccaaggagccctcccacctgcctggggctgacaggcccatcccatgtgtctgtcttggggctgggcctgtgtggtcatcgtgtgccccggcgcccggcgagagttcggtgaacatctgccccgtcgggatcacccgggaacccgagatctcccccacccgtagcagctccctttcttaatcctgggcacctgccacggatctggccatgactccacagctgagagtgccgtctcctaatcccccggcccgaggctctcccttaatcaccgacctccggcccctaatcctctcccggattgtccccatctgtaaatcctggacggcctccggcctgaggctgggctcctgcggggagggcctggctgccctcgcccgttccccaacccgggactcaggctccagcaggggctgaagaccccctgggcaggccctcccctgggatccaaggggctgagggtcctgggccttctgttgccaggagacctggtgtcctcgtggggtttgggagccgggtcggcggcctcctcccccaagcttcatccagccctggagagacggggacctgcgtcggctttgggaacttcaggggaagaaccctgagctcggggcaggagaatgacatggtctgtctgggttcccatcccactgtttcacttatggctggaggagcctcagtttccgtgtcagagccgagagagaggctgggcggctgttggaggagggctgagctcacatcggtgtcaggtgccgggggccccactgaagccactctggagtgagagggggtccgaggcttcttccggtcccccaggtgtgagagctgaggccggaaggtttccccagggacccagcctcatcccggcctccggagctggtctccctccctgcctgcgagggccaagctggacaaagtggcaggacccccgcgtttccgaggaaggggccctcgtagaggcctcactgttacctgtcggggatgggttttaaatacaggatttaatgatggtcactgatgtttctgtgacagctgaggggggcctgtccctgctcagcactggggttggacaaggagggcacagggtgcccggggagtgctggggcccgcctgggtccctatggtggccggatggggaaagggctgccggacgcggctgcacagagtgtgagggggagtggggttgggctttgggccttcccctgaccccaggtcccctctctggggtcctgtcttctggagctgcctccccctccccagggcgagaggcaggagagggtctcccaaggtcactcagtctagtgttgggcaaggagagggttggggtggagagggttggggtgcaccggcagagacagtgacgccctgcagggctctggggtcccctctgccccaggcctcggtttccccttggtaggggacatgcgtgggcgcccttcttccttctgacctctggctggtgacgacgagggttgcggccccaagccctgcttggaggcattgtggttggaacgggcaggcccagccccacaagggaccctcagggtggccaccccacctgtcccttctcctaggcccctctgctctgacccccgtaatccccaggaatactgccctgctgggcaagatgggctgaggagtcctttctggggacacaggagcagaaggctcaagggaggtggtttccagacagtgtgggccgtggataagaggacagtcctggggtctcatcctgcagtcccacttccatcagaggggaggtgtggtacctgcccccagctcaccccaagaataaagggggagaatgtctgttaatcatcacctggaaaggaggccttcatgttatatggccgtttaaaaccaggtaccccttggcggtttctaggtcctcctggtggtttctaggtctccttggcggtttctaggtcccccttgacagtttctaggtctccttggtggtttctaggtcttcctggtggtttgtagatctccttggcggtttctaggtcctcctggtggtttctaggtcccccttggtggtttctaggtcctcctcgtggtttctaggtctccttggcggtttctaggtcccccttgacagtttctaggtctccttggtggtttctaggtcttcctggtggtttctaggtcctcctggtggtttctaggtcctcctggtggtttctaggtcccccttggtggtttctaggccctcctggtggtttctaggtctccttggcagtttctaggtcctcctggtggtttctaggtctccttggcggtttctaggtctccttggcagtttctaggtcccccttggtggtctctggagccccctgggagtttctcctcgcccctcgtgggggaggtttctaggccctgtggccttctcaactgctctttcctgctggttttgtcccaagactggtgctcgaaggtgggaggcaggtctcaatccagagggtgaggctggggctgagctccacggtgagccccctcggggctgaggggcagggggccagcggcaggcgggtggcatcccctcagcccactcggtgctggggccctgggggtctcgttgctgagcagatgtgtcggactgggggcctgagccctcatgtcctgtctagactcagggaaaggaaggccttaaatttctagtccttttagtcatttgatttcacccttcaagcttgtgaggggacccctccccaccccgagatcaagtcagccttttttttttttgagacagagtctcactctgtcacccaggctggagtgcaatggtgcagttttggctcactgcagcctcgacttcatgggctcgagcaatcctcctacctcagcctcccaagtagctgggtccacaggtgcgcaccaccacgctggctaatttttgtattttttgtagagacgggatctcactatcttgcccaggctggtcctgaactcctgagcttctgtgatcctttagtcttggcctcccaaggtgctggcattagaagcatgagcccctgcacccacccttcccttcttttttgagacggagtctcgctctgtcgcccaggctggagtgcgatggcgcgatctcggctcactgcaagctccgcctcccgggttcatgccgttctcctgcctcagcctcccgagtagctgggcctacaggcgcccgccacctcacacaaaaaaataatacatttttgtatttttagtagagacggggtttcaccgtgttggccaggatggtctcgatctcttgaccttgtaatctgcccgcctcagcctccttaagccctggaattacaggcgtgagccaccgtgcccagcctgagtcagcccttctctaggttttatccccagcctgggtggttcttggggggtgtcccgaaggctcagcccctccccatcccgaggcggtggatgcttggaagaagagactgaggttctcaggggctgcaggaacttgtccaaggtcactgtgccagcaggcgggtgccagcccaggtctggctgatgccaccacgatgtgagtcgctgggtcccttccagcgtttggctcttgcagaccgagctgctgtgaacattttggtacaaatggctttttaatttttttctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtggggaccccggccatgatagggaggggctgggcctggggtggggataaggcctcaagaattggccgggcgcggtggctcacgcctgtaatcccagcactttaggaggccaaggcgggcggatcacgaggtcaggagttcgagaccatcctggctaacatggtgaaaccccgtctctactaaaaatacaaaaaaaaaaaaaaattatctgggcgtggtggcgggcgcctatagtcccagctactcgggagggtgaggcaagagaatggtgtgaaccctggaggcggagcttgcagtgagccgagattgtgccatcgcactccagcctgggcgacagagtgagactctgtctcaaaaaagaaaacctcaagaactaagaaggctgagttggtacagggatgggaaggggtcccgtgtgtgtgtgtgtgtgtgtgtgtgtgtgtgtgtgtgtgtgtgtgtgtgtcagagggtctcatgttacccaggctggtcttgaactcctgggctcaagcgatcctcctacctcagcctcccaaaatgttggaattataggcatgagccagtgtgtttggcctagcccccagtgttaatggcaaaatcctatgaatctttgtgctggaaattcaagaccctcccttgtctgagtcaggcacacgcaggccatgtgggctcagaccccagtctggaacctccccttcagcaagagcccttggccccagagcccagaggtttttgttttgttgtgttttgttctttgagacagagtctcgctctgttgccccggctggaatgcagtggcacgatctcggctcactgcaacctccacctcccgggttcaaacaattcacctgcttcagcgtcccgagtagctggtactacaggcgcccgccaccacgcccggctaatttttgtattattattttttgagatggggtctcactctgttgccaggctggagtgccatggcgtgatctcagctcactgcaacctccgcctcactggttcaagcgattctcctgcctcagcctcccgagtagctgggactacaggcacgtgccatcatgcccagccaatttttttttttgtattttttgtagagctggggtttcactctgttggccaggctggtcctgatctcttgacctcatgatgcgaccacctttgcctcccagagtgctgggattacagacgtgagccaccacacccggcctaatttctgtatttttagtagagacggggtttcaccatattggccaggctggtctcaaacccctgacctcaagtgatccgcctgccttggcctcccaaagtgctgggaacacaggcgtgagccaccgcacccagcaggcttttttcttttatcagttttccaattagccattgtaaaacctatcaatcagtgtcattaagcccattcttgctgttgtacaaccgtcaccactatccatagtccatacctttctcattcccccggacagaaaccgcaccccgcacatgccacttctcacccctccaacccccggcccccggcacccatgcatccccttcctgtctctggattggcctgtcctggacatttcgtagaaatgggctcacacggccgggcgcagtggctcaggccggtaatccccacactttgcgaggcctaggcagaaggatcatgaggtcagggtttcgagaccagcctgaccaacatggtgaaaccctgtctctactaaaaatacaaaaatgagccaggagtggtggctcatgcctgtaatcccagctactcaggaggctgaggcaggagaatcgcttgaacttgggaggcggaggtggcagtgagccgagatggtgccactgcactccagcctgggcgacagggtgagactccgtctcggaaaaaaaaagaaatggcttctctcactgaacgtgacgtcctcaaggggcatctgcgccgtggcctgggtcagagcctcactccttttcgtggctgagtcgtgttccatggtggacgggtcgcgccgtgtttgtccctccgtttggtgatgggcacctgggctgcctctgcctttttgctactgtggatcgagctggtgtgaacacagcggagtggtcgtcgtccgcagtcgagctggtgtgaacacggtggggtggttgtcgtccgcaatcaagctggtgtgaacacggcggggtgctcgtccgtccttgttttcatttctttgggtataatctcggggcagggagaggctggtaattttatgtctttttaaggagccacccgtgtttgctccgagtcgttttgattttcattttctcgatagcgaaagggttgggcatctgtccagtagccatttgctgaccctctatgacctcctgtgtggacgcggcactcccagcaccgtgtctggcccgccatacgcaggccctgaaccgacaggaccttttctgccagagcttcccagggagagttttgggatccaccttggggacttggactctggccgggtgtatctgggagtggaaacgccctctggtctcttgtccacgggtatttatcatacggaacgtccgaatggtgccaagtccggctcggccgttcctcccaccctctcggcctcccctgtggcgccagccccgtctctgcttggcttccctccctcctgtgtggacgccccacttcctcccctctcctcctgcgtggacgccccactccctcctctctcctcctgcgtggacgccccacttcctcctctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccacttcctcctctctcctcctgcgtggacgccccacttcctcctctctcctcctgcgtggacgccccacttcctctggaaatgcagccggtgctgccctggttcagtcttcctgtggcccctgtggaggctcccgcttctcagtaaggcatctggggccctcacctcccggcgtgagctgagcacggttcatttcccaccctggcttcccgccttcgctctccctgtgcgcgccgccctgcctcgccctgctgcttcccagtgcccctctgcaccccggctcctctctgctcctctgctgtcctgtcctgtctatttttttaacgccaaccttgtgccaggcacattgtccctctctggtcatgtgaagcacttaatctattttgagccacctcttgggccttgtgaggtctcctgcatcttcaaggacacggggtcaaagttgggcctgaggaagggacctgggctagggcagcgcagtgggcgttgggctccctcggggctgggtggccttcctggggtgggagcctggtcccgagggaggagtgcccagggcttgtcctgcaggcgcctggggggaaggcaccggcctgaggtgtgggcaccctcgccccccagggaggaatgcccggggctggtcccataggtgcctgggggaaggcaccagcctgaagtgtgggtacccctcgcccccagggaggagtgcccagggctggtcctgcaggcgcctggggggaaggcaccagcctgaggtgtgggcaccctcgccccccagggaggaatgcccggggctggtcccataggtgcctgggggaaggcaccagcctgaggtgtgggcacccttgccccccagggaggagtgcccagggctggtcctgcaggcgcctggggggaaggcactggcctgaggtgtgggcaccctcgtcccccagggaggaatgcccggggctggtcccataggtgcctgggggaaggcaccagcctgaggtgtgggtgcccctcgcccccagggaggaatgcccggggctggtcccataggcgcctggggggaaggcaccggcctgagctgtgggcaccctcgtcccccagggaggaatgcccggggctggtcctgcaggcgcctggggggaaggcaccggcctgaggtgtgggcaccctcgccccccagggaggaatgcccggggctggtcccataggtgcctgggggaaggcaccagcttgaggtgtgggtgcccctcgtcccatagggaagagggcccggggctggtcccataggtgcctgggggaatgcaccagcctgagctgtgggcaccctcgccccccagggaggaatgcccggggctggtacccataggtgctggggggaaggcaccagcctgaggtgtgggcaccctcgccccccagggaggaatgcccggggctggtcccataggtgcctgggggaaggcaccagcctgaggtgtgggtgcccctcgtcccacagggaagagggcccggggctggtcccgcaggctcctcggaggaggcactggctcgaggtgtgggcgcccctcgtccccccaaggaagagtgcccggggctggtcccgcaggtgccccggggaggcactggcctgaggtgtgggcaccctcgcccccaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggaggtgaggtggggcgggggcggggccaaggcagcaggggcggggctataatggtgcgtgggcggggccaaggcagcaggggcggggctataatggtgcatgggtggggccaaggcagcaggggtggggctatgagagatctgggtggggtcaaggccccaggggtggggctatgggagatctgggtggggtcaaggccccaggggtggggctatgggagatctgagtggggtcaaggccccagggatggggctatgagagatctgggtggggtcaaggccccaggggtggggctatgggagatctgggtggggtcaaggccccagggatggggctatgagagatctgggtggggtcaaggccccaggggtggggctatgagggtgcaggggtggagctacaatggtgcagtggtagagccaagacagcaggggtggggctatcaggttgctgagcagggtcgaggcagcaggggcagggctatgatgctgctggggtggagtcaagcagcaggggtggggccgtgatatctgggtggggtcaaggagcaggggcagggctgtgagggtgctgggcggggtcaaggcatcaggggcggggctatgagggttgtgctgagcggggtcagacatccgagtggagatatgagggttgtgctgggcggggtcaggcagcaagggcgggactatgagggttgtgctgggcggggtcaggcagcaggggcggggcaatgcgggttttgctggggcagggccagacatcaggggtggggatatgagggttgtgctggggcggtgtcagacatcaggggtggggagctgtggatttggggggtgtcctagggcgggggctgtggatttgggggggtcctgcagtgaaggctgtagaggtgggcgggggtcctggggtgggggctgtgggtttggagggcgggggtcccggggcagggctgcagggtggggccgggggtcctgtgcggggccttggatttgggggagggggccaggagctcccgcagtgggggcgcacggggctggggctctgaaggtgggggccggggggtcagcgggtagggtgggctcacggcgccttcctgcagatcttccacatgacctatgacctggccagcgcggtgatgaggatctgcaatctcatcagcatgatgctgctgctctgccactgggacggctgcctgcagttcctggtgcccatgctgcaggacttcccgcgcaactgctgggtgtccatcaatggcatggtggtgagcgccgcgggccctgacggagggggagacgcaggctcccatacagaggggggacccaggcccccttatcccgcttacagagggttgaacccaagcctttcagaggtggggacccaggcgcccccttatggaggggaggactcgggccctttcagaggtggggacccaggcgcccccttatggaggggaggactcgggccctttcagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggcggggacccaggccgccttacagagggagagacacaggcccttcaggggtggggacaagacccccttacacgggaggactcaggcctctttacagagggggacccaggactgcagccccggcactggccccttaatgtccctgggggtctgaaacagccacttggaacctttcaggcctgggatcgtccgtggagagaagctgagtgtggttatgatgagtcctgtcacccagacatctgcttagcgcgttttccaatggatttcccttttaattaacccacattaattattattattttatttacttatttttttttgagactgagtttcactctgtcgtccgggctggagtgcagtggcacgatctcagcttaccacaaaccccacctcccagggttcaagggattctcttgcctcagcctcccgagtagctgggactacaggcgcccgccaccacgcctggataattttcgtacttttagtagagacagggtctcgccatgttggtcaggctggtctcgaactcctgacctcaggtgatccgcctgcctcggcctcccaaagtgttgggattacaggcgtgagccaccgcgcccggcctggttggatcccttgagcccagaagttgaggctgcagtgagccatgattgcaccactgcactccagcctgggtcacagagcaagacctgatctctaacaactaaagaaaaatttacaacatggccctgaaatgggaaagtggtatcaccatgccaaagaaataataaatgggccaggcatggctgctcatgcctgtaatcccagcactttgggaggctgaggcaggcggatcacctgaggtcaggagtttgagaccagcctgaccaacatgctgaaaccctgtctctactaaaaataaaaaattagccaggcgtggtggcgcgcacctgtaattccagctactgtagaggctgaggcaggagaatcgcttgaacccgggagcagaggttgcagcgagctgagatcacaccattgcactccagcctgggcaacagagccagactttgtctcaaagaaataaataaaaataagtaaaagcaaaaggaagaggccgggcgcggtggctcacgcctgtaatcccagcactttgggaagccgaggcgggctgatcacctgaggtcaggagtttgagaccagcctgaccaacatggagaaaccccgtctctactaaaaatacaaaactagtttggcgtggtggcgcatgcctgtaatcccagctacttgagaggccaaggcaggagaatcgcttgaacccgggagcggaggttgccgtgagccaagatcgtgccactgcactccagcctgggcgacaagagcgaaactccgtcaaaaaagaaggaataataaatgaagttaggtcccagatactccttgcttcctagctgagatgtgctgactgttaagaagggttagttatgggagccctcggccgctacagtcaggttagtggccagtgagcctttgtccctgcctggggagtgctgtgccccagcgtccagccacatatgggacttgggatgtgtttggtttggacacagagcaggtgggcattgatggggtcaggagctacagagggaagacccgccagtgcccctccccagagcctggcacagctgcccaggctgaggcagcccattgtctggctgccacccgcacatgcggtcccatttcctgaacagagccccgcggctcccctttcccggccgggtcagctgaggacttggtgcggcaggacctcctgggccggcctggtgtctctgcccgccctgcccctctgctctggcccagatgctccctggaacttttgccccctcttgacctcacagatgctctgatctcagaggctgcaaaaggcgggacccagactctcgcccttggggtctcagtttccccaggagtgaagcgggcaggtagaatcagccctggccctcctgccaactcactgtgacaagtgtgcaaaccatgtcatctacctgggtctccatttctcttggttacctctgaacatggggagctcaccacctccagtgcttggcagagggtgggcgctgggcccttgaggaccgagggctcctggggcgtgagcacctgcccaccaccgcccctcctgctggccttgcagaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaaggtctgagggaggcgggccccggcctgggttctgatgggggaggcgggcctggatctggggtctgagagagagtcaggccaggccctggggtctgatggagggaggcaggcccggtcctggggtctgaggctggagggaggccttgccctggggtctgagggcggaggtagtccttgtcccggggtctgaggggaggggcgggcccggccccggggtctgaggggagaggcagtctcagcccttcactcagcttcaagtggcgcgctcagggcagagaccgcgtgatggggagcaggggaccctgggggtctgtggctgtgattaggaggagaaacggccggtggtgagaggttctctgaccctgtgacagggagggaggtccagagcctggagatggacgtggggcgggggctggggaggggatgcaggctgggcaggaaggggtgagttgggatcagggcaggacagggtcagtctttggacatcgggaagcccccgggctgaaggggcattgccaggaggctgggcccacctgggggtctctaggccggctcaggatggggctgggttagggaagggcctggcggggtctgagaggcctggggttgcttcaggacacgccggtggccggcagtcagggccaggcttcagggagagcaaggctgccccactgctcagatgcggcctctggcctgcagcgtccattgggttaatcctaggcttggcagtggaggggacacgggggagctgggaggggtggagggagattaggattggccccattggcagcccctggagttgggcctcatgcaccactctgtgcctcagtttccccatgttaggcggctggctggtcctggctgggagccaagtgcccccctctcccgcgccccgagcagtggctggctgggtcagctgggccccgtgccaggcgccctgctgtccggaagccacgggcctcacacccaaacataagctggtgccaccacccgcccgccgtcacgggttccgctgagctcagggcagctgcggccgggcggggctggggcggaagtgaggctggagctgccggggggcaccgtcctggggacagcagggcctggcacccccgcccagcacccacgctcccttccctgctcaggaggggctgacccgatggtttctggaaagatcatcagggaagggccagagcccccgggaagggggtcctgtgtgtcagggtacctggggcctctcctcgtagagtcaggtgcccacccattcctcagggatagggttgctagataaagttcagggcacccggcctggtgcagtggctcctgcctgtaatcccggcactctgggaggccgagacaggccgatcgcctgaggtcaggagtttaagaccagcctgagcaacacggcgagacctcatcgctacaaaaaattaaaaaattagcagggcagggtggtgcacacctgtaatccccactactcaggaggccgaggtgggaggatcccttgagcccaggagttcaagaccagcctgtgcaatatggcgagacctcatctccacaaaaaataaaagaatcagccaggcgtggtggcgcacacctgcagtcccctgctactcaggaggctgaggtgggaggattgcttgagcccataggcggaggctgcagtgagctgtgattgcaccactgcactccagcgtgggccacagagcgagacagtgtctcagaaaaaaaaaatggaatttatcattgaaacgaattcaactttgatttaaatagaagcatgtttatttgctcttgttgaatctggccgcccctgtgtgtggcggaggcctgtctccccgctgtgggcgggggctttgtctgacccagccctgaccccccacagtacaagcaggtgtgaaggcctatctccccgccacaggccggggggctgtctgacccacaagcaggtgcccgtgtgcccgctgcaggctgggggcggtgtctgacccagcctcgcctccccacagtacaagcaggtgcccctgtgcccgctgcaggccgggggcggtgtctgacccagcctcgcctcctccccacagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggtgaggcgggcgccgggcgggcgggaggcagcctccggtacagggccggcctccctctcctggagcccaggagccggtccctgagggaggcgaggtgcctaggctgcagcaggagggactcgagctagacctgcgtacacaccctcccctccccgccccgtgagcctctgcacccccaggacccccgccacccccgccttgcttcccgctgcccccttagcagaactgcctgggtctgtgcctgacagggcggggcagaagcagggcagggggtggggagggaggagccgcagaggccccgctgagcaccaggtcctgggggcactgaggctgattggagcgggtttaactcccagctctgttccggtagcctgagtgaccctgggcaagtttcccagggttgcgggaacaaatacccacaggctgagtggcttgaacagcggagattcggcctcccaccgtcctggaggccggaagcccaacatcaaggcgtgggccgggccgtgctacccccccggagcccctggggaggatccttcctgcctcttccggcgtctggggctccaggcgccctcggcttgcagattgatctccctgatctctgcctccatctgctcacagccttctcccctgtgtgtctctgtctcttcttgtaaattcatccgtcgttggatcagggcccacccggttcctcgtggcctcgccttaactgggccatgtctgcagagaccctatttccacataaggtcctattcacaggaaccgggggtcaggatgtcagcctgtctttctgggagatgtagttcaacccacaacacacatcaaacagttattgagcgccgactgcgtgccctgccgtgtgcttgaaggtcccaccctcaggaagcggggcctagggatggcggccgtgatcacgcaggcagcagagagcagctctgggaagcggggagggacgaggacggggaggcgacatcagcaaggccgtgtgtgagccaggcagggtgtccccggtgtagcacctggctcgggcagaggccccgaggaggggctggaggagctgggcgaggaggcgggcaggacgggcctgacactagggacctcgggccccgggaatgcctctgggggggcgtgtacacccgttgctcccaggaggcacacactgcggttcgcttcgccaagaatgtttaattgcatttgatgactacggtttccattcattcatttgtagagatataacactcagaccacaaaatgcataaaatgcggtggcttttagtattaacagagtgctgcacccgataccacagcctcactccagaacattctcatgggcccaaaaggagacctggggtgttagtcaccagctcactccccgtccccagcccctggcaacccacgctacttagtcattatttaggtgtttaggagttgcaaagtcaaatctttaaacccacatatggccaggcgtggtggctcacgcctgtaatcccagcactttcagaggccgaggcgggcagatcacctgaggtcaggagttcgagaccagcctggccaacatggtgaagccccgtctccactaaaaatacaaaattagccgggcgtggtggtgggcgcctgtaatcccagctactctggaggctgagacaggagaatcgcttgaacccaagaggcggcggttgcagtgagccgagattgtgccactgcactccagcctggacaacagagcgagactccgtctcaaaaaaaaaaaaagtaccaaaaagtgccccaggtcataagggcacagctcgatagctggtccctaaagggaacgtggtgtaaccaccacacagaacgaagctggaacgttcctgccgtccttagaagctgcctttgctaaggggaattgccctgacttcccacaccattgattcatctccagacccttggttttcatgttgatttttcaaaaatcacctgatagtctgaccgaatgtagctttccactggtgtgtgtgtgtgtgtgtgtgtgtgtgagagagagagagagatggagtctcgctctgtcacccgggctccagtgcagttgtgtgatcttggttcactgtaacctcctcctcccgggttcaagagactcgtgcctcagcctcccgagtagctgggattacaggcacccgccaccacacccagctaattttttgtatttttagtagagatggggtttcaccatgttggccaggctggtctcgaactcctgacatcaggcgatccacccaccttggcctcccagagtgctgggattacaggtgtgagccaccacgcccggccttatttttcccccattttctttttttttttttttgagtcagggtcttgttctgcgctcaggctggagggcagtggtgtggggatcacggctcactgcagcctcgacttcctgcaccaccacgcctggctgttttttttttttccggtagagacgggggtcttaccgtgttgcccaggctggtctagaactcctgggctcaagcgatcctcccgcctcggcctccgcaaatgctgagatcacacgcgtgagcccccgcacccggcctcctttccaccgctcttgtctacagccgcccctcctggtccgattgtattggcagatgtcgccaatacggtgtcaaacggcgaaggggcactgagcgttttttctttctcccgtccttggcggcagcagctcggttccggctacggggctgagcccgtctctcagacgaggaaactggggtccgagaggtgagccggtcccagaggcagggcgagggggaagcgggagtggggtccgcagcggacccagccctgcctcccccctgcaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcgggggtgagcttgaggggggcgcgcctggagggggagggggcacgcgacccccgcggtgtgcagagccagggggccggggccggggccggggccggggatggggatggggatggggatggggccggggatggggatggggatggggatggggccggggatggggatggggatggggccggggatggggatggggccggggatggggccggggatggggccggggatggggccggggccggcaccagggagagcctgggtgggaagcgcccacgctggccaaggtgcagaggccgggccgtgtgcctgggcggggagggccgcggcgcccgcctcgtccagcaacccccccctgcgcgccacgtgcagagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggtgagcgggccgggggcgtggccggggcgggtgccctggcgggggaggggcgtggccaaggcatcaggagagtggcttggacagtggcagggggaagggcgtggctgtggcatcaggggcacggttggggcagagacgtggccaaggcatcaggagtgtggccatggcagcaggggcgtggctggggcaggggcagcggctggccgctcctaggacccctttgggtctagaggctgattttctgacctattgtcctacttcagccagaggcagcctgtttcccaagggagggaatgcacagggtgtttgcggttgtgccgaatgctcggtgagcacctgctgtgtgctgggggtgcaggggacagacccgggggcccactcagactcccagggaggcttatggactggtgatgaaatcacacacgactgggctgtgtgccagcagggcaggtggggccggtgggcttccctgagttgggaatgcagagtggagaccagggtaagggatgccatgtggaaacggggaggaagatgtgttcgtggagtggacacagcacatcccaaggccctgaggtggaaaagaggcctagagtccagagagccagggaggcctggaggaggttggggaagaaggggaggccagacacacagggcccagtgggcggcagggagagtttagactaaatcaggagcatcagggagccatggagggttctaggtgggcggaggacctggtcagattgtatccgccaaggcgggccgtgtccaggagggagacggtgacctggcctctcaggggggcagtctctggggcagggaggggcagagccctgatgactggatgtaggcgccagagagatggcggctcatgctgctgttcgtgggaatgggaatgaagaccatggctgaaacgcaggacaggtgcgacggagtggtgtcagggagctccctggtgtacagtaggaagctctccacaacttgctctatacagtgagtatgcaacccgttcctgagtatcaggtgcttaggttataacttctgtatacagcaggtgctcagcacaggctgtgtacaggcaggtgttttcggtatgcctgtggcacactggaggcagtcattacataatcagcgtatacaggtggtacacatgcatacttggtgcacagtgatacctgctccatgtacacagcaggcattaaatacctgtttactgccaggcgcggtggctcacgcctgtagtcccagcactttcggaggccaaggtgggtggatcacgaggtcaggagattgagaccatcctggctaacatggtgaaaccccgtctctactaaaaaaaaaatacaaaaaattagccgggtgtggtggcgggcgcctgtagtcccagctactcgggaggatgaggcaggagaatggtgtgaacccgggaggtggaccttgcagtgggccgagatcgcgccactgcactccagcccgggcgacagagcaagactccgtctcagaaacaaagcaaaacaaaagccctgctttctgtatgcaggtgcttcatgcatgctggctgtgcatagcaggtgctcagcctgtatatggcaggtactcaatatccatactataggccagagatgctacatatgtgcttattgtatacagtaggtggtaaatgcatgcttgctctacacggcaagcactgtgtgcgcacccgcggtgcagagtaggtgctcggtgcccgctgtacgcagcaggcgctccctgtgcacacgctaacgccccctctcccgcaggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgtccccggccgtccccccttatcgccctgcgcccactcccatcgcccctgcccccggcggcggcctcgcgtgcgagggggctcccttcacctcagtgcctcagttcccctagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaagcctggccgcgtgtgattgcccgagacccgcagggcgtgcacccttcctgaagacagtggctcctgggggtggcaaaagagctttatttacacactgacaaggctcacggggtgtcagctgaagaagtaggtggaacgcttcacctgctccaggtcgaaggcccctgcggaggaagcagagcggacggcgtgggtggcgggaaagccccgccctggcccgcagttcgagccacccttgcgaggctgcccacccgcctacctggcttgggcaccgcctgcagtgtctccttcagctggctggcctccaagatcttctggggcctggggttggaagcagggtggggtgaggctgaggccaggttttggggtggggggggaatccaggtagttggggtcagggagcgccttactcagagcagaaccgcttgaccaggaatctggacaggtcctgcaggatgggctcgctgtgcaagcggacaaactgctcccggcacacctgggcaggagtcagaggatccccaggggtgatcaggcaggctctgggcaccacccctacccaacgccccagtgtgggggccccacccatgggtggactgaggctcagactacgggggcacctggttcatgacggagacatcagctgcgtgagtccagtaacagtcgtgcacagagacgaaggtcaggcccttcctgtggcagagcggaggactcctgaagggaggggagctcacagggccacccagtgaccagcatcctggccctgcgctcagccccctccacttgaggtccagggaagcccaccctcctgcaggcctcgccccacccctcgccccgcccctccccaaacatcctgggttaggtatcagtacagggggaggaaatgttcccagaagcctcctcgccccacccctgccgccccccacgctgctgtgggagcctcagctccgagggcggctacgaggtcccctcctgccagggccaccaccccgcatcctgagcattcccagctcccgtggccggtagattctgctggaacgacctccacgtgctccagatctaaccacacatcgcggtgccaagaaatgcccagcaggaaggggcagcgcccatgctcggctctccctgtcgggccacaggaggggagctgccaggaccacctacattcggggcacacagcctcagggcctctacacaggccccacagacacagcagatccactctgcccagtccctgcccccagctagacccagccttgccagctgtgccctgctagccagaagacgcccctgggaggcgagcggcacccacgccgtccggagacgcccacctgtagcagtgcagggcggtgagcatcatgtgggaggagtccagcgagtggatgaagttgggcgggaagccgttcttctgcttacgtgtgttgggctttctgaggacggaacaggtgccggtgggggcggcccagggacacccctaactggccgctgtctccaccgtggctgctctccagacccccggccaggccccagcccgggccccccactcaccggctgatgtctccgttgtgggtgtaggtgatgctctgaattccacctcctatttgctaaaaaggggaaggggccggtgagtcccacccgaggcccagcacggtggtggtacattgaggtggtggtacactggggtagtggcacgctaggatggtggcacactggcgcgggatggggtggcacactggggcggtggtacactggggtggtggtacgctggggcactggtacactgggacgctgttacactgggatggtggcacactggggagggatggggtggtacactgaccttgaccttggagtccaggcgatagggctggatgacggggacgcccaggggtgtgacccactccaccacagagcccatgtgggagatgaggcgggcactctcggtcagccagtgctgtgggacacaggccgtctcagggcagggg

SEQ ID NO: 13135 - DNA, 7731 bp, Human
aatcttctggaactagacagtcgtggtggttgcacaactctacgaggtactaaaatcactgaactggctgggtgcagtggctcatgcctgtaatcccagcactttgggaggcagaagcaggtagatcacgaggtcaggagtttgagaccagcctggccaacatggtaaaactctgtctctactaaaaatacaaaaattagctgggtgtggtggcaggtgcctgtaatcccagctactcaggaggctgaggcaggagaatcgcttgaaccagggaggcagagtttgcagtgagccgagatcgcaccactgcactccagtctgggtgacagagccagactccgtctcaaagaaataataataaaataaaatcactgaactgtacagtgtaagtgggtgaattgtgtggtatatgagtgatgtttccgaggtgtcattaaagaaactcagacgcctggggtggggccagtctcaccgctgtgggtcccatccccatcatttctcacaaggccctcagatcacccttccgcggtggggggcggacactctaagaagggaagacctgggctcctgctggcgagaaggcggtggacatttcttcagtgtctggtgccgcgccctctgcccagcgtgctccgtggagggtctcattgtcttcctccagacgtctctttactggcccattttacagaggcggaaccgaagcttggggtgttggccacagggctctagtgtgggaagccaggccaggctggacctcagccatggggacccctgtccctgagactgtggcacctgccacaccctctgtgtgacccgcctaagccaggaagagagggtcaggagatgcctgagccaccaagaaggcatcccagcgtccagccagaccggttatccctccagagggctccccggcaggacaggctggtcgccatgtcttcagcctggtgctatttaaaggtgggtgccacctggggctgtggccgcagggccaggactgggctgctgggagctgtgtccccacagcggaggtcgccgcccctctcaggcctcggtttccccagttgtcaatgcctccacttggctgtgagtctgtgagggtcactgtgctcaccttttggggcccagcgcatggggcaggcagaggaagggtgggggccagccgccttgctgggtggttccccgtggggcctggggtatggctctaagggaggagcaagtgtgggtgcgaatggggccgccccattcctgccgcctccgacgtgccccgccagccggccaccgacaggtctacgtggctatcctccctcctgcccacctacctgcccaaacacacgtccccagtcgtcacctgcccacccacccgcgcattcccacacccttgtgggcctggctttcgggaaactacaatttgcggggagagaagtcccacgagggcatgccccggagcctggctggtcccacggctgacgcacgcggcaggacctcccgtgtccatctctgtccccaagcatctccgcctctgcccctctctgtctctgtgtctctctcgtctctcccggtcatcttccttgtgtctcttgactgccgccgtctttctgtctctgtctccctccgggtctctgtctccctccaggtctctgcggcccgcgtctcacactcccgcccccgcaacccgaggtcctagcccgcccggggactcggctgactcacggacacgccccgcgagacaaacaacaaacgcgcggaggccgagcgcggagtcccgcacggccgcgcccctgtgcacctggcccccgcccccgagacgtcccattggccggcgccctagcctggtcccgcccaagtggaccccgcccccgccccgaggcaccccattggccggcgtccccgccccagcgaacccggccccgcccccgaggcgccccattggccccgccgcgcgaaggcagagccgcggacgcccgggagcgacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagtgagtgcggggcggcgggggcctggggtggggaggcggcgggtgacggcaacgcggccgccgtcttcacggtgacctgcgcccgcgggggagtcccggaggctcctctgtgcagcctcggcctcagtttccgtggtctgtgagatgggtgcagcctgcctggtgggagggttgcactgttaaagcgaaggctgcagcggcggacccggctcaggggcagagaagcgtccgtgtggtacaaccctgtgggtggggccacccatctgcaggtgggaaactgaggctccagaggggctggggcaggcccagctgcatggcggaagcggcggggggctgacctccggactcctgacatcacagaatccagtcagggctgcctgagtcggggccccctctgcttcttcccagacaccccatctggcaggtgaggacaaggaggcacacagaagggatgggacctgcccagggtcacactgacaggggtggcggagctgggtccccacagggcccaggacgtcacggagcgggcgtctctgtccccagggtctgccgagcacactgaggtaggccctcagtgtttgtggaatgtcaggagcaagaggagaggctgggcacagcaggggatgtgggtacctggaggccaggggagtcggtgtccccgccgggcggggggcactgggaagggggcccgggcccgctggctgccgcctgaatcaccaccattagggcaggtaatcaccccctgtccttcccaccgctttcatctgggcgccaaggccctcattaggccgcacgtgacgagggcggacaggggactggctgggccggtccatccatggcgggcatggccaggcggggtggcctcgggccggggcagaggcctggctccgctgcctgacctggaacagtctctgcctctctccaagcctcggtttccccagctggacggtgatgggggtgagggctagctgagggctctcctgcccttcgtgcattcgctggtcactaatcgggcaccttgtgggtgctgtgctccgcatgggggacccagtggtgacagagacgcccaccctcctggggctcccagagcagaggcgcgcagcagttagacacgtgaacaagggcgcaggtgggtgcacagaacagtgaacggttggccgggtgcagtggctcacgtcggtaatcccagcactttgggaggccgaggcgggcagatcacgaggtcaggagatcgagaccatcctggctaacacggtgaaaccccgtctctaccaaaaatacaaaaattagccgggtgtggtggcgggcgcctgtagtcccagctactcgggaggctgaggcaggagaatgacgtgaagccgggaggtggagcttgcagtgagctgagatcgcgccactgccctccaccctgggcgacagagcgagactccgtctcaaaaaaaaaaaaaaaaaagaacagtgaatgacgtgaacaagggtgcaggtgggtgtgcagaacagtgaacggcggtgttgggaggcaccttgccaggggaggggaggcgcagggcgaggaaggggccaggggagatcgtgacacagacgccccagaacaaccacctcaaagacgttcctgtgtgtcctggaaggtcgggctgggaagctgccccgaggagctttcactttgacagggagctggccgggcacgcagggaactgtacacccagctgacaaagcggcagacacccaggccggggtgagcgagtgtgggtgaggagtggcggctggccccagggtccttgctggacaagacacttcagctcagggtggggcagggctcacccagggctacccacagacgatggcgtccaaatctggctctgccactcccaggcctcaactggcccctctgcaacgtgggctgctgagcgggcttggtaggacagctggcatacagtcggcgctcaagcatgtctgtggtgtcccataaaccaccggtgtcccactctaggccactgccagcccggcctccagtccagagtcccagtccggagtcccagtgactgtgcgtgggccgggcagctgagctgtgagggccgggctgggggctccatatggggtggtgtgagctgtgagggccgggctgggggctccatatggggtggtgtgagctgtgagggccgggctgggggctccatatggggtggtgtgagctgtgagggccgggctgggggctccatatggggtggtgtgagctgtgagggccgggctggggggtccctggggtggtgtgagctgtgagggccgggctggggggtctctggggtggtgtgagctgtgagggccgggctgggggctccatatggggtggtgtgagctgtgagggccgggctgggggctccatatggggtggtgtgagctgtgagggccgggctggggggtccctggggtggtgtgagctgtgagggccgggctgggggctccctggggtggtgtgagctctgagggccgggctggggggtctctggggtggtgtgagctgtgagggccgggctgggggctccatatggggtggtgtgagctctgagggccgggctgggggctccctggggtgctgctggtcgctggctcattgacagttatcagtggtctgggtgggccctgccccttctgactcccacatcccaggaaccctttcccaaccttcctcgtggtgttgctgcccccctgacgtccgtccctctgggtgtgtgggagcccccccgccatacacacacacagatgctgctcttgggctgagctgcagggacagcgctgacctggccctcccacgggctcctcatcgatctctgcactcccccagctcgtgggggccgtcctgcttcccgttccctctgcctgctccttgctcctccctcacatgctggggggggctcctggtgtcagtcacggctctgggggatcctgagtgtccgtcgtggtcgggaggggactcgtggtctggggcagggggggctcctcgtgtctgtcgtggtcatgaggggactcgtggtcccgggggtctcctggtatctgtcgtggtcctgagggccctgcacgaagcacagcggacagcagcggtgctgggggtgagccagcaaggccctccccgacccccgcctcccccaggcatcctggagatccgctctgtacacgtgggcgtcgtggtcatcaaagcagtgtcctcaggcttctacgtggccatgaaccgccggggccgcctctacgggtcggtgagtgccgggcagggctgggcggcgcgggcagggtggggagggtgggccggcctcacccccgcccgcagcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctgaggccctgagaggccggcggctccccaaggtgcctgggctggtggcgaggggcccggccacgcttgttcttccccctgcgggctctgtaagcgctgagtgcccaccgtgtgcgggcgctgtggacacagcccaggagccctccaggggggtcccagcctgagggggtggtggccaccaagcaggttcaatcctgagttggggacctcgaggacccaacagggcgcctctcgggctgaaggacgcagacgtcgaaaggtcgagggggacgtcccaggcagggcccggcagaggcaggggctcggggtggggagcacgttgggagtgggggcaggagcggaggggaggggagggggccggggagacggtgacagacgccgcagaacaccagcctcgaagccggtcccgtcccgggaatctgcaaatacaacgccttgcgaggacaaaggcacctgcaggtgggacggagatggaggagcatccagggtggggggtccagggccccagtgtcctcacagggtcctcacgacaggaggcgggacggtgagagccagagagagatggggatgggccgcgctgtggccgtgaaggggaggaagggccctaagctgagggacgtgggtgcctccagatgctggggaaggcgggaacggttccgcactggagcccccgggagggaccggcctgctcctgccttgatatgagcccagtgggacccagtttggactctggcctccagaaccgccagaaaataaacgtagtaagccatcaactttgtggtcttttgttacagcagacgtcggaaatatgcacacggtgtctgaaactgttctcatgacaaaataagcctcagatacccccgggaagggcggaggccgacgcctcggtgctcctcggatcccccgggaagggcagaggccgacgcctcggtgttcctcggatcccccgggaagggcagaggccgacgcctcggtgctcctcagatcccccgggaagggcagaggctgagggcaggagccgtgctgggtgcagggcaggcctgggggcttcatgccgctgtcctgcgggacgcagagagggctggccgtcggtgtgggggcgcccccgcctgtgcccagcgccctcctgacatcctgactccgctgggacttctgcctacagccctgggagtcaaactccagcctctcagagaaaaggtcagagccaagagccccacagcctggagccaggcagtgacaccctgggcccgtctccccttctgtgcgtggggcgacagcagcatcgccctggtgaagtccccggggacggccagggctccatccccagccgccgccttccacataaatacaggaagactgggccgaggcacttgctgggaggtgctgagcagcctgacaccgaaaacccttctgggaagggagggtcgtgcccggcccgagagcttctgctcaccctgcagacagaagcgagccccaccccaggggacaccaggcggcctctggggacatctttggctggcatggagtgggtggaggacagggctgcacccaggatgtccccaggttggcagtgtgaggggagatcggcccacgttggccagtcggagggcgtcgccacttgagttgtcactgggagctgcacaggtcaccacagctgaaataaaacttgctggcaccccacgcaggaacgtaacatgtgcctcgaagaaacgggtcagcaggccgggcgcgggggctcacgcctgtcatcccagcactttgggaggccgaggcgggtggatcacgaggtcaggagatcaaggccatcttggtcaacatggtgaaaccccgtgtctactaaaaatacaaaaaattagccgggcgtggtggcgggcgcctgtaattccagctacttgagaggctgaggcggggaatcgcttgaatccgggaggcggaggttgcagtgagctgagatcgcgccactgcactccagcctgggcgacacagcgagactccgtctcaaaa

SEQ ID NO: 13136 - DNA, 10465 bp, Human
  misc_feature (1)...(10465): n = A,T,C or G
ggccgactcttttccctgctttggtttgtttgaaatctaaataaaactactttatgagaggccagagaagctgtgcttgggagggagaggcagcctccacgtccatgagtgactgcacacggaccagtcccactgggtaccctggctacgccaggtgtggatctgggaggcctgtcctgggaggcacggggagcagccgggtcccgcggcctgtacgttcccatgacttgggtcagacaggcctgggcagcatcccccagcctgcgggacaggggcggccagaaagcccccagagttcctcctccctgtgaccaggtgcatctagtgggacgggagctgcctctgcaggcatccagcaaagcttcgtcgcgggtccacagccgcctgggcgttgatctcagcgtctcagggctcccaggaccacagatgcccccgatcagcactccggcggctccagctccgtccaggcacaccctcggggtggggagccgtggccctgggcacacagggcaggcacctcacgtcctggtgtcaggaagtccccagcatcgttttattacatgtcatggaggaaagctcggagctcccatgccctcccggggcaccgccttccaggaacctgcctgcgttccgcttctgggcacccggaaagtcgctcagtggctgattcagggtcgaggagctgtgaggatgaggtttcccaccaagttgggacagaaaatggggccctggggtctcagcaaaccatggccctcgggaccaaacctggcgtccgcccctattgtgagtgaagtgttactggcacagccacacccaggtctcaggatcatccatagctgcttggtttggtttggttttgtttttgagacacagtcttgtgttgcccaggctggagtgcagtggtgcgatctcgcctcctgggttcaagtgattctcctgcctcagcctcctgagtagctgggactacaggctcccaccaccatgcccagctgatttttgtatttttagtagagatggggtttcaccatgttggccaggatggtctcgaactcccaacctcaggtgatcgcccgcctcggcctcccaaagtgctgggattacaggcgtgagccgccgcgcccggcctaaatttatttatttttgagacagggtcttgctctgtcacccaggctgaagagcagtggtgcaattacggctcactgcagccccaacctgggctcaagcgatcctcctgccccagtctctcaaagtgctgggattacaggtgtgagccaccgccttcggccagtgtctttattcatgaagaccaaaaactagaacagcgcaaatatccgtccgctggtgaatgcataaacacagcgtggtccagccacacaatgggatgtgacacagccacaaaaaggagcgaggctctgacacaggccacagcctggatgcaccttgaggacgtcatgctgggagagacgccaacgcaacaggtcctgtgtgattccactcctgggaggtccctagagaccaattcagaggcaggaagtagtggccgggcgcggtggctcatgcctgtaatcccagcactgggaggccgaggtgggtggatcacctgaggtcgggagtttgagaccagcctggtcaacatggtgaaacctcgtctctactaagaatacgaaaattagccgggcgtggtggtgggcacctgtagtcccactactcgggaggctgaggccggagtatggcgtgaacccgggaggcggagcttgcagtgagccgagatcgcaccaccgcactccagcctgggcgacagagcgagactccatctctgaaaaaaaaaaaaaaaaaaaagtgttactttgtcaggtgtgatgatggtagtgtggcttcatctcgagtcctctttgagaaacactttctaaaatgctcaaggatggagggtggagggtgtgcagcggtgggcggggctgtgaccgtcacctcacctcccccacaggaagcgcgtgtggggaggctcggggccggggccagcacccacactgggtctccacagcggcatggaggcctgcgtgtcttcactgctggtgctggccctgggggccctgtcagtaggtgagtgggagccgggatgcaggggggacactgaggcccagcgctctcggtgggtccctggatgggaggggtgggcgcgggcgccgacatcctgggtgtaagagcggagattcatccttgtttggagggggactgaggcctggggcatcccgagctcctcacgcttcaccccgagtggacatcccgggaccgtgggagagtgtggtgtccaccggctcacctcgcccatcctcccggcagcagccagaaggcaggggtcacgctcacacccgaggtgcagagtaggagactgagacttggcgaaggagatgctgacctaggactgcccagctgggagggcagagctgggactcgatccccgctggctgcctgccaccaccaagggcttggctgggactaggtgcccagcagtgagggagaagggaggtgggtggcggctcccctgcattccagctggactgagtgacaggggctcttgatgagttggggacccaagaagatggacagaggtaggaatccagccgtcagtcatcatcatccttcctcccatttttatttccttccacccatgggtccatcatccctccctccctccctccctccctccctcatctccccttccttccctctacccgtccgtccacccatcattcctccttccattcttccacccacccatccatcatccatccctctacccatgggtccatcatccatccctccctccctcctttcgttcccccttccttccctccgccagtccatccacccatcattcctccttcctcccattcttccacccacccgtccatccatcatccatccctcctttcaacctccctccttccctccacccgtcatccttccctccctccttccatgtatccacccatccatccatcatgcctctctcttcctttcccccctccttccctcctccctcccatccatccatcatccattcctccttccatccctccttcctttctcccgtgcttctgtgtatccatccgtatttgcagggctcgtgctgttctaggcctgccctcctgtctgactggaagagacaggccaggcatgagactgtgcagagcggaggaaacacggagggcaagagggcgggtggggggccgttgcaggagacgagcataaaccaagggaggaagccggtgggggaaaggtacgcaggcagctaagtgagacagacaaaggcccagggtgcaggcagcttgcaggcacagctagacttgcactcttgtcacccaggctggagtgcgatggtgccatctcggctcactgcagcctccgcctcctggtttcaagcgattctcctgcctcagcctcccgagtagctgggattacaggcgcctgccaccatgccgggctaattttgtatttttagtagagacagggtttccccgtgttggtcaggctggtctcaaactcccaacctcaggtgatccgcccgcctcggcctcccaaagcgctgggattacaggcgtgagccaccgcgcccggcctattttttttttttaagatggagttctgctattcttgcccaggctggagtgcaatggcacgatctcggctcaccacaacctctgcctcccgggttcaagcgattctcctgtctcagcctcccaagtagctgagattacagatgcccgccaccacgcccggctaattttttgtatttttagtagagacggggtttcaccgtgttagccaggatggtctcgatctcctgacctcgtgatccacctgcctcggcctcccaaagtgctgggattacaggcgtgagccaccgcacccggccttaatttttgtatttttagtacagacggggtttcaccacattggccaggctgatctccaactcctgacctcaggctatctgcccaccttgacctcccaaagtgctgggattataggcgtgagccactgcacccggcccgcaagcggggacttgattttcaaagcatgatggggattcagagaagattttgagctgatttacgttacattatgaaatcaatccttttatatttatgattgatttaaaataatttttgtacagctttattaggaaattatgcactatacaatttacttatttaaagactacatttcttgctgggcacagtggctcacgcctgtcatcccagcactttgggaggccaaggagggtggatcacctgaggttaggtgtttgaggccagcctggccaacacggcgaaaccctgtcgctactaaaaatacaaaaaaattagccggacgtggtgatgcgcttctgtaatcccagctactcgggaggctgaggcaggagaatcgcttgaacccaggaggcagaggttgcagtgagctgagatcacggcactgcattccaggctgggtaacagagtgagactccatctcaaaaaaaaaaaaaaaatggccaggtgcagtggctcatacctgtaatcccagcactttgggaggctgagatgggtggatcacaaggtcaggagttcgagaccagcctggctaacatggtgaaaccccatctgtactaaaaatacaaaaattatccaggcgtggtggcaggtgcctgtagtcccagctactcgggagactgagtcaggagaatggcatgaacccaggaggcggagcttgcagtgagccgagatcgtgccattgcactccagcctgggtgacagagcgagactctgtctcaaaaaaaaagaaaaaaaaagttttttttaagagactgggtcttgctgtgtcgcccaggctggtctcgaactcctggcttcaagtgatcctccctcctcagcctcccgaagtgctgggatcacaggggtgagccacccacatccggcctgatgtgcgttttgaaggactcctgtggctgtggggcccagtggggcctggggaggtcctggagaggggattgggaggtggcctggggggaacatgatgggggtgatgagagggggatgggagggatgaagggcagcccacacgtatcagcctaaaagtttcggggaacactggggacttcattaggatggcacatctgcttggggtcctgggcctctgagctgggcaaggacagtcgcggcaggcagcaggggcatgtagccccaacctggctctttgtcccccatcctggcaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggtgagtaccctgccctgcccaccccaggggtccggggaatccatccgacggcgctcattctctgcagggggtgggctctgggagatttaggcccattgtgggacccccgtcccctcccggtgacgacttaggcaggtttaagtgacctgcggctgtgggactcctggagaaggtttactccttgcaagaggcactggcagggccagctccttccacaccgcagcctgggtcagagcctggctcctttcacggctgagccacagtcctggtgtggacagagtgcattgtgtctgtccattcacctgctgatggacccaacttaggcgggggcttctgctataaggaaggagggtcaggtgggggtgtttgccacctgtggccaggaggtcgaagccggccttcgagagtggctcgggaatcgacctggttcccggggatcaggaagccgctaaatgacccatcatggagttgccctacctcaggactggtccgtcatacagagcccagatcaagatggtcaaagtaacaaaaagggacctgccggcttgtgtaactgcaaagtctaggaggaggcctggcttcaggtgcggcttgatccaggtgctcacaggaggtgctgtggagcccatctgtctcccagctctgctgcactaccaggaagcctgtctcacaaggtggaaagattgaccctcctcagtcccatggaaagagggcttggctctctaaagttggggcacacttaggaggattggcatgtgtcaacccctgtacaaatcactgtggttgagcctggggccccaagtgaagggaattcccagggctggttttcgtgaagctgtaggcttggggttggatttttggacacacagcccttgcctggggccagggccgggcagaagtctggggcaggggtgagagcagggagggcttcctggaggaggtgggttgcaaagacacagggaaggactggccaagccaaggcctgtgaggggcagcggctgtgagtgatggccatggacaacgggcacagtgggggccgggactgcatgtggcgggtcgtccacgccgggccaggccgcagcaccctgattccctctgtccccaggatggcccagctgaggctggtgctggggctccacaccctggacagccccggtctcaccttccacatcaaggcagccatccagcaccctcgctacaagcccgtccctgccctggagaacgacctcgcgctgcttcaggtgtgcagggacgggacagggagaactgggcaccctcctgtcccccacgggtgcccctcacccccactgcgccctccccccgctgccgaccctccccccgcactgctgcccctccccccgcactactgccccctcccccattgcccaccctccccccactgccacccctccccccgctgccgcccctcgcccnnnnnnnnnnnnnnnnnnnnctctccttgttcttctctgctgtgttctgtttttcttgcgttcttgtgttcttctccttgttgtccttttgtcgtttcgtctgtgttatctctttcctctgtcgctcttttccttctttttgtctttagtacaaaaagcacagacagttgcgtttctcgctccgttcctattcttccactaatcgtcatcttctcttctctctatctttgctttatccttgttttcatcgtaacaaaaaaaaaaaaaaagcaccaaaacacgcctccttgatctttattctcttctgcttcatcctcttttttcttcttcttctccttttttatttgctttctttgtggggtgggtggtgtgatcgtgttgattggctgttcgggtgtgttggtggtgtgctggctggaggtgtgaggttgtgtgcggggcggcggtatggtgctggtagcctcctccgcattgtggccgcgcccgcggcatctgctgccgcctccgccctttgcccaccctccccgcactgccacccctcccgccgctgcgcgccccccgcccccgcactctcaccccctccccctgctcacctgccccttcctgtcactcgtagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaaggtgaggggcgcccgggtggggctgggggaatgaggctggcgggagggccggggccagggcagccgccgggcaggttcctggctctcccgttctctggggagtcctgtcaggggctggggggcggggaagcactggcaggggtcccgtttctcaggtgcagaaactgaggctcagacaggtttagcaacctgcgcaagaccacacagccgggaagcggcagagctgtgacttctgctccagccaagacggtccggcgggggaagaaggagcagggttcacagggccagcgggagatggggaggggacgcgcgtgggccgggagcagcccctgtgtctccttgagcctggggataacaggcctggccctgctcccctcggcgggccctgctcccctcgtcccctcagcaggcgcagaggctgagctgcggtgtgtcgtccctgcagggtgactcgggcgggcccctggtgtgtggcaaaggccgggtgttggccggagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctcagagcccgcctgagtcccagcccacctctgtccatgctggctgtggggcttccgacaaacctgtttccctcagcctcccgagtaactgggtctacaggcgcccgccaccacgccaggctaacttttggtatttttagtagagaaggggtttctccatgtttgtcaggctggtctccaactcttgaccttgtgatctgcccacctcggcctcccaaagtgctgggattacaggcgtgagccaccgcgcccggcccttccctgttttaaaaagggaggttgtggatcccaaggcttctcccaggagggggcggcgttggccaggactggagcggtggccgggtctgcaggctggcaggggtgggcggccgtcctccccgcgtggctcctggggctgggccttgaacagcatcccaggatcttcttttttagtaacagcttttatcaagttacaactcacatagcagatgagtctccctgtaaactgcgattcaggggcctttggtacctgcacagagctgggcaaccaccaccgtgacatgtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcctgtcccctgtcaccccagcaccccgaaaacagtcctgtcaccccagcaccccgaaaacagccctgtccccactgtcaccccagcaccccgaaaacaggcctgtccccactgtcaccccagcaccccgaaaacaggcccgtccccactgtcaccccagcaccccgaaaacaggcctgtcaccccagcaccccgaaaacaggcctgtccccctgtcaccccagcaccccgaaaacaggcctgtccccactgtcaccccagcaccccgaaaacagccctgtccccactgtcaccccagcaccccgaaaacaggcccgtccccactgtcatcccagcagcccgaaaacaggcctgtccccactgtcaccccagcagcccgaaaacaggccccatctctatcaccccagcaccccaaaaggaagccccacccccattgtcattccagcaccccgaaaatagactctgtccccactgtcaccccagcaccccaaaaggaggctcgtccccatcggccgtcactccccgtccccaccccagccccggtgccctcacatcccctccctgtctctggatgggcctgtgctgacatttcatggacaggggatcacgctgcgtggccttctgtgtctggcgtctcccgctgagcgtgacgtcctcaagctgcacccgcgcgctggctgggtccgagccgtgctcctgctccggggggtcgagctccagctcgaggggggcctcgctgcgtttgtgggtgcgtccctgggtgcacatctgggcggcttcgtctgcgtccgtccgtctgaagctttgctgggagccgcctgtgtgcgttttcgtgtggacctacctgctccttcctccctccagattagacccgtgggagtggcatctcgggctgttcagtgactctgtttcagcgccgcgctgttttcctgcagaatcttttaatttcactaccaactctttctttcttttcttttctttcttccctttcttccccttcttctctttccctcccttccccttcttctctttccctcccttccccttctctcccctcccctcccctcctctctctttctttctttcctttctttcctttcttccccgtctccccttcccctcccctcccctctcctcccctcccctctcctcccctcctctctttctttctttctttctttcttttcttttctttttttcttttattttcctttcttttcttctgatggagtctcagtgcgtcacccgggctggagtgcagtggcacgat

SEQ ID NO: 13137 - DNA, 17633 bp, Human
tacgaaatcttaaaggacagatcgataggggagagagaattttgttagaatctctctgagagcattgtaagggcagcctgattgcccttagtccttaaaggtaatatggaaggttttctctttgtcagacctattgccctgatcccagtagtaaccagtgtgttcatcttaatctctgagggtagctctgtggaagatccataaccttctgttagccaaatctacctagtacttacagatgcattagtgggcagccattggctggcaagtaaagagagaggaattggggagaaagagagatttgttgggcctcagtgagagaaatgacattctctcctgattttatgaggcgcagaatttttaaaataacatggtgttgattcagcttggtttgctaattaaaggaagatttaaacactggggttccagaggaaaagcgttcataatcctgagtcatgcctgtgggacccagcagaatggggtggaagtgcacaggactgggcatcatgagatctctgttctacttccagctttgttactaatttgctgtgtaatcttgggtggggcaagtctgagttttactgcccaatttataaaagagaatttgactagccttgtctgtaatatacatactggttctaaaaatttgatcctaagattctataaagtagccattgaggcttaccaaagttacaatattacagatggatcaggtagggggaagagggtggggtggaagagagggtctgtcctattgaattaatctatgcacaagaaaagaagggcagtcccttcttttcttttgagtgacttttaatcctttactttatgtgaaattgttggttccagaatatagattcgaagagaagtgtatggaattgggagtagtagtttttcctgaaaagcaaagtatttttaattgagtagctatttgaaggcatgaatcctttaaattttgatcatatccgtcaagaaccaatatccaagaacagaaagatgactaaattgtattctatggcaatgaaatgctgttttagtttaagaaagagatgaaaagttcagatttgccctttagaaaggtcactcttgctgtatatggtgtggaaaatggatcagaggcaggaaagactgaataaggagatccctgctaagatcctccatttaggaagtggtagtggtaatggagagattagatgggagaggagttgaggaagactcccaggtttctggtttgggcaactggaaggatggcgatgccatttactaataaaggaaacacaggaaaaagtggaacaataatgagagtagatggaaataaaaaattttaattaaaagaagtaattaaaagaaaaaaggagcaaagaagaaagtcaatcgtccagcagggggcgaaagagctaaataaacactttttttaaactaaaaaaagaaatatttatgaggaaacagagcaaagttttgaactctctgaggcttcggtttaggttctgagctttctcagtggtcaaataactttctattttattttattttattttatttatttatttagagacagtctcgctctattgcccaggctggagtgcaatggtgggatcttggctcactgcaatctccgcctcccgggttcaagccattctcctgcctcggccttccgaatagctgggattacaggcgcccgccaccatgcctggctaattgtgcatttttagtagagaaaggatttcaccatgttggccaggctgtctcaaactcctgacttcaggtgatccacccgcctcagcctccgaaagtgctgggattacaggcatgagccaccatgcccggccgaaataactttcaaatacttttttctttttcttttttctttttttcccctcagaaaagagtatttgactgtgttttatgtgttgctaggggagacggttgctatggagatggatgatatcataactccattgtgaaccagtaagaacactctcgtgagtctaacggtcttccggatgaaggctatttgaagtcgccataacctggtcagaagtgtgcctgtcggcggggaggtgaggagctacaagggtttttgcttagctttgtttttattcttgtaagcaggatgagactagaatcctttctttccaattatattggttcctaacttgattatttctgtttccatggtctgaggtggacacagttttcccagttcttggtagagaagcacacagagagctttccaaagtatttttaatcacgtttagtttgattatttgatgtaagataaagttaaaatgttatatttttccttcatagagaggcaatatcaaggttttaaatctcggagaaatggctttcgtttgcttggctatcggatgcttatatacctttctgataagcacaacatttggctgtacttcatcttcagacaccgagataaaaggtaaatggattttaatggaatagtttttaaattaggaaaagtaaaattaaatggattttaatggaaaattaactgtctttttgacctgccttatggaagtgcataactaactagtagatgaattgttattgaaactatttcaggaagttcatgaaaaaaagctatgttcttactagtcactttcttgtataaggtaactgatgttgacacacattttgtgcgataaatgccaaattaaaaacactctccatacctttttgtatagtcttttttaacagattaagtatctgaaacctcattgcctggtactaaactaactggaacagttccttaattactatccttagctactatccttagcttttatgacaattagatacattaaaaaggtacagaaatttaacgtaaaatttaaaaataattagaattatttaatttttcaattatattatattatttaatataatgttaatgttttattattaattaattaaaattatttatagtatattattatattatatattatattataattaatataattaaatacatatatttatattatagtgatatgttagttattatttgttattatttgttgttcttatttgttattgttattgttagacagatttttgtaataaaatgttcccatcttagaccaaattctggcgtacatgagcacagagataaagccacattgaattttttgcttctctaaaaattaatacctagtgaggcaaagtcacattttgcatatgtgatttctcaaagaaggaacaactatatagcagtaatctagatttttttaacagccttactgagatataatttacacaaaactaactctttatacaaaactatattctttaaaactatacatgtatagtaaaactctttactatacgttggtttttagtatattcacaaagttgtgcaacaatcaccactatcaaagtccagaatagttgcatcacccgtaaaacagcccctaaacccattaagcagtcaccctgcattgtttctccctccagcccctaccaaccacgaatctactttctctctctatgaatttgtctattttgaaatttcatagaaatggaactatgtcaatatgtggtcttttgtgtctggcttctttcagttagtataatgttctcaaggttcatccatgttgtagcatgaatcagtacttcatgtctttttatggctgaataatatttgattgtatgcatgtagcacattttgtttatctgttaatcaattggtgcacatttggaagccatctagatttagcaatatttgtcataaaatacagaaaaaataaaagtgttttattgatttatttcagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaaggtaagtaaagcatgcatttgccgtatcagagtgatcatcaggtgttactttgtgattcctgactttagtgtccgctccaattcccatatctcaatagttctaattaggatataaaaagcttccacacccgcttctgtctcctatgcatcctgctatatctgttttcaccccatccagtgttaagattgccattggaagaacaagaaaaaaaacaaaaacaaaaacaaaaaactcggtctcgtgcaatatgaacttgaagagcagcacttcactagaagagcatttcactgtattttacaattgcttatattcttggatgtgggccttatacatgctactgacctgtgaccttttctactgtaggagacaaggcttatttatctttgtacccttcccacagagggtcgcaggattatggttcgttgtatatattgtagtaagagctcaatgaaaatgttttgaattattaactacttatatactcaacaagcatgtatattcaaagatttctgttgtagatgacattctgttacctctctaattcagctaggtagtttcaagagacaattcaaattgagcatttattgatcaactttgtgctgggcactctactaggtatcaggaatatatgaataaataataaatgatttttgtcctccagaagctcatgatttgtctgtatttttctggttacttccagggttttagtttatgtatttcttgaaggtttcatattatattttgaaatgtggcatgatttgccaagtaatgtgcctatggtatatgaaaattatctatttgattccaagcagatatagctcaagtttctgccataaagttttttttcccttccaaaagtttttgtttttatttggaattagatgttaagattcaaatgatctcataaaatgatatgacatacagaggtgagctctgctggaaatgtatctgtggcattgtatcaaatagtctctaggattgtcttagatattgggaactctccagggtattaatgatttattagtcttattaatatagctcactataccatggaggtttctaagcttgactttgtctcatctttttgtcaaacagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggttaaaacaaagctctcttttcatatttaatactatcagaacaattcatttgggaataagtcccttaatcttatgtaccaggctgtaggcacaatagatcctgtgacagtgtggcacaaaatagaatctttcttgtagttggtgattagccttttaaaattctttaaatcagcaaatacctttggcaaaacctgtatattattttattgatttagttcccagttttggggtcatattagtaaacattcatgagtatttgctcatctgctcagagcatcctagaataatcaatttactacttttgcatatgcttatactaatatgagtaaatgagccctcaaatgttttttggttttgcatgtccctcttatcgtgaagtgattcccagtaacttccttttgaaataatcctgttatgttgattgcaaaataaaatggagaggtcataggaaatgaagtaaaattgagaaatgatttcacaaatgattcatcaccaagcctttcaaacattcacagttgatttgttccttaggaattccagaaactaaagttcaggatatggattgcgtatattacaattggcaatatttactctgttcttggaaacctggcataggtgtacttcttgataccaattacaacttgttttactggtaagtatttttataattagaattccatattaaaaaatgtctactcaagttagtcgatagtatgagtaaactatattttcactaagttaaattcattatacttgtcagagttgtatttatgatgataattgtttacaattatttgaggttttcaatgggtgtaagtggttttaggatgtagatactggaaggtattctatgggtgatataaggaatgcaataattgtttctgtactgggttaattttgtatcctttagatagatgaatttagaacttaaacaattttgacatattttatattcttgtttttttaaaaaatcagttatctattaaactgaatttttttctgactccctcctttgttaactgtcactgaagcttttaaacttggacattgtgactcgtgtatcttcttaatttcttaattgttttagggtaacatgatcaccatgttctgatgctcctttgcaaggttgcacatctgttaagtacctaccatctctactgtaagagctctactttaggcttccctcattccacacctggatgattgccattgcttccaaaatgacggtcgctctgctcccaatctctccccttccaatctctcccctttttattcattctgcacactgtagccagctttatcttcctatattgccattttcatataccactctcttgttcaaaaacctcctgtgtctactcattgccccaggataaaatctaggctgccatactgtctactattaccaatgtgaatgctccactcaatttagatccatctctacatttttttctcacccgtgttattgccttttatacctttgtttgcattaccttctggaatgccctctggctctatctttctttcaccaatttttatccatctttttcaaggctcatctgctccccagtttcattaacctttaactgatcatgtcagcttctgttttgtttttcttgagctattactttgtttttttttttgtttgtttgtttgagacaagagtctccctctgtcacacaggctggagtgcagtggtgccatctcggctcactgcagcctccacctcctgggttcaagcgattctcatgcctcagcctcccgagcagctgggattatgggcgtgtgccaccacacctggctaacttttgcatttttagtagagatggggtttcacaatgttgcccatgctggtctcaagctccttacctcaagtgatctgcccacctcagcctccgaaagcgctgagattacaggcgtgagccactgcgcctggccttgaactatttttttttatagcctgtaattgtttattgtccagatggcatttaaattttttctcatatatgtgtgctttgtctcctgttaaatttttaagggattggtgggcatgaattgtttattatatttctcttgcctacctccaaagtactatacccgtagtagattagcactaaatatttattacatagctgaaacaagtgatagcactgataaactgataggtaattatccaaacatatgcatttactaaataatggaaaaatcaagagaggactaagcattactattggtgagttctagttccaaattatcatggcatctttctttagaaaataataatagataaatcataagctataaactattaacaatcctgagatctgggttctaatccctgctctagcatcatttaacttggcggccttgggcaagtaattttttcttttagaatttttgtttcctcatctggaattggataggtaaatttcaaagatctaaattatttgttcattaattcaacaaatattaagcatcttttaaatgccaggcagtgttctagataaaaaggacaaaagcatgaataagagaaagtctctgccctcctgtacattgtggttcatatttgatataatttgatcctcatcttggtgaaatagggaggaataaacattaacattttagagattggaaaataaagccttccctgctgacatcaagtaagtctgtatggagttaagcctggaactgaagtctcccaaactctaatcaagtgaactaaccaagagacaacaattttgcaaactctccctaaagtaaatagttggcataaggttaatttagtagagtccagatatgtgtacaggcaccttatcagctgctacattggcctcttttcaacagggatttgactgcttttacagataatgtcatggtttgcattgcaagctattctttaggaaaatagcaagcatttgttgctttcgaatttagtagggaatcactcctagttccttttagctttattactggaataaggttaacttaaaatgatatggtaacatttctcatttaatagatgagaaaattaaatatttacttgccaaacaactccttctttttccttttgccctcctacagttggcttttctgaggtttatctcttgatgtgtattgtatactccagattttcattcattttattaaacataatattttctaagtctgctttaaaatttgctttcttttaaaataacttccccagtaaaataacttaaaaggcaatatcatgcaggattatttgtacaaatcacaggttttcttactaggaatcttattctttgattcacaaaccttgttgatgaatcaatataacctaagtacacaagtaagaatccttgtctttgagattttgcgaggactcccaacaaattgtaagctccatgaaatcggggactatgtctgctttccctactgttttttccctattgcttatcatagtgcctgacatatagtaggtgcttaataaatattgtacattattaaatgatttttaaactgacatggtatcctaatataattgaaaatgaagtgccttgatactggaaaagattgttatttaaacacaattctcacaacactcattttacaggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatataggtgatgtaaaccaacaaacaacttcaaattcattgtttctagtttaggccatttacaaccacttgagagggtgagagagagaaaaaggggaggaaggagagagagacatagacagagagagagacagagacctatggaaatgcaaagacagaaaaatgagagtcagcagagtgtatgaggtggcgcttattaaatatttaaggatgaaagataagaaatttaataaaggttaaagtatcattttcatttagaactcacaattttattttccatcttcagtttgtctgctatacagtacttttgtctagtgttagtgatggattaattatgaagatacttcttcccaggcctcaatagacaaatggctggatatttattgagtctatattttcagttctaatggttatgagagtgatgggttctagagtctgccagacctgggtttaaatcttagatctaccatttttctagtcgtgtgactttgggcaagttactctgtttcaatttccttagtagtaacatgaggataacagaggaccacctgataggtttattgtgaggcgtgaatgagattattatgtaacatccttggtacttacagtgtctgaaatagcataagcactaaatagggttatctatttgtaaaagtagtagtattgttgattgtggttgttatttctaatgctacaaaatggaaaattgttgtaatgatttgggtcttcgaacttttctcttggatttatatatttgtcagtgggtgacttgtcaaaaatgagtttccaaaataaccaagtttgttaataaactcatcttggttggcaagcaactttgattttaatacgtatcatagggaatattactgagccacttggtttatccctggaggtttctgttaccagatgtccctagctttggataaaggctactgctaaacttcaacaatctccgtgttgaaatggttctcttttgcttttcagttaaacctttgccgccagtctatcttacttttactcgggagagttcatgtgaaattaagctgaaatggagcatacctttgggacctattccagcaaggtgttttgattatgaaattgagatcagagaagatgatactaccttggtggtatgaatattgcatttatttgggaaaatcataactacagccttttaaataaaatagcaaatgtgagaaccaaaatcagttgcatccacgtgagggacagaacatgacatatatcttagttcaatttccagaaagccaaataagctaatggacaaaagtataatgaatgataccaattttaaagttacataggaccttagagattatctagtcacttgttttcaattttgtgtcaataaattaaagttggtgaaggcttaagatggattgtggagaggcctcaagtaaaagcaaaacaaaattaaaaaaaaaaacccacaaagaccacttattgaggaacaaccatcaggtcaaaattacagtatggcaggcttacaagagaattgcttgtaccaggcaagaagggctgcctggggaattaggcaatggttgcaagactaattactgccaccagcaccaacaatgtggtgatgcctttaatcacacattgttatatattatttttccttattagtttccagtttagagagtggtagagagaagttagtgagtcagtagttctaattcattcctttcatatacagataagaaaactggttgttgaattgatgtatagatcccaggtatgtaaattcacttacaatcaaattatgcagctagaactagatatcagatctggttcccagtccacttaagtctacactacattatgttgattcctaagataagttatgccaaaggaaaagctattatattgaatgagaaaaattcttcagctctttgaaatgcaaaattgaaataattgcttcagtgatttttttactctgagatcacccagccttgagatagtctcataactgtagcaatagtttcataccaagccatgagcactgttatacaggttttgtttccttattcttattccaagccctgagcattgttatgtaggttttccttattcttattaacaatcagaataaggaaataagcataaggaaaaaagaaaaagctatatattaatatgtgaactctatagtttccatagtaataacattcacatgctggctctgtcttttggtaactgagtgtatgtagcatcttccagttcatagaatctgggaaatttgacactagtccacatactgggtgttataaacaccaaggctacctaggaattttgctgtctcacacatgctgtccttcactgtaagtgatccattatcactgtagaaataaaatatagataaagaagggaagaaacaatgattttaaaacccccactatacagagagctaattactgctgggattatgcatccagtcttttgatgcatagattgcatagattttatgtaataaaacccactttgaaagggacagatatggaatctgtctagttgcaactagatcaaataatggcatctgattttgtccttggctttcagactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtatgagctaaaaggacagtaactaaataatgagctctttgctagcaaaattaattttcttttggtgtattttgtaattacagaagtgaaggactttcccatatagtctatgaacagagagaataagttagggagcacttcaattgaataaagatttattaaaagtctaatattcattcagttaggactaggaatattgttatacttctattatcaaaattcttgtttttctgtcaatatagataatatgctcattcttttgagagattggcaggaacttattttaatcaatattttcatatgctttcagtattcaagagaacagaaatcttaaagcaagtatagatcagcatacatttgtttctgggtgtctaatactattcaaaaggaatatttttctaattaaaaggtcatgaatagtaaaatacatattcattccattcacttctaacactgatttaaagtgatttgtgataaagtcatttaaattacatagcaatataaactaaaaagcctaaagaatgaggtaaaatgtgattgtgcttcacaatgtattagctttaagagtagaaattactaataaatgttcaaaattgaaggaaatcaactcagcattgctctttcaggtacatagatatagatgcagctctaaataaatatactgatgctgatacagacagatactgccatatctatcaatcattcatctcctttcatgttgttctactatagtggaatctctattatctccctacgaatacagtggtatcattgatccctttcattcatcaaatatttattaagcacctactatgtatcagactcttttcaagcattacagatatggcagtaaagaaatctctaccctcagtgaacttacattttatttccaattgggtagagataggcaataaacgagaagcctaatagattatataatcactaaggattatggagaaaaaatagcaagacagtggaaaactcaaccaagagctatatggaatcagaaagaagacttactagttttatgtttttcatttttgttactgttttaaaaaatcaggaaactctaaagttatgtcctgaactatatctcgtcattagtcaatgcattgtataaagtggttatggtgagtttttagccatatcctcaaaaaatatattcttttctgtattttacatgcaatcttatcaatgatagtgatgcctaagatttctcttgctttgagggaaatcttttcctttttttggtacagagtcttgctctatcacccaggctggagtgcagtggcatgatgttggctctctgtcacctctgcctcttgggttcaagcgattctcgtgcctcagcctcctgagtagctgggattacgggcatgcaccaccacgcctggctaatttctgtatttttagtagagacagagtttcaccgtgtcggctaggctggtcttgaactcctggcctcaagtgatccgtccacctcggtctcacaaagtgttgagattacaggcatgagccactgtgcccagccctcttcatagaatcttaatgactttgaaattagaaacaaggaatttcttgagttgcatgtggtctcagttctttaggacatttcttattggatgtttcaagttatagaaaaataggacaataatatttttggaaataaaagtatgtcctcttcaggattgactctgtatggggaaagccagtagaacttcagcaaaggagcttcctgccttcccactgttaattttgcatgacagataacttacatcagtaatttctctggattatattcttgtaaatcttctctgaacacgtgaatttgactgataattttctaatagaaaacaagatcgtgaggaaataggacaaagaaaaaggtgggatcaagagagctttgtagatgcgtggctaagattcaagatcttttatattactccaaaacaagtgagaggtactagtttagggagaccaaacttcgtctgctttttaagtttgcctagtgattgctcatttcttgctatgcagaagaaccattaaaactccatccctaaactaacaaagcaaaatcaaaaagaaaagaaaaacccttatccctccctttggtctttaaaatatgagacaactttaaaaaggtaaccttaaaagatgatttccattactcacacaggaatttttattgaaggatacctcttgcttggtacagtatcctatgatctaagtacacgtttgacttactgagagttaagagacagacacacaggacatgtttgtttaatcacttggctaatattttgtcatttttaaatggagaattcacaaggtcaaatataaacaaactcatatcaggaaataagaattgtgtttggggaagttatttttctaagtgaaaataagacatgtcacagttcagtaaagtacttttctatataaaaattgcacaaatgaaaggaacgctatactcaaacacaattgtggtatttatgcactggcaaatatgacaggggtttccaagctcaactcagttctgaagtatttataaaataattcagtttcaaaaatagtggcaaatgtctaacacttcccctttccgtgtgatttttaatcctaggtgaagacctatcgaagaaaactttgctacgtttctggctaccatttggtttcatcttaatattagttatatttgtaaccggtctgcttttgcgtaagccaaacacctacccaaaaatggtaagatgtgtaacattatgatgtttagcctgagaataggagatttttaaaatgttctgcacttagaactgatggagatacattttataattttgcttgttcgctgtgggtgtacaattgattccgtatggattatgatgttatcttcagaaaatacagcaatttttaaaaattaagcttacaagacttcattttgaggtggatttacttttgtcgaaatcaaactttaaacatgaaatactatttggccctagattagagaatggtatacggaaagagttacaagagaaaagcaggattgggagaaatagaagagtgaattaaaatgatcatagactgaaacacatattaccagtgtgccacaggcacaagaacacatgcaaatgataaagcatggtgcctgcctttggagcacacactcaagttaagggagacaggatccatacaaaaaaatataacctttgagatgattttagatgattgccatttgagtcgtgcagataatgctatagaatttcagaaaacaataggaccactctgggttggggggctttaaggaggagttgtaacctggagaaaaatatctttttgggacagggtctcattctgtcactcaggctggagaggagtggtgcaatcatggttcactgcagccttggtatctagggctcaagcaatcctcctgcctcagcctcctgggtagctgggactacaggcaggcaccaacatagcgggactccatctctataaaaaatttaaacattagccagacacaatggctaatgtttagattttttatagagatggagtcccgctatgttgcccaggctggtctcaaactcctgggctcaagcaattcctcccactttggcctcccaaagtgctgggattacaggtgccagcaactgtgcccagctgagaaaagatatctcaatgccatatcttttcaagatagagagaaaagtgaatgtgtatagaatgcttcactttgtttgctgaatgctcttgtgcttattctctgagttgttaatcttcagtgaaatagtttgtgttattagagatgacttgttaataacagagttctttctagattccagaatttttctgtgatacatgaagactttccatatcaagagacatggtattgactcaacagtttccagtcatggccaaatgttcaatatgagtctcaataaactgaatttttcttgcgaatgttgaatacgtcttatttttaaatattgttgtatttaaataggcttttgagtactcaaagcctcagctagtagtacattttctggattctattaacagtttcttttctcataaattcatagtgagagtgctgcacgtagttctccaatcaaggtatgagtcaggttttatatttatgatgtattaataaaacaatgtgacttcacagattgcactaagccacagagatattgtcagatcttggaaaatgagattctagtttttgttgttgtttgttttaaactgcacttgggatgaaagtatacagtatgaataaaactgtttggctttaggctgggcgcagtggctcatgcctgtaatcccagcactttgggaggccaaggcaggtggatcacctgaggtcaggagatcgagaccagcctggctaacatggtgaaaccccatttctactaaaaatacaaaaaattagccaggcatggtggcgcgtacctgtaatcccagctacacagaaggctgaggcaggagaatcgcttgaacctgggaggcggaggttgcaatgagccgagatcatgccattgcattccagcttaggcaacaagagtgaaactctgtctcaaaaaaaaaaaaatcgttttgctttaaaagtaacctgtgaaaagtattaggaagcaagaattttaaatacattcatagtcctaagtatattctttgcatttcatgaagaaaaatgtgtgaagaatgcagtgcttaaaaagctaaaagtagtaagatgattaggaatcatatttgaaaaaattggaagtcacaaactacacagtaaaacttgagagtttccctatactttctgatggtgtgtgtttttggttcacggaccaaaaggtacaaacatctgaaattagtaagaagctttctaaaaggacaatcaaccttcagggtatgtcacaacctaggtgtcgataattcctttaaaacttagggaataatggactccaatcaggattgtagattacaatcaagagccaagcttccgtttggactagtttctattcaatactattcatagtagagtggccatcacctgggagcttattagaactgctccaaccccgacctactcagttagcaatttgcattttaagaacattcccagatgattcatttgcactttcaatttgaaaaacactgatttatagcagtattttagaataaaaaatgctaaaataatataatgcagaggaggtaagctcctgggaagggtagccacagctgtgctcatcattgccactgatcatctctaaaagatgaaaaaagctaaaactgaagtgtaaaccacaataccatcctttactatcacttgtaatcaatggtaggatgtactgccatttccctaagtagacttgtccttgttaaacattaaaactcctgtgatagtgtaaattaagatgcaatgtgattggcaattgctgtcaaactagatcttgctaaagttgttcttagtgagttgaagggtgtagggaaggacggaggaatgtgatgtggagaggtcaaggtgaggtagagatatggtaggcaacctcatcctgggaggctgcatgcatcttggcaacctactcttccaattcccttgtttagtgcatgcacaacaagccctactaattaaaggaattctggcctctctaccataaacctagaagccccaatcagaattgccccaacaaaatggaatcaagtagcaccaaatccggatatagttgggccctgcacaaagcagccaggaatggatttggagagaggggtcaactctcactcccccagtccactgttttggacacaacagaggttctctgaactgggcgccagtgcatatgcacttgaagaaagtgctttttgtattcacatggtagccccatccccactgaaaaggagcccaaacaacttgggcttgcatgaaggatggggcccaactcaccctccctacacagaatggcagtggcttggcaa

SEQ ID NO: 13138 - DNA, 10543 bp, Human
atgaaatcaagcccggccatgcttgatttttaataaagcatcgtatctctctattttacctgaaaaaagatcccctcccacccaccttatatttccgaaacaataaaaaatgagttttaccttttctggtcatcgaaggcattttttgagatggcttaacaatcttttaaattatagaacacatttacaacatccttgacacttaaataacatttccagtgttctttttttcttttttaattatatttctaaagatagctaagagaacaatttcaaatagttcctctatgcttttagatgtaagttgtttcaatctccatgtattggtgagaattaagagacttgcagttcgccatgtcctgtcatgttagcttattttgtagggaaatcaaatctggcacctttcaattaacttctttacctctctaatctaaaaacagatagaatacattctggagcaagaaggcatgattactatctgtggattgccttgacttcctcaactgtgtcttctgtcatttcgaaatttgctaaaagacctcctataaaagcaggaaagcacagacggaaggaaggtggtgctgttgaaaaataatttacccctagtcgtgagcttggcaactcttcaagggatcacaatggtgtatctcatctggacctagaggtctcgaaggaggagataagtggaaatgttttgtgggctggagcttagtcattctcctcggtgacttgaggtgcaagctattttggaggaagataaagaggaagggagacaagaagtgggaaagaaaaaagtctctctgccttcatacatgcttctgttcactacgtttatactacttttttttctttgaaaaattttttctttgaatttcttttttttctttgaatgattgttttaaatcatgtggtaatgtggtcatgacatatgttaggtaacaaaaagaaaaataatgattccaattttgttaagtatatgtatagaaaaaaggaaagtaagcaaatcgatcagttatctttgagtgataatataatgaataatctttatcaccttcatactgtgttctttatattttattctctaaaattttccattaagcatgaataaggttttgtatcagagttttaaaatacattttaaaaggaaatggcaacttattcagctacagcttttttataacatagtatatgaaagttcatatctagtaaatgtatttggaaatataatacatttggaataacttttctgtaaggatgcatctttttaagtgactttattagtctccatgttgcatttttaaatatataactctgcagggcttcacattttccccttcacttttgctagctgtcagtcatcacctctaccttgaaactagtctatgaccagtaggatttgtagataattatcattaactgattgagtggattcagcagtgtgcctgttgtaattaagtgtttggatatgcaaatagataaagaatagataaaagagaaggtactgattaggatgttaaattcacaatatgatggttgatagtgacaggtaatagcatgatgtccttttgaagatactatattaattatttcttgaataccttttcaagtaagttactgttatttgaaattccacttaatgccagccctggcccctcaacatttcatcccaatctcgttgtttttgaaaggctcagagtcatattgggcacttctttcattactgcctttaactgaccatttcctcttttctttcctgcaacagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaaccgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccatgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtttggtaagaagtattaatgaagtagctaatattacagcttcattttctactaccacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaccacattgtgtttatctgagtaagttcattgggatacagtcaatacttgtgctgttaatgtagaagaaatgacgcaggagggcaggaataaaagaggtaataggactttcgtattctcctatcatgaatatgacttgcatttctaaaggccatttgatcctttttgtgtgaggagtttatatgaaatcctcatgttcttttaaatttcccaactaaattgtgtgttcctacgaataccttttaggtatgcacacatacacagagcatcttattttatactggtgaaatctatgttgtttaggatacagataatgtcattgtatttatcctatcagaataggcttttcccctatttcaaaatagatgctattggctttattttttatttttaaattttttttaaacacggtcttaccatgttgcccaggctggtctcaaactcctagatgcaagcaatcatcccacctcgatcacccaaagtgctgggagtacaggcagaggacaccatgcccagccacgctattggttttaaatgtcagatttctttaagaattctcatagtacttttctgccgcagaatttatagcacatctgtccatcctttcaataggcactcaaggaaatgtatctattcatatgctcaacttcaattgattagtctcatatgatttttcagaaccccttttgctaacccctcttggccatttcattaataatgtatttgacagagattgaatcaggaaataaattcatgacatttcagttaactagtattacctgtttgtagaatctctgttggaacattgactatgaaagacagtgctaacaagtaattcatattacttttggggattttatgtaaagtaacatctatgctattcttgggtacttttgccaagagttacagaccttattctatacagactaaaccattagtcaaaaaataccattcattcaaaataattcattaatgtcctcctactctgttccaaacactaggctgagttcagaggcctcacagaatagtgaaatgcgttcttagccaaatcaggcaaatcttctccctcactatgtccctgaagaaatctcttcatctgatatatttactattcatctactttctacagcactatgttagggtcttccggggattcagagaaaagtgtctgtgagccattaagaaactcacagatcaggtaataaacactttttctaatgcattccagtgtctcagagcctgcataatcactttatactacttcattaaattgacaggacatctaaggtgacaaaagagatgtttctacctgttggtaaggttgatgcaactgtcataattagatgttcttggtttttaatagatgcagcaatgagagagtacattgctaaagtcagaacttaatttgaattaaattttcaagtttccaccaagtatttgaaaacttagaaattgtatttcgtaattacacatgcagacatttaaatttttattaagcaccacgatggaactcaatctaaaggaataatggcacctgataattactaacaacctttgtttatataagaccttgtgcaaactgtgtgataacgtatgtttgcattctgtctttaaaataaccctgtaaggtgcgttattttaatttttagattttaaaacttagcttcaagagaaattaagtgattagtctatagctacaaatcctgtaaatggcagagtcaggaattaccactgagcatgactccatggactcttaattgttttcctgcctcttaataaattgaccatccttgagactgactagccttcagatttttcatgatggagctatcataacttctcagtggatacatatattatcatttatggcaaataaagggaacattttagaagcctcaaaattcttgtcttttaaagcccttggtcatccattcctattttttataaaaattctttttgtgattatttgatggctgcacatttatctgatttgaaggt

SEQ ID NO: 13139 - DNA, 95648 bp, Human
  misc_feature (1)...(95648): n = A,T,C or G
acactaactttattgagaacagcgatattcatttcttcaatttcatttgtgttaacccaactgtaggtgatagtgctctgtacatcatagttacccagtgaattacgtacctgacatatgattgcttatttctggtattaaaacaagatttcataaaataaacatgacaattaaactcgttgtttgaagtactgaactttgtaggtcaattttgaaaaaggaagctacatgactgtcttagcaatatttataggtatattatatgtaagtgggtgggtttcttggaaattgaattggtaatatggctttagagtagtaacacaaaaactatagctctgtgctctcagctaaccacttttagtgtcacctgggctgcttattaaaaattcaaatttcttatccctacccagatcagaatcaaaatacctgggggttgtagctccaggtacctacatttcaacaagcaccccagataattgtgatgcacactgaagaactactctagcttgtaatctcaggtggtaaggcattttatatatacatatatatatacacacacacaagcacaaatggtaattctatgggaaaatggaaatcagcaagtgaagtgaaatgtcaattaccatcaggaacaggaagctagttcaccattacgcatcagggaactggaagaattacttgagatttatttttttgggtgatatattacttggcagtttatcaggcctcatttgcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccgcgcgcccccgtttccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccggtgagtatccctggatggggaggttgcggccccggcacccctgccctgtcggtaccagggccccatttccagagggggactggcgtacctcacctgagccgggaggaggttgggtgggcattccagctcctggagtcggctcgcttttttccttgagccagggctatctatccgctcgcctccgctggggccgggaagattcccgaggtcactgtatctgctcctgtgatggactctggggtcctcggaaccccagcctgcctcttcctgccgctcaccgcatcccgagggccagaagtcatcttcctgatcggggtactaggctttgccacggccctttccggaggagaccatgaagtgcttgctagacctccaaacgacctttagggtgcccctaaacctcaactccattttgtcccctcccagtcgctctgtaactgagggctagggagcctctctagccctagaggcatccgccctctcgaatttgagggatgccgtcgcttccgatatcttccttgcttccgatatcttcctagcttccgtaggcttaggtttgttagaaaacagctggatcctggcgaagcgtgctttccttccttcccccacccccgttctttctgtctacatccctgccttcagtgggtgctatatatttagtatgagctttattcacttcctcttcctctcgtttgagtgcctgaaagaactgtggctgatgtctatagacatagaaaaatctaggagaatatgattcattgtctaaccccatcaaggggttacatattttaaataagacgtcatttctcctcttcactccagcatctcctccttcaaaggcatttttcaccctcttgaaattaatacgctctattcgctcttttcacctaaaaaaaggtcaatcgtcgctctgagaaacaacagtgagatgcaaaataagggtaaaatggcattgaaatgaatccctttgaaaaagtaagcggtttgctttatcagttaatggtctcatcagcgcttcagtttcctcttctgcaaaaatcagtctgttgaactagagcatatcaaaggttccttctagtgttttgattctaggacctctaaattcatgcaggctgcataatgcaaatttaacctgattaaagccttatttctcatagtcgcttgtcaccttagtttttcttttattttgtctctaacaagaaagacttttaaatgttcttgatacgtaaggcagcaggtggagattcaatgatggtactgccattgagcatatcggtcaagattttaacagtgtaaggcctcttccttaaattgtaaaatagctcatcttttgattgaaactgctaaagtgtaagacatgtaagactcctgttagaattaacactctctgccatttaggtgggggatgaaacattaaactgttagtatacttgtaccttagaataaagtaccttattgtcctgctataagaaataatttgacaactaaaaatccatggaaggtgtaatacagcaattgaaagcttgagtaaattcaattttgtgggtttttttttttttttggaaaaccccctatttaaaaacacaagtgatttagattaagatatttctttcagtatttttggtaggggtgagatgggtgaagaaagaagagtcttgttcaattcagacaagagaaatgaattggaactctggagaggctcaggttctagacccaactctagatatatatttaaccttgaacaagtcacttcacctctcttagtttttgcatctgtaaaataagtgtctttatggttgttgaaatgatccacaagtcccccaatttgaatgatatattcttataatgaatatatatgacaaatatatatatacacacgtgtatatataggtatacacacacacatataatgcaatttgcgttaaggctgttataaatcctgttataccagttgactagaatgtttttctcaaaggtttgtgtatagtggtttcaatttaggtatacttagttcttaatcctgattaaataaataattatatgtgaaaatctataaactcagaagcattttacaaatgttgggtattatgttaatttctgcttgcaagtgaaatgtgtgttataccgcactattttttaaatgtccatggcttttagaaatttataagggaatggctgggtgtggtggctcacgcctgtaatcctagcactttgggaggccgaggccggcggatcatgaggtcaggagatcgagaccatcctggctaatacggtggaaccccgtctctactaaaaatacaaaaaattagccaggcgtggtggtgggtgactgtagtcccagctacttgggaggctgaggcagaagaatggcgtgaacccggaaggtggagcttgcagtgagccgagatcgcgccaccgcactcacatactgccttacaactgtaattggctaggaactttaaaataatatgtgggcatctcattcatttattaattcattcaactatcttcttccttcatctgtcaagtatgtcaggccctcaggacatgatggttaagacaaaccctactctatgagtttatactttgggctgatggagatggttggggggcatgtggagagacagatgtacatccagtttatttttgttaaaaacaacaacagtcaaatcaaggacaaacaaaattctggagaagttaagtttccataggggaggaagagatgattctattaattgtagcctgtagactctttgacattacctttttctccatcctttcaattgctgagcctttagcaaaaataaaagctttgtttttccacttctaccattggctggtcttatatactctttctttcccttttaactttttattttgagatagttgtagattcacatatagttgtaagaaataatacgctttatctaatttcccccaataatagcctcatgcataagtatagtgtaacatcacaactacaaaattgaaatcgatgcaatccatcaaccttactcagatttcgtcacctttaatgcagtcatttgcatgtatgtatttagttctacataatgttatcacgtgtagatttatataagcactaccacagtcaagatacagaacaattgcatcaccacaaggatcctttttgttgtctttttatagatgtagccatctcccttcatccctgactcctggcaaccactgatctgtttttcatgtctataattttgtcatttcaaaaatgcttatataaatgaatcacacagtatataacctttggagactgactttacttcactcagcataattccttggagattagtgcaaggaatataccttttatcaatggcttgttcctttccattgctgagtagtattccataatatggatttactgcagtttgtttaaccagtcacctcttgaagggcatctgatgtttccagggtttttgtttgttttacttatttatttatttatttattgcctattttgaataaagctcatatgaacagttgtccacaggattttgtgtgaacataaatttctgaaatgcctgagagtgtacttcttgggtggtatagcacttgcatgtttagttttctaaggaactgccaaaccattttccagagtggctgtaccattttacattcccaccaggaatgtgtgaatgctcctcatccttgacagcatttggtgctgttactattttttattttagccattctcataggtgtgtagtaatatatcctcctagttttaatttgcatttttctgatcgccaatgatgttgatcatttttccatgtgtttatttgccattctctgtatcttcagtgaaatatcagttcatgtcttttgtccattttctatttggattttttttttaacctggtgagttttaagagttttttattatttttttgagacggagtctcgctctgttgcccaggctggagtgcagtggtgcaatctcactgcaagctctgcctcccagattcacgccattctcctgcctcagcctcccaagtagctgggactacaggcacccgccaccacacctggctaattttttttttttttttgtatttttagtagagacagggtttcaccgtgttagccagggtggtctcgatctcctgacctcatgatccacccgcctcggcctcccaaagtgctgggattacaggcgtgagccaccgcccctggcctttttattcttaatactaatcatttgtcaggtagtggtatgaaaatatgttctcccagtctgtagcttgtctttccaacctcttcacagggaatttcacagagcaaaaggctttaatttggatgaggtccagtttattaatttttcctctatggactgtgcttttggtgtcaagaaatcttacaaacttttgttatttaatttgattcctttctgttctgtataacatccattatttctgtaagctatttgagcattttctctttcaacaattttagagctcaaatatattctgtgaacaagtggccttaatggcttagaatgttaatacatattcacacatgctctcactatattaaaatggctgccttaaaaatataatgtctacctcaccaggctgtcaaatgcaacattaaaatttgtattttaaaattaaatagacgcatgatatgctaaagaggtttttggtttcactttctaaattaaaaatattttggcaaaactgtatcattttccatcaaggattttggtaagtaatccaaaaaacaaatttgtgttcttatttaaatgtactttgaaagtctacttctgcattttgagtagtgaagttatgattcatgaccatgtatttagcagacttttctactcactgttgattatgagaataatgaataaaagatcattgtatttgactgtctagactgcatttttccttttatagcagctacatgacactcattgtaactgtcttttgaaataaatattaggttcaaggtgatgtttacagttttatattttgaaaaatgtatgtgctcatatgagaaggaattataggaaaaggttagtgattaattttgagaatattcatttctgtaaggcagtactgaaattatttgtcccttcagtgttactatatttactcaaatatgtgtgcagtgagggaagtagattgttatttgaaaaagataaaacattggtataaggcaggggctggcaaaatactgcctgtggccaaatcctgcccaccaccggtttttgtaaataaacttctcttggaatatagccacatccattaatttatgtgttttctggccgcattcacaatacaacatcagagctgaaacagagcccttatgtcccgtgaagccaattttctctctggacctttacagaaaaagtgctgaccccagagataaggtaaccttataaattgttgattacacacacacacacacacacacacacaatttaacaaactaccctgactttttataccttctggttacatttccaggtgatattgtgattcaggagagtgcattcattttctttactaagtctccaaagcactgtggtctaggagcagcaataaggaatgcatagagagttgagacggttgattttgttgttaagtgtgggttatttaaatgtgaatgtgaatttacatgtgtggcaatcagtaagctgcagatagacttctatgcagtctatgatgtcttttggagaccctgttgtgagctgtagcggtaataagagagccaggcatggtagtgtttttgctcctgaaactgctatgtgatctttaagtacatagtagtaagagcctatcaaactgagcttagactgttggtttattattttgtttgtacaacttccttttttataacgaagcagttgacactttagttcttttaagtgttctaagtgtaatgttgaaaatggaaattgagtaaagacaggtggctgtgtatttagaaagtaataagtctccatctctcatcatacacaaaaataacttaagaatatattttaaaaatctaagtatatattttaaaaaatcttctggaaagtgtaagacatcataacccagttaaaaagacaagtgatggccgggcactgcagctcacgcctataatcccagcactttgggaggccaaggtgggaagattgcttgagcccaggagtttgagaccagcctggacaacatagtgagaccctgtctctaaaaaaaaaacaaaaaaaacaaaacaacaacaacaacaacaaaaaacaacaaaaaaagccaggcatggtggcatgtgcctgtagtctttgctactccagaggctgaagtgggaggatcccttgagcctgggaggtcgaggctgcagagagctatgattgcaccactgcactctggcctgggtgatagagcgagaccctgtctcaaaaaataaataaataaaataaataaaaatgaaaaagcttctacatatgcattagaagctttaattgacctccacttaattgactcaccacattgaataatttttatttcctttgtaaaatacagtgtacactgaatacttggtattagttggttgatctccagtactccagcgtgcttgtttacctaccagtacagtaaatttttttactactaaacctgtatatgttggttgtatttgtttttttgtttgttggttggtttgtttgtttttgagatggagttttgctcttgttgcccaggctggagtgcaatggtgcaatctcggctcactgcaacctctgcctcctgggttcaagcaattctcctgccttagcctcccgagtagctgggattataggtgcccaccaccatgcctggctaattttttttgtatttttagtagagacggggttttgccatgttggccaggctggtcttgaactcctgacctcaggtgatccacttgcctcagcctcccagaatgctgggattacaggcgtgagccaccgtgctaagcctgcttgtatttgtttttaaaaggtaatttgtttaatatgttgtaacctgacaatatatgagtgggggagattggagttctttttactgaaaatttacaaatgaaataatatgatgtctgggatttgcttaacattatacaaggggtgagggatggaggtgggttgtgggtagtatggaagaaacacaattcagcacatatgaataactgttgaagctgggtgatggttacattagattcattatgatgaaacaaattgttttgagaagagttaatgaaaacaagttgcaaaaaaaaatactgtccgcttaaatgtgggtaagatgactatacaagatacgtggaaaaaatataaaaatctaaaagagttttattttattttattttattttattttttgagatggagtctcgctcttttgcccaggctggagtgcaatggcgtgatctcggctcactgtaagctccacctcccgggttcacgccattctcctgactacaggcgccctccaccacacctggctaatttttttgtatttttagtagagacagggtttcaccgtgttagccaggatggtctcgatctcctgacctcgtgatccgcccgccttggcctcccagagtgctggggttataggtgtgagccaccgcaccagccatctaaaagggttttatactcacattacttgtcaaatgtaaaatcaatgggcctggagttagagaaaaaggtcttggcctcttggccccatatagaaagtttgaggctggcatggtggctcatgcttgtaatcccaacattttagggggccaaagcaggaggattgcttgaagccagttcaagaccagcctgagcaacatagcaagaccctgtctcaaaaaaaaaaaaaaaaatagctgggtgtggtggcacacacctgtagtccccagtcactcaggaggctgagacaggaggattgcttgaggccaggagttcaaggttgcagtgagtcatgatcacaccactgcattccaacctgggagacagagtgagatcctgtctttaaataaaaaaacaaaacaaaataaaaacaaaaaaaaccccaggtcaggtacagtgcgtcatgcctgtaatcccagcactttggaaggccaaggcaggcagatctcttgaggccaggagtttgagaccagcctgggcaacatggtgaaaccccatctctacagaaaatttttattattattattattgagacggaatctcgctctgtcgcccaggctggagtgcagtggcatgatctcggctcactacaacctccgtctcacagattcaagcgattcttctgcctcagccacccgagtagctgggattacaggtgcccaccaccacacccggctaatttttgtatttttagtagagatgaggtttcgccatgttggccaggctggtctcaaactcctgacctcaagtgatctgcctgcctcagcttcccaaagtgctgagactacaggcgtgagccaccacgcctagcccaaaaaatacaaaaatttagttgggcatggtgccatgtgcctatggttccaactactggggaagctgaggtgggaggattgcttgagcccagtaggtggaggttgtagtgaactatgatcactcacgtcattgcattccaccctgggtgacagagtgagaccttgtctcaaaaaaacaaaaacaaaaattagccaggcatggtgatgcacaactgtagtcccagatacttgggaggctgtggcaggaggatagcttgtgcccgggaggcagaggttgcagcgatccaaggtcactccactgcattccagcctgggcatcagagcaaaaccctgtctcaggaacgaacaaaaaaacaaaaaagccccccaaaaataaataaaccaaaaccacacacacacaaagtttgttgaatgagtatatatataccactgatgaaaggaaggtgaaatgtttgccatacatatttttatgatcgtttacctgaaattaaccttttaaattacataaccaattgttctaaatcacattagataaaagggtttctactgcataatatccataatatataaagagctcctaaagatcaataagagaaaggtacccactacaaaaagcaaaaagtggcagaagattatacatgggcatttcccaggaaaagaagtactggtgaataaaaaagaaaagatgttcaaattgactctggttattagggaaatgtaaaccgtttttcaccagacagattggcaagaacttaatatccacttttaacaaataggcatttgcatacactgttaatgagagttcacatgtataactctttgctgaagaataccaaaatcatctcatttttaaatgtgcatacattttgacccaatagttttattagaaaacaattctagggaaatattacatgtgtataaaactatgtataaggtttcgctgcagtgaaactgtttgtaactgtgaaaatttggcagtatcctaaatatccatcagtagggaatgatttaaataatggtaagttatactgtggaataccattgagttattaaataaaaaaagaagaaaagcctcttggttagacatatatatacactgacataggagttccaaagtatgctgttaagcaggggaagagagggggagggagtcaaagaacagttgtataccataattccacttatctaaaaataaacccttatcatgtgtatgggtaatacaaaacaatctgattgatacacatcaagagtaattatccctagaggaaaagagagtggtgttagaggagggcagtatagttttactttttctctgtacaattctatattatatattataatttacaattacaattttgatagtaggtatgcagattactattatagcaaaatacaattactattttgatagtaggtatgcagattactaatattaaacatttgcacactggaggatgcttataataggattccttcattctacaacaacactctactgtaaatgtaattaatgccttgtactgaacactcaggtttttaaaaaaatgatgttttctgctatcgatgaagtattggtattttctaaatttttgacaccaaaaatataagtataaaaaagaataaaaacagtaatttcatacccagaaacatccattgtcaactttttggtatatatgcttgtgcttatatgtatggacacttgcatgcacatgtgcacacatatatcacctttctacaaaaatgggtttttactgtacatactgatttgtaacttgcttgtttaactcgacactatattgtgagcatcttgcagcatcagtaactccgagtaagtgaaaaagacatctggtgggaaaaggccaacatcgtgccatgtaaatacagtgttttagttaaaataactggtttctaggacaaaccagaattaaaaaaaaaaaaaagtcatggtcaccaaagtaaataaccaaggaattttaaagtctttaatgttgagtcagttcagttctgttttgaatttaactatgaacatgttatttacagtgtagttatcaatgatgatgtaaaagtgcaatatattaaaatatcattaggaagctttttttgggtggagtttgattttagcgaagaattaaacactgaacctgaatggttatttttgttcaaagaaaaaccaactgctgtggctagtttttggtagaggtgtgtgtagttgtattcttttgcaacttataaaagtaaagaaaatctaggtatctgtggcaacataacctttttctatgatatctcagtttgtagtttatcaaattgattattaggagaactgtgtcagagaattaagtttgatttgggcaagtatgtgtgtatgctactttctcttgtcatctagaagtatttgttaaacaaatttgctgaagacccattataatttcctctgggtttatgctgtaggacttagaggtgaaaatatcttacttttgttgaagggtttttgttacttactattttccatgaattcaacagtgcattttacaaaacaagattctacctggtagacaatggtgttaatgtgaaggcccaacatagctatactcaggtttttattatgatgattgaaacagtgtccctattctccaaagccatttaggcctttttggaattgatttcacagtacagaggattttaggtgctatcaagttagcagattttaaagggaatcaggatagagtttctctatttctcacttagttaatgagagggcatgtgagattgaacttttacagaggcattgaaaatgttaatggtggattcttgtggtagttatgaggttaatggagtggggaggtatggtgaaataactgtttcttcttttttcttttcttttcttttttgtttttttttttgacggagtcttactctgtcacccaggctggagtgcagtggcaggatctcgcctcactgcaacctctgcctcccaggttcaagcgattctcctgcctcagcctcccgagtagctggaactacaggcatgcactaccacgcctggctaatttttgtatttttagtagagatggggtttcaccatgttggcccggctggtctcgaacttctgacctcaggtgatccgcctgccttggtctcccagagtgctgggattataggcatgagccaccacgcctggcccctgttttttcttaggtattctgttttattacctttaatgtggactttaagtattttaatactataaataatgatagggttttgtacgaccaactctcctggggaatacctgaatgatgttttatcaaagaaaacctggagaaataggcagagctgccctgctaagatggtgaaaattcactgtgcttcaggatatgttagtaatttctgctttccagatgaactgaaaactgaaaactccctcagtcaggagacaggaacttggtgaatgagcataaaattcagtcatggttttgagaagaaaaagaagaactagcactaataccacatgggatgaatccaagtaaaagatctatgttccacatgacgactgaaagttgagaagcagcttcaaagaacagttgaaaaatcacaactttactgaagggtagaactcggcagaaatagctgtagcaattgttagatgaatatgtttcagacaaacagagcagaaaagagaagagaaggcctaggataatgatatttcttcacctggaaccatggaaactttcccgatttggtcaacagtcaattgcaaggttagtctaggacggtttaaagtctttagtggaatatttcgggttcagaaagtgtcagcaagcaaagcaaagacccattttggaaggcattggggtcccttctgtacctagacaattccttataggagtaggttagaatttctgtgaagcaagttgtttttctataacctggaaactacaaaaggcagggctcaggcacactgtattggtgaattatagcaacctgtagatgggaagctgtgtagtttttttatttcttcaagtagaaatgtgagtattagcacattcattcaaatagagttacatgttataaatttttaagcaaaataactgacctaagtatgttatacagctcaaatttccccccagaaaattttggactgttttactaagattttagtttttagtgtcaagtattaaggccaggatttttatgtggaagcaggtttttaaaaatttatatacacattgacttaattttaacatcctcttgatcatcaagagattaagtatttaaatgtttgtaggaaagtagcttttttttttttgagtctcgctctgttgcctaggctggagtgcagtggcgtgatctcggctcactgcaatctctgcctcctgggttcaagtgattctcctgcctcagcctcccgagtagctgggattacaggcctgtgccaccacgcccagctaatttttgtatttttagtagaattactaaaaattactaaaattacatgttggccaggctggtcacaaactcctgacctcaagtgatctacctgccttggccttccaaagtgctgggattacaagcctgtgccaccatgcctggccaggaaactagcttttttgtttttgtttgtttgtttgttttttgtgagatggagttttgctcttgttgcccaggctggagtgcaatggcacgatctcagctcatctcaacctccgcctcccgggttcaagcgattctcttgcctcagcctccttagtagctgggattacaggcatgagccgtcatgcctggctaattttctatttttagtagagacagggtttctccatgttggtcaggctggtctcgaactcccgaactcccgacctcaggtgatccacccacgtcagcctcccaaagtgctgggattacaggcgtgagccaccacgcccggcggaaagtagctttttaaaggaaacattcccccaaagaattgacttcattataggtggtatcccttaaaatacagactgtttcagaagaggcagcagcagaatgaaaactttcatggtgaattccccaccttctattttattcctgttttgaaatggagttccccaacatcaccattacagctcagccatatctttgcatttctttgtggacttagttagaactgaatgattgatgattttcagcgcgaggagtacaaaataggggagttgatacttgcatcagccctgctagctgccttgaatcctagctcagtaggggtcactcttaagctgccataggcataacaacttctacataggtggcacttctggcactttggagaacattctagtggtgggatagttccctaacccctgtcttatctctgtggtaccctgcatctatgccatttttgtttggttacataaaatgtttctgtggagtgattggcctatgattgcattgataacatttagtaaaacagaagatttgttcctaacacgttttacagagctgatctttttattgaaaaatccctaaccctaaagaccacagttttttgtttgtttattttgtttgttagcctcatagggataaagtgcttccttataatcttgtttccaattgtcttcaactgaggaagaggaagtctgttgactgtctccctgcaccccctctgattgaaggatcaccttgcttagggcactgccagcttaaaagtggaggtggatgccatactaggacattaccaaagatgaggaggagtggcagtgaacttagagtctatagccagagtgtacattgaattttaaaaaccaataatctgagatctagtctgtacttaagagacatatttaaacaacaaattgtagactatgggatttcttttctttctttttttttttttttttttcttgagacagggtttcacttctttcacccaagtgcaatggtgtgacctcggctcactgcaacctccaccttctgggctcaagcgatcctcccacataagcatcctaagtactgggaccacaagctcatgccaccatgcccagttaatttttgtattttttgtagagacagggttttgccatgttgctcaggcaggtctccaacttgtgagctcaagcagtttgcctgcctcagtctcccaaaatgttgggattacatgagtaagccactgcgcctggctgactatgggatttcttaagctaagtagtatattgaaaagtctgcagtgtttcatttgatgatcagtctccagtgaaaatctgcaaaattgagtcaaaactgaatttgtctttcaaagttgggattattgttatataacactttcatggtacttaatgacttcagtgagatgtaagtaacacattttgaagcagctcacttcggttgaaagaattatttttcaacctggagttgatttcttcaatttcgcatcattcctagcaaattgtaacattaaggtcatattatttgtccagtcttttctaaatgctgtaacgttttgtcatgaaatcatgggaaaatgttacttttgcattgtgaggagtgagtaggaatttgtttaggacagaaaaccaaatcttagaattgtggactttgcttatgacttctacctctttagttaaaatcaaagttgcgcagttacctgtttgagttgcataaaacagttctgtgggatgatcctctcaaccatggttatccagccttttggcttccctggaccatgttggaagaagaattgtcttgggctacacataaaatatgctaacactaatgataactcatgagcttaaaaaaaaaattaaaggtgtatacataattttcacgatatctaccaccagagataagcaaaaatgtcctcgcattcaaagggttggacacggctgtgagtataaactattggaaattgtgttgagtttgatttttggccagggttagggccatgtcctgctattgccagaccatttttttcccttgctcttaccggcactgccccattgctgcagaaagaccaggatgctgtctgggcttggcacaaggctctgaacctcaatgtcattcccttctactttcaggcattagcagccctgaaaaccataagatggggctgttaaaagcattttgaaattaatcttttcttgttctttttttttgttttgagatggagttttgttcttgtcacccaggctggagtgcaatggcgctatctgggctcactgcaacctccatctcctgagttcaagcaattctcctgcctcagcctccctagtaggtgggattacaggtgcccgccaccttgcccaggtaattttttgtatttttagtagagacggggtttcaccatgttggtcaggttggtcttgaactactgaccttaggtgatccgtccgcctcggcctcccaaagtgctgagattacaggtgtgagccaatcttttcttattcttaaaaaaaaatcaggcttgtaagacgcggtcacatagccatcaatcagagttaaagatgtatggtaagagagaacaggtttgttttcaaaactgtcctctgtgttggccttagttttgcctttgatgaaaaagcaaactaccctcttatattttattgctattcatattggttgcagatgcttcaaggaggattgaattactgcctagtttaaaggtgatatatcttaaataatcatagaaatagctgcaaaaggatatcttaaaggtacattacattgcagatgcaacagaagctaaatgcattagggatacatgggcaatatctactagtaggaaatatcagcactgttaggattacagccattttcttggctgacctttgtatggggatacataactctccttccttaaatagtatttcattgagatgggaaaaaagactcctgctctgcttgggcttttttagtgctctggcccttctctttaaatctgttgttaagagttcttgttttggcactatgcaaaagtgccttatactgaggcattttaagtacttaaacaatgaaacctccgttggctgtgttccacagtggaactaacccattccaaactttacacttgctggagtattataaccagacagcagtgttgtttgtaacagctggctagtctgtagatgaaattgatcaagatgttttagtttctcagttggtgcctttcaactctgcatttttcttcctctattctttcagaacctcactttcatcctttggctttgcatacttttccttgccccaatatttgaaggaagtttttaataacattcattttcaaagcaagccaggtgatacttaagtagtaacaggtataactggttaattccagagggtaactattatttttaacttttaaaaagcatataattgtcaggttgggcaattattatagggttgaggattgcctcatgtgtgaccttcctttcctattctacctacatgtctagttctctgtgttagtcttctgtccacttaaaatatcaattgaacagtaagctccacaaaggcagggcatagtatatacttactgagtatttcttgaacaaatgcacgcacatgtacctgtaattacccagggtttgggaaactagattttaaaaaatattttgaagggaaagggttgttactggctatacttaacttttaattttctccctccttaaatcaacatgttattcttcagcaatgatgtttacaaaaccaaataaaattagaattaaccatttgtttcccacttcagtgagtccgtacccagtggggtgatgtcactgtcatatttaggagaggccagatgatataattgcctttataactttctgttacaatttaaaagagcacagtgacttactaccagaaaagctttgtaccatcatattcttgtttatatgtagggaccacttaaccaagtggatacttttgtttagatttttaaaagttttagtttcatgtcttctaaactttaaaaatatcatcttattatatgatttattgttttgatctctctctatatatatatataattttatttttttgagatgcagtcggagtgcagtggcatgatctcagctcactgcaacctctgcctcctgggttcaagcgatcctcctgcctcagcctcccaagtatctgggattacaggtgtacacaaccatgcctggctaatttttgtatttttttgtagagacagggtttcgccttcttgaccaggctggtctcaaactcctgacctcaggcgatcctcccacctcagcctcccaaaatgctgggattacaagcatgagccactgtgcctggcctgttttatgattttaaattacagaaaatttgtttaagatagttcagaggtcctgtgtaatgtgcccccagcttcccctaatgttaacattttatataacactagtgtgatactattaactaaactaaggaatttatttggatttcccttgtttttctaccaaaatctttttctttggtttcagaattcaaaattattatacatgtttattttagaaaacgtatgtatataaaaacataaaacaaaatacggtgatcttcctacccagagacaactactgatatttttagtatatatccctcattcctggtctcgaactcctgagctcaagggatcccccctacctcagcctcccaaagtgctaggattagaggcatgagccactgcacctcttgctttttttatacttaatattagcatttacttcttttgtgaacctcttgccatgtttgctgtttttaatacatgtagttacatagtcataggttgcttaatgacagggacatgttctgagaaatgggttgttaggcaatttcatcattgtgaacattatagagtgtacttacagaaacctagatggtatagccaactatgcaccaagactgtatggtacagcctattgctcttaggctacaaacctgtacagcatgtgactgtattgaatactgtaggcagttgtaacacagtgctcagtatttatgtatctaaatatatctaaacatagaaaaggtactgtaaaaaaaaacggtataaaagatgataaaatggttcagctatatagggtgcttaccataaatggagcttgcaggactggaagttgctctgggtgagtcagtgaatgagtggtgactgactgtgaatgcctaagacattactgtacaccactgtccactttataaatactgtacacttatgctacactaaatttatgaaaatatttttattcagtaataaattaaccttagcttactataacctttttagtttacaaacttttaaatttttttgactttttgattcttttataacatttagcttaaaacaaacacactgtacagctgtacaaaaatattttttctttatgtccttattctaaaagcttttttatatttttaaaattgatttttttctctttaaacttctgtgttaaaactaagacacagtctcaaaacaaaaacaaaaacaaaaaactaagacacaatcacaaacattagccgaggcctacaaagggtcaggatcatcagtatcgctgtctttcacctccacatcttgtcccactggaaggtctttaaggtcagtaacatgcatgcagttgtcatctcctataagagtgtcttcttctggaatacctcctaaaggacctgcctgaggtgcttcttgagaaggtgtcattctttttagaaatattgatatgtccatggtggtttgctagtattcttgaataatgtgccctgctgtgacttcactagtctacaggaatttttcatctccattatattcttatgggacgactgtatatgcagtccgtcattgactgaaatgttatgtggttcatgactgtagtttattccctatttttagatattttgttgtttccatctctttgctcagttaattcttcatgattttaagtaaaaggccaactgtgtgtgtcttctcaatcttttcccccctaacaaatgagaaatatgacactcttatcattacagtggctcaataagccagtgattctaaatgtatgtatattatgttgaacgacttgaaattgccttttttttttgtctgtagcaaattttttactattggcaattttatgtggttcaacctaatagcttgaaaaagatttctaggttattctgaccaccctgcacccctgtcccatctctcacttccctgagaatctgcatttagaatagtgagctgtttctgaagcctttggactaagcaacaatgttgacaaacttaccttccaggagtctctgataagcacaacatcctgaagacatatccttgtgttgatgacatatgcagagaactttaactatagtgacttgcatctgtgtgtcagtacggtagagatagacttctgagttttcacctaagctctgcaagagagcctgatggtcctctatcctggttccatatctgtagtgactagctaaggacagtggtgccacccagtggcacgttatagacaagctgctgatgttgctttagcactcttcactgcatcaaattctttcctttcccatccctttcccttccccttcccttcttcccttcttcccttcatccctccttccctcccttccttcctctctccctttcttcccttctctcttctctcctccttccctccctcccttcttcctttctttttgttttctttcttttctcagggtctcactctgtcgcccaggctggagtgcagtggcgtaatctcagctcactgcaccctccacctcccaggctcaagcgatcctcccacctcagcctctggagtagctgagactacagtcgtgtgccaccacggcctgcaaatttttgtacagacaaggtttccccatgttgcccaggctggtctgaaacccctgggctcacatgatccgcccacctcaacctctttagtagctgggactacaggcacatgccatggcagctggctttctttttctttcttgcatactcttccacattcatggtctcattttccttttattttccccacctatgccactggcacttacgagcttcatttcggccagctgataatattcagggacactagccatataattttgctgtgatacccttattttaataaagctttggaatataggatgtgaaatagtaagtgtaaacacactgaacacactgtcacttactctgcttatgaagtcgtggttcttacccagaattggcatcaagtttgtacttggtcagaatatggcacttcttggccaggcatggtggcttacctctgtaatcccagcactttgggaggcagaggtgggagggtcgcttgagcccagaagttttgagaccagcctgggcaagatggtgagaccctgtctctacaaaatttttaaaaatgaaccaggcatgatggcgagtgcctgtaggcccagctactcaggaggctgaggtgggaagcttgcttgatcccaggaatttgaggctgcagtgagctgcgattgtgccactgtgctacagcctgggcaacagagcaggaccccatctcttaaaaaaatgccacttctcctgttcaatgatgagactcctaatatatgagaggaggccctcctatgtatttcaaatgtggagaggcatatacttctactcagattgaaagatttatcttggaaatccttttttggtttcctttctacataatatgacttcttatttcattccaacttaattccaaaaatatttatccagcacctactgtgaaccagtactgtgctaggccccaggtattacagtagttatcaagacagacatgacctctgcctctaaggagcttagagcctagcaggggaacaggaacttagacaaatttaagtgctgtcccgtagggtactttgaggtcaaatagtagaggcacttcacgtaacataggaggtcaaggaaggctttctacacatttcatttaaatgaagacctaaagggaagcaagaaaaggcagaagagaatgttactggcaaagggaaaagcatgtgctagaagcaagcagagatgagagattaagcttgatgcttttgagaaattaaaagaggttcaagttcgtaatggctacagctgtgagatcaactcttttaagtctcatgacagtacctgtaactaataatattatcccctccatttttatggttgtggcaaatgaggaaaagatgttaaatattttgccctaggtcatccatctctagtaagtggcacagccagggattgaacccaggtcatctggctgtagcatattggctcctaactaccatactggattgcctctcagctggggcatagtcttccttagtaaatggaatggtctgtgtctggtactacctaccataaaaagagctggagcttataggatctggattagtttagaaatacaggtttgctttagtcttttattcttgattgggaatgaaatgcttcatttgatatgcaactctgaggctattgacacatattttccaaaaaaccatagatgggaaattataactggttacatgtttattacaaaaataaaattggtgtgaaatatgtatttcctgcaaggctagggtttttgtttgattgttaaagttaacttggcaatatccttttctctgatttttaaagttaggctgagtgcagtggctcatgcctgtaatcccaaccctttgggcaaccaaggccggaggatcacttgagcccagaagtttaataccagcctggttaagatagtgagatgcttactctacaaaaataaaaaaataagttagctggatgcagtggtgagtttctaagtcctagttataggaggctaaggcaggaggatcccctgagcccagaagttcaaggcagcagtgagctatgattgtgccactgtactccagcctgggtgacaaagcaagaccccatctctcaacaaaaaaaattaaaaattaaaaaataaaattagttaaagggtgaacataacttattaaataggactatacttttttaaagtcacaaatcaaatacctatacacggagatattttcttacaatgcatctgatttatcctatatctgtttaagatacaagtgtgttttttgtgagatgagaaattgacttcagtttgaagtcatcagttaaggtgttaatctagattctagaaattggattataaatgttgcacataaactaagattgtagtaatttgatatcattgaaaaacacttggaataaagagtcttgtgtgtttgtgtgattaatggtgtgcagctggtgctttcatttacttgcccgtcgtatatgactgtggattcaaacaggagtttttacttggaagtgtttttccaggagtgaaggttggcttctgctaatatacccatacattcttgccttgttctctatgggatgaaagttaggatacaactagggtcatcattaggatatttttgcaaaagaaagaggggtttgataattatgctgggacaaccacaggacagtcctcagaaagctgggaaatgtgttcacctacattttattttattttattttttgagacagagtttcactcttgttgcccaggctggagtgcaatggcgtgatcttggctcactgcaacctccgcctcccgggttcaagcgattctcctgcctcagcctcctgagtagaggggattacaggcatgcaccaccaggcccggctaattttgtgtttttagtagagacgggttttctccgtgttggtcaggctagtcttgaactaccgacctccgtgatccgcctgctgcagcctcccaaagtgctgggattacaggcgtgagccaccgcacccggcctcgccttcattttaaccagtttatctggggatcaggtttgtgactctagcttccgaagtactggctcaacccagtttagcgaaccatcagtgacagagagatttccctctactttggagtaaaagttaatttttgagaaaatattctgttgtattattatactggaattgtatgcgtagcagctgtattctttttatactttttagcattgtgaactccatgctgccagaccctgttggggttattgcaggacacatttgtagatgtgtgggccttacaggaagtgaaattacttaatgatattttaccactgctcgaaacatttcgaaagaaaaactttgagagaaagaaatgattcagccttttctgcctcctactttttgaagtcagctagtacacatttgtaatgtgatagcacagttgattggaatgtctgaagctagacaggtaagatgataccctttgaagtttgagtatttggtcccagaaccaggttgtaaagaagaaagtactgatggaaagctcacttctgaaatcccctcctttcacaggccctctgatcacccgtgtggaaagtagccctctgggtctactaatcacagacatcaaaggaatgatattcatttggttccttttgcttgagttaccttctcctggggcaggcttaatttcctgtaggggactgattctggtcagttgaaaaacattttcattatggggcagaaggttgcaagtatggcatggtacctattctatctcatgcagatataatctggcatttgagttcccatttgttttaataggataagtaagtagaactcttagctttaaagaaatttatactttcatctgtgcagaacccctcatgattgtctggctttttgatattgtctgttaacttgctattacaggttgagtatctcttatccaaaatgcctggggccagaagtgtttggattttggaatttttcaggttttggaatatttgcattatatactgactggttgagcatccctaatccaaaaatctgaaatactccaatgagaatgtcctttgtgtgtcatgttggtgctcacaacgtttcagattttggagcatttcagattttggattttcagattagggagactcagcttgtaccagtcaatttttgttagtcacgttttgacataagggacaccaaaaggatgcttagcttcagaaaacagttaaccatggtagttatagtaaggaagaaaaccctcattttatttagcttataggttatattacatgagcaaaagaagagtttattttgctttgagcctaatttaaaaaccgaagatctaacctgctttccttagtacaaataaagccaacttttagctccttttacagtattactttgccacttgagtagggctaaacaccttttggaccatattcattgttactatcaatacatagacacacattagaattaattgaaaggctggtgctatattttctactttattattaaatgataaaagtaacattcactgtagaagttttagaaaatgtagggaaattataaggataaaactaaaaataacctctacgtgggtgcagtggctcatgcctgtaatcccattactttgggaggctgaagcagatggatcgcttgagcccaggagttggagaccagcctgggcaatgtggtgaaaccctgtctctaccaaaaatacaaaaaattagcctgatgtggtggcgcatgcctgtagtcccagctactcaggaggctgaggtggaaggatggcttgagcccaagaggtcgaggctgcagtgagccaagattgcaccactggattcctgcctgggtaaccgagcaagaccttgtctcaataaaaaaaaaaatcacctgtaattctgcaacctagagattaacattttggtttatagcctacataaatttgaggaagttgatcttgagtatgaagtttcatcttaaaccaatttcacttcatatatcttaaacattttctcatactcttaaatactctggcaatgctgcatttgatggccgcatagtatttgatcacatggatacattattttaccaatcacctattgggaatttgaagttgttcctattttttttttctgttatccataccaccatgatgactgtcctctatttttttgtgtgaatctctaatgatttcctttaggataggggtccgcaactcccagaccatggaccggtactggtccatggcctgttaggagctgtgctgcacagcaggaggtgagcgacaagtgagcatttctgcctgagctccgcctctggtctctggtgcccgaaagtttgagaactgtggctttaggatattcccagaaatagaaagtgaaattacaagtgcaggaagtataactgaaggcctgttgtcacatattaccaagttattttctatttagcatgtactaatttctacttttgtcaacagtatataaagtgcctttttgtatacttttggcagcactgagtaatttctttattcttaattggcactagtttttatggacccccagtgcattgctatctgttttagtaaataaaagttattcatggcaggaattaaaataaggatgcaatattataagtagtagtactgcaaggaactggtaactccagctggtactttgagaattgtctaaacggaccatattttaactctaagggtctatgtttctaaaaatatatttttcctttctgaaatacttttatcagtctctaatgtagaggaaagtgctatttttttctcctaaagttgtaattccatatgtactttctgctcattacgttaggcatttctctgtgtgtaagacttatgtttttgccattttaaaaaacaaaaacaaaacatacattctggcaaaaattgtacaaattttgtgggaagtcttgattgttacacaagagtactttctggttaagaacacttaaggtaacaatcactttcttcaagtattgttcaggtctgtagtattttaatgaatgccttgtaaattcagattcatccatgtatcaacacacttcttgactaaacttggaaaggagagttgtggtaaggtcagtgtttgctgttatgtaatctgtttgtccaaaatatttaaaaatcagtatcgtaagattcttaattcagagtcaagaattatcagtgtgacagcaattttcatatgttgaaagttttttccccagtagttgtttcatgataatcaagctgtttcttaggtgtggacctcaaaaagtattatcagttgatttttatgactttgaaaaattctaatttaaatgcaattgatatattgagagctcataaacagaatgtgctttccctgttgatactgctgctaatttaattctaggtaactgaaggaaaaggaatggtgtgcattcttgttgttttttcatactctcacattcatcttttatctagtctcaagatgatcttaagagtaaagctgtaattataactgattagaaagaatttcctaactttagtatagagggaagcacatagggtgctttcttaatgttctagaaagcagaccctattttagcttcttagtcatggagtggggggaactgtttctttctttttaaaattattttacagttatcattgtattcaatttttaaaattcttacaacctctgtgaagaaggtaaagagtagatgaataaattttaatgtcaacctagaacttcactccataatttatttgtgttatagtaagttattttaagctagtatatacccctattcaaaagtcaagatttaaacattgttgctaaaaagtaaatggggcctggcgccatggcttacgcctgtaatcctagcactttgggaggctgagacgggtggatcacctgaggtcgggagtttgagaccagcctgaccaacatggagaaaccccgtctctactaaaaatacaaaattagccaggcatggtggtgcatgcctgtaatcctagctacacgggaggctgaggcaggagaatcgcttgaacccgggaggtggaggttgtggtgagccaagatcgtgccattgcactccagcctgggcaacaaaagcaaaactccacctctcaaaggaactttctggcatttaaaaaagctttccttggatcagatattgaaaatccctctagtgttttaatagcttctatttgtcactaaatatgaaggatgggtgggtttgtggttaaaaaaataaatagcaacaatttcccaaaaggtacatatttaaactgaatttcaaagccgagataaaaagtatggttcagaaaccggagatttcagttaagcttcaggtaaaggaagcaaataggcagaataaaccacacagacaaaatgtcaaaccaggcaatgtttgtctttgagcatcttccatttcttattttagtaggcatctcactggttccctgtgtcttttatcctgctctctgtcactggtagcagaacaagctaaacttccttaagcaaaactgtcctaagaaatgtacactgcagagacttcctaaagagagatggatggattcatttggaaacatctgtgtgcacactctaatttgtattcatttttccctagagaatgattacacctatataattaaaaagttgcctttgaaaactattggcaccaaaaatggacaataattaatgacccatccctcattttttaaaaccattttattgtggtaggattgacatacaaaaagctgtaaagatggaatgtatacaactcaatgagttcggagagaatcatcaccacaatctatgccataaacccatccatcacttccaaaagtttcctcctgccctcttatgtattgttatttgtgtgtgtgtgtgtgtgtgtgagagagagagagatgaaaacacttaaaataagatataccctattagcaaattttaaaatacacaatgcagtattgttaactataggcaccatgctgtacagtagatctctgggacttcttcatctttcataactgaaactttgtatcatttgactaataccatcctgtttctccctctacccagcccctggtcaccaccattctgctctctgcttctatgagtttgactctttttagtttccttttataaatggtgtaatgtagtatttgtccttctgtgtctagcttatttcacttagcatagtgtcctccaggtttgcccaagagaagtgtttcttttttagagacaagctcattatctttactttaaagcctattttggttctgagagtctacaacttggtatgtaaggagtgaaatttgtgtgcttgcagttcattaggcacttgatagatctacatcgtatttatatatcttcatactaatcatgggggagaatttatgtaacaaaatgaatgatagaattattagctaagattggactatttctcttggcattcaaactagactctgtctttgagtttagatgaagagaatgggtctaagataaataagcattgcttatttgctgtaatgtttaccttatttaagtaagaaaaataaaaataaacattgcttcaaaatggataaagtgaaaactatcagaatactgcatatttatctatgcaaggaaatatgactgttgtcatggatatgcagtttggtatctcaagcaagaaggtatcagagaatgtgaatatggcatagtttataagatctgtgacctaataatcatacttctaagaaatgcgagggaataattttatagtcttgaagtgggaaaatgacccagaagccataaaggagatatattttactacttaaaactaaaaaacaaacagccaacaacaacaaaaaaaccccacaatatttatctaatatgtctaagaaattcagacatagtgaatttttttttttttatttgagatggagtctcgctctgcagtggtgcaatctcggctcactgcaacctccacctcccagattcaaccaattctcctgcctcagcctcccgaatagctgggattacaggtgcctgccaccacacctggctaatgtttgtatttttgctagagacagggtttcaccatgttggccaggctgacctcgaactcctgacctcaagtgttctgcccacctcgacctcccaaagtgttgggattacaggcgtgagccaccatacccagccagtgaaatattttcatatgttcattagctaatagtgaaaagcaaaaaattaagacagtgtttttggtatctatcaaacagttcaatccagtattggaggagatatggggaaatgggcatattaatatactgccggtgggaatatgaaactatattcttttttagagggcatttttacttttttaaaaaaaataaattttagactcacaatagagttgcaaaaatcatacaccatttccatgggtcctttacccaatttcccctaatgttaacatgttacacgattatagtacaattataaaaactaaaaatgttcctaatctgggttaatctaatgttttttcatgatttgattgagattatgcagtttgggcaagaataccacaaaaatgatgctgtgttcttctcagtgaatcaaactagggcttacatgatatagatgtaccttatactggtgatggtaactctgatcacctagttaagatggtatcagctgtgtttttccacagtaatgttatcattttcccctttgcaatgaagtaatatccacacactttttattaatacatatttgggggagatactttgagacaatgtaatgtccagtttcagcttttgctcaccagcattagcattcactgatggattttgcctgtagtaattattcctgtggtgttctaatggagatttctatttcctttattccttctacatttattagaattcttctatgaggaagattagtctcttctccctcatttacttatttgatcgttcatttatattagtatggactcgtgggtattattttactctgtgggatataatctagtattattgttatttgttgcccagattgtgttaataccagctgtggccattgggaactctttttgggttggcccctgtgtccttttcacatgtctccatttaaaaaaattcagcacttttttattccttggcaccagataacactaacctcatcttgaatatttcctgcctcagccccgtaatcaactgctccaaagagctctggttctttttcttggagaatagtatttggaacaagatctgtgtgctggatatgctcattgctattggggtatcactgcttctaggcctggagggcaatttttaatagactaaatataaaatgatcatacccttttgaatcagcagttctgctagatataaatcctctagaatcactagcataagtatattgatagggatgttcattctgatctttcaaatgatcagaaattagaaaaaccccaaatgtctaccaacagagaatatgggttaacttaattgtgatatggtcatgcaatcaatggaatgccttggaatggttaaaaaatagatctatgtattctgccatggaaagacatgtaagagagtcagtttgttttttgtttttgtttttgttttttttgagacagaggtttgccattgtcgcccaggctggagtgcaatgatgcaatcttggctcactgcaacctccgcctcccgggtttgagtgattctcctgcttcagcctcccgagtagctgggattacaggcgtccaccaccacgcttgactgattttgtttttgtatttttagtagagatggggtttcaccatgttggccaggctggtctcgaactcctgacctcaggtgatccacccacctcggcctcccaaagtgttgggattacaggcggtgaagccacccacgccatgggcccagttttttttttttttttttaaagcaagttgcagacatgtaatagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggtgtgcgccaccacacctggctaatttttgtatttttagtagagacagggtttcaccatgttggtcaggctggtctcgaactcctgacctcatgatccgcccgcctcagcctcccaaagtgctgggattataggcatgagccaccgtgcccagccctgaatatttttaaaaaactttttaaaaaagttatctaacttttccatgaagcaacatatctagttcattctgtacattgcacaggctagactttgggtagttgtacttatgttataacatttatttaatatgttttaatatttacgaatcaagtgactcaatcttatgaccacttagttctcctgtgctacacattcacatatattcttttttttttttttttatgagacagagtctcactctgtcacccaggctggagtgcagtgatgcaatcgtggctcactgcagcctccgtctcccggtttcaagtaattctcatgtctcagccttccgagtagctggggttacaggcgtgcaccgtggtgcccggctaatttatttttgttatttctagtggagaggtggtttttcaccatgttggccaggctggtcttgaactcctgacctcaggtgatctgcccgctttggcctcccagagtgcttggattgcaggcgtgagccaccgtgcccgactacattcacatatattcttttttttttttttttttttttttgagacggagtctcactcagtcgcccaggctggagtgcagtggtgtgatctcagctcactgcaacctctgcctcccgggttcaagtagttctcctgcctcagcctcctgagtagctaggattacaggcatccaccaccacgcctggctaatttttgtatttttagtagcgatagggtttcaccatgttggtcaggctgttctcgaccttgtgatctgcccccctcagcctccgatagtgctgggattacaggcgtgagccactgcgtctggctcacatatattcttaaggggaaaagattctcccacagcttagcgtgtgagtgataccttccagtagtttgactggcttacgacagttttttagtactgtttttaatgagacattttcttgttcctttatgatttttaaaataaattttaagtacacaatttttatttttgaaaattttggaagacactaaatcagcaggaaaaaaacccaaaatatatgcaaatattaaaacaattcacctctaatcctaccacccagcaataactgttagtatttgaagtacattttgctaatttttctatgaatatgtaacactcaaatatatgtacatatttagaatgcagtcatacatactgtttttgacctgtatttcttgataacaacatttctaaacattgaaatgtattttagtatggcagttttaatctactattaaccaatatgtgatttatgtatacttatctaaaataagacctatcaaggaccattgtttagggaattgttttgaaaaggacttggccagaatttacttttagatttgaacattaaatgctaaaaactttcttaatgtttttctttttgtttttgagaccgagtctcactctatcacccaggctggagtgcggtggcatgatcttgactcccgggttcaagtgattctcctgccgcagcctcccccgtagctgggttaataggcatgcaccaccacacccagctaatttttgtatttttagtagagatggggtttcgccatgttggccacgctggtctcaaactcttgaactcaggtcatctgctcacctcagcctcccaaagtactgggataataggcatgagccaccgcacctggccaaaagctttcttaatatttttccactgttttctgaaacattctattttaaacttattaagatcgatttttgagacattaagtccaggacgatgattcttcgtgcttgaaacatttccaacagatgctatcacaagtttagtatggactttacttgtggaagaatgttttcaaaatattgcttaacagaccaacttatttgcagagagggctagagccaaacacattaatgatttgttttaaagtctgtccccaaatatgagggttgtctgaaattgaatgacactgccttgtattcgtatcagtttttactttttttatatcactttttgctctcctattagctgcgtggactttgttttgctcactggcatttggtgagttgggctttctcagtgctgccttcttttctaattgtaagatgataaacccttgatgctgtattatctcttttttctttttttaatgccaccaggttactgttaggtcaaaacaaacaatattatatgcttcagtctgttaaaaatttgctaggctaacactttctaactttcttatattagaaaaaaaccttgcatatatctgaagtgaaagagtctaaagtttgttttacaattttagctaaatcatcccaattcctgatcatctataaatgcaacccacatggtggtaatctgcttagttttttatattaaattatttcttcaatttattttaatataatgactttaacagggagatgctattttgtaggaggagactaggagagaagagagtgcaggatcagtttttctgttgtgtagaagtaaattaggctaggttacaaaatgtgatttggtttccttttctttgctgggtagctgctactttcatttttttgtgatgaaagaaatggcttttaaggtgataggcattgagaaaaattacttccttcacattagagaacctctgagagttgcttctcctgctcagccaatttggggctacaagaatggagacgagtagaaggtttaagctggggctctcatccagcttggagaattccctgacactctctagtaccaagggtcaagagttgactatcctttgcaaatatttatttatggagttattttccaaattaagcaaactagcggatagttttgtattttcccctatccctctcccctgcaacttctacctttagatctttagatgattttatagaaggatgggtttttttttttggtcatttttaagttactggaattatctatgggggaaatgtgtacgtttttatatagaaatatgaagattttcttctccagcattctccttgtgagctctttggatcttattttaatatctatatgcaagttccccgcgcccccccccccatgtcaatagcaaatgttagccttctggaagaaaaataagaacatatgaaataacctgacttctgtttataagtaatcttaaccatttgtgttaagacatatactgatactgtccctggtaacccctcaacaaaagtagattgtggatattaacataaagttgaaagtagttcactattattaactagcctttgttagtaataggcttggatataaatcattctttccttcatctctttaatggtagcaaagagaaaattaactgtatgaattaacaccagctagttagtgtgatgattacagttatgtggatgttcgtttatatgacttccatgggggcgtctagactaaaaaaaaccaacaaaacaaaaaactcgaagggttattctcataatcatatgcaagtagtagtgaatactgctggatggaataaagcctcagttcttcagaatatagcatcatgcccagggggccccagctctgtagaaagcaatatcaaattactgaaaggccttattttattattccaagtattcagatggtaactagtttactcctgcattgtccaaaataggtcaaaccctcaaccctaaactgacaaacatttctggtgtatatatttttttctttttcttttttcttttctttttttctttcttgtttttttagacagggtctcactctggttgcacaggctggagtgcagtggtgcaatcttggctcattgcagccttgacctcccagactctggtgatcctctcacttcagcctcctgagtagttgggactacaggcatgcaccaccatgttcggctaattttttgtatttttagtagagatggggttttgccatttttcctagactggttttgaactcctggattcaaggtatctgcctgccttggtctcccagggtgctgggattacaggcatgagtcaccattacctggtccttttggtgtatatcttgaaaaatgtcacaaaaatgatgtgtttacaaattgaaaaaagatggaaatatatttaggtttctacctagaccagtgtcatatttgtatttgggaagaaacctcgtgttgtttcaaggaacttactcgtttttggttttgatgggaggatagatgcctacagtcatctgtgtgtggggatggctgtcttgtgtgactgactagtttgctgtggtcagacattgtctctgtgtctgaacatggctttggtcctgaccatgggggattcagagatacaaataaaacagttaagaacatggctcttgcttcttgtcatttttccatagagtttcaactactgtcacttagattctggctcagttactttctgagatcctaagagcactaattctagtcagacactcatctctagtcatttcttgcttttcctttagtacctggcttatgagctaaggtgcacagataatgtgaacaagcactcgatatttcttttaaaggggcacttttcttatgtcactgtactcataaatgctgtctcttactgcagattgaaatcacagaagatattcgtgttcttcttaagagaaaaagaggacatttgtaagtatttgtcctttagaaattctaaatgtgtaattttattagctttttgagaaaattaagttcccacactaacaggcatcttgaccctttttatagaggaaaaactctaccaatatttatgattgtgtttaaaaaggcagtattttatagagcaaaataggaaaacattttaccctgtgcagcttctaaaatttaaaccatttgccactcatttgtaaaagaacaagtggtaattaaaattcaaacaacgtctttctatttgagtcatacccaaaactggagtcagggattggagttctggttctgactactgaggcttatagaatatgtgtctttggtaaactacttagtctctcattatctcagtttccttatctttaaaatgggtttaacagtaagtgcacaatcaggggttcattattattattattattgttgttgttgagacagagtctcgctctgtcttccaggcttgagtgtagtggcgccatctcagctcactgcaacctccacctccgcctcccgctcctgagtagttgggattacaggcacgtgccaccgcgcccagctatttttttgtatttttagtagagacggggtttcatcatgttgcccaggctggtcttgaactcctggcctcaagttattctcccgcctcggccttccaaagtgctggattacaggcgtgagccaccgcgcccgtcctcagtggttcattattattgatggagttaaatccatagcagtttatgcttgccccgatacgttgaagcttattctttttttttttttgccccaagatggagtcttgctctgtcacccagactggagtgcagtggtgtgatctcggctcactgcaacctctgcctcccgggtttaagcaattctcctgccttagcctcctgaatagctgggattataggtgcccgccatggcgcctggctaacttttgtatttttactagagaaggggtttcaccatgttggccaggctggtctcaaactcctgacctcgtgattctcccaccttggcctcccaaagtgctgggattacaggcatgagccaccataccagcctgaagcttattctttgagagacagccacaatgtatacttgtgccgaagcttattgaagaataagcttcaatgtatcggggcaagtatacattgaggctgtctctcaaactgatttgcgtgtatttctgatcttcataaatttttaagtatatatttcattgaggcatctattctagactacaatatggagtaaaagaaatacaacagagcacctaaaattaaaatcatagtgtttgaggcttggactttgaaatttacctagtcctatagtccccgattgttgatttttagaccagtgctggttagtgaaaacgtttttactggtccatggtgaagtgagaaaaataaggacagcagatcatgagtttttaaaagctaaacattttcagtttaaaggattgcttcttatagaatatatctttctaatttaggggaattaaacatgttatttatctcatgaaattatggtgatagtaaatggtagggctttaaaaaaattcatgcctggcaaaacaacaacaacaacttggtagctctgtgtcatttccccccactaattctttcttttacattttttgctgttttgtgatatcttaaaatatgaacccaactttctcattttacagatgaggaaacagacattgagaggttaatttgttccaggtcttaccactcagcagcttgtgaaccaggactaaaaccctatatctgatactgtctctctagaacttctggtcttctgaaaattgctttcattataataggttataaatttgaaactgaagatatagtagttcttatgtgctaataactatttttgatttccaagtataaagaaattcaaaaggccatgtttttgtatagctaaatgctgaagtccactgattagcctgcattagaagaatcttaaacatggccaaagatttgtatcagcagatcagaattagctgtcaccgaattcagctacttaggtgttacacgctacccagtggctgacaaagaagttaaaatatcagcaaaattattatttccttttggaagttgacagactatactgccactgtgaagagtggtagtattcaaacttctatagttaatttaactacagaaagtactgttttctctctcatagatgcacacctacacacacacacatacatatttatagcaatcaatctgcagcccatctagatttggaagggaaaaaactaccaaggtgaagagtaggagttaccagaagcactggcatgaacatatctggccagttgtgttcaggagattgcagatagtactctgtgacactttggaggccccccatcaattgcctttgtctgaactttcccaaaatatgtttcaaaatggaaataattagctcccttatcacccttgtcttactcatcttactgaagcataagccagataaacaaatgaatgtggagggagagaacagaatggaatgtattcccaatcctaatgtggaaatattaactccaggggtacttttccatggcttcttatatttggctttgtgtgacttccttctttaggtaggaattctttaatttctgaaatgtcagacatactcaaaatgaaatgctaataaggataaaatgcatttttgaattatctgctgtctttagaatatgtggccttctgttctttactacggctaatatgtgagcattgactatatggccataagatttcaatattcaacagatttatcagtctttgagttatttaattagaatcacttctaagatctatttaatactgaaaagcagaatgagtttttttttttttaaatcacgatacaattttgtattatggtggtcaggcagctgaattatagtcatttatttggccattttataagaaatggtttaagactgcattgttgcataatttattaacagtctgacatattgaaaagaacattgacaaactaacctattaagctggttcctcctctggcagatggggagggcagatcatgtggcaaaaaaaggcatagttgtaaaattctccctgtaacatgaatctattcctatgggaactactactgctgcttaaagacttttttggaacctacactcatggttgaaagccctaagttgtattactttattataataaatatgtaagatgacaggagatagatgtataacctatagatattttgtatattcttcacttgaacaaaacacatttattataaaagttaactttaaagttaaattctataacccaattatttttggttaacttatgttaaaatcatctatatatcccaacagagaaaaagcacccagtaaatcgaagactttgtagataaaataaaagtctgcactgtggtacaatgggcagtttaatttagcagcaaggttttgtgtacagggacctgcagcagttactctttagcatcagttgtacaacattgacattgtcattgtgctgtctgctgcccttctacagcaatgaaccatttgtattgctctctaaacacatatcacccagaacttagtttttctccctttttcattatgtttaataaagtttgattatagcatcatgcttagccagtaggtgccacttctagcctgatttatcctcaagattccttaaatgtaagctttggattatttacaaccaattattggattaaattatatacaaccaattcccagctttagaaagctacatttttaaaaatcaagtgtatcttgatcacttaaaatgaggaatagatgtataattatacacagtgtatgtgaagtgtgtaggcatcaacattgactcctagagctcctcattttaacatacatagataggatactgattataacatcctatgacctagcaacaacattatctgatgcatgctggggatcttcttaaggcatgatgggagggaattcactctagagcattaaaagtgtcttcaacatggcagctgaggtgctttctttgctgggaaaagctgcaaagagactggcagaatggcgacttcaggagttaatacctctccaggtgatgaagtaaacaggttcagtttatcttgtgagagacgcacccaaagatcagtcataattgtgaaaagctttcagtcatactagccaggcacaggtgtaatgtgttggtatatggcatctctatagtcatcttaggttttgttttgcttttcttggttttaaaatgtatttattataattactgtatatttgagcttaaggtttgattgcacaagttatttgatattgaatagactgcttgttatttgcaatataacaatttgaatcagatgagacaagtgccgtaatgatacatatattttacatgattatttcgtcttgcagactgatgaaagatcttgttagaactcttaatgcttttattttcttaatgtattggcattctctaagttttaatgttaaagtataaagttaattgtaatgtctcttgtaaagtttgatttcatttacaaagtgaaaccattctgactcaacctagttgagctttctctggtatgttttacaatcatttggaagtttttaatagtgtatgaaagaaaataagattttaaggaagcactccacccctttacaaaagtccttgtgatgcaacatgtatttagaaatatgatcttttaaagtacagcaggtattcttatcggtttaatctcttggaacttttataattgttttctgatttaatgtttactagttacaactaatctttttcagaaggcaaattgtctctttatttggtgcttaaattactcttaaataatgtgtaacttgaaaatgagacttctaaaaaagtagcacttatatagttaattgttgattttcaaattgatttaaaaactatttttgtaagatcttatgtcaaggacaaagttaatttgtcactactgtatgtttcaacttggcagatgcatggatccttgcttggtttagttcattttctaaaacttttgaaaaaatatcttggcattaaccaactgcagttcagtagtttttctctttcattctcaaattggtgttgtgtcacatgcttctgggtaagacgatttcttcttttaaattcagactttaattaatatgtagtgtttgtttactttgtgtactagagcttaatgtatcactaatgctttctgtatttaacctatctcggagtgtttgaagtaactggaatgaaatacttattaaatctcacctcagaacaaaaaaataaaataaaattgaatctgatttttcactaaaacttctagtacttactggacatctatagaggccccccccccctaaaatgtcttaggatgtaggacagattagtgctcaaaattgttgccagtatttcttcatacccaaagtttgtcactctcacttatttagattataccagtattactaggatcacagataattgagctaaaaacatggactttaaaatcaaagcgacctggttcgaatctctactcagctgtgctatcttgggcaacttaatctctctgagtctgttatatctttaaaatgaaggtactacctcaaaggagttttctgaaggattaaatgagataatatatctgaaggacttagcacagtatctagcctgtagtaaatgctcaatacctggttattactatgattcccatatggaatggtaaagttcaacaggagcaattaactatccaatgactgaagataatgccctgcctttttctggctgacatacaaatacatgatttcaaggaagcaccactcaaagttcatgtcctcctaatgatgggatagcagtatcattcttcatacatggaaggacagcatacctttgtgaaaattatcagtgaaaatgcacatagtgcaaattgtgtaaccttcatgcttttataacaccaatcttttccaactctatgcaacaggcagtttttccagtttcatattttctattaagcaactaacaacatgttcaagtttattttaattaccagggattttaagagtatagtatttcctaggatgttgacatggacaagtgattgttttttaagatgattaaagttagctaccttcacgttattgtacttgcatatatttttaccttatagattcagaataattccagtacattcttaattcagtaaacaatttgattgaagccaacacacggaggcactgttccagtcacagattcagcagcaaatgagacaaactctctgccttgtgaagcttatattctactgggagcatagacagtaaacatgaaaaataaaacatggtatattagtaaaagtactcaggaaaaaaataacgcaagtaagggatagaaagtgtggggagtacaattttaaaagaagttggctggagaaatgcctcactgagaaggtgttctttgagtaaagaaaaaaaaagaggcaagagaataagctacgtagatgtcttggaagaacattccaggcagagagaacctcaagtacaaaggccatggggcaggaacaaatgggactgcagaagaatgttccagggaaagcgtactaggaggtgaagtcagaaccttggggtaggggaaagactatatagtcttgtaggttgtagtaaggacttcagcttatattctgggtgagtcatatgggaattctttgaaagattttgagcagaggaatggtatgatctaacttacattttgagaatagtactctggcttctgagtttagaatttattgtaggggtatgagatggaagcagggagactagattggctatcccatttatccacatgagagatgatattggcttaaaccaggatggtaacagtggaggtggtaagaagtagttgaattagattcaccttttttgtaagtcaaaccattaggatttgctggtgaattgcctgtggaatgtgtgagaaagagaggggggtaaaagggtgaatctaaggtttttggtcaaagcaagtggaatatatagagatgggcaagactgggtgagataggattgtggaaggatgatctcagttttgaacatgctaagtttgaggtatttaactgacacctaagtggatctgttgaggaaacagttggatatacaaatctagtgtttaaggcagacttccaggcttgaaggaaaaatttggaagtcatcacgacatatatgtggtatttaaaattgtgaggttcaaggaccaagccccataccatttagaggccaggaatgtgaggaagaagcagaaaaaaaaaaaaagactgaaaaggaatagccagggaagtaggaagaaaacctgaagaatatggtttcctggaagctaagtgaagaagtttaaagcagaagagggctcagctgtgttaaaggctgccagtgggtcaaggaagaagagaactgagctttaattgacctttggatctaatagcatggaagtcattggagaccctgatgaggagaacaagtttatagagtggtaggagacataagcctgattgtagtgggttcaagagaaaataggagagaactgggagacagagagccatagacacctctttcaaggagtgccaaagagatagaaaataaatgggctatagctgaaaagaagatgcaaaggagggaatgttttttaagatgaaagaaataacagctggttatgatgctgaagggaatagttcagaagagcagggaaaattaatgaggaaggacgagagggaagaattggtagagtagcacttccgtgtccttataaagacagggtgtaatgcataaatgaaggggttggcctcagcttggagcatcaacagttcatccatagtcacaggagagaaaacagcatgtggccacagatttgattaggtgggtagatgtagcagtgagagtctgtggaaattatctttggattgttgctgttttgtctgcaaaataggtcagctgctgagaataagtctggatgaggaatgttggtggtctgaagagagtaaagtatgaaatccagaggagtgggccagtgagtggactagtgcggtgtggtctctctgcatcagggagagtccatttgaggtagcaatcacaagtttaaagtgagacactcaacacagtcatgtgtttctcacagcaaattcagctgcataggtacaggtacagattaggtggagaattggataggatagaaccaggctgtggttgagatgattaagtacaaccaagtgagacaaccaagagggactgagtatgattgcctatggaatttaagaggaagaagacaaaggtttctcacaaaagcactataaagtaggtaatataagcagtattcctgttttacagatgaagccactaatatagagctttcttttttaaatcatactttaaattctgggatacatgtgcagaacgtgcaggtttgttacataggtatacacgtgccatggtggtttgctgcacccatcaacccatcatctacgttaggtatttctcctaatgctatccctcccctagccctccatcccctgacaggcccctgtgtgtgatgtaaccctccctgtgtccatgttttctcattgttcaacttccacttgtgagtaagaacatgcagtgttaagttttctgttcctgtgttagtttgctgagaatgatggtttccagcttcatccatctccatgcaaaggacatgaactcattgttttttatggctgcatagaaccacattttaaacccagatctgttagcctagaaaatttttgttgtttctcttatgagacattatattttgcctaatgatgggtacgatgctcagcatcatacccttaccaccaactcttctttttttgaagtgaaatgaaatgtttaaatcttttttgaaatgaatttatcaatagactgagtataacccctgacaaggaagtattatagtttaagatgataggcaaaactgggcagaggctggctagtgtacttgaaagagcactgggtgctcgatttgtgctctgccattcatttgcttctctgtaagatgagggctcagacaatatcagtggttcaaatattcagctgaactggaagttccaaggagtcccttcaggggctgtcatagcctcctctaccagagcagctatgctttttgctttcatctacgcttgtgtttttatatctatataagattttattcaaatggatgacccatgaccccctcactacctgcagaaagaatttgaaaacctctagactaaatgatctctctggtttcttctcacctgaatgttctttgagccttgcctactgtgtgtgtgtgtgtgtgtgtgtgtgtgtgcatgcgtgtgtgtgtgtctgtactaagcactatgaggattacctagaaagcatttctctttctctaagacttaaggcaaatatgtataaaagattaaatttatgtaacatcaataactaaaaaacatacaatgcattttaaatccaactaaagtacaggctcttcaaaagctattttctgtttctttatatattttcagccttaagcctgaagatttctcaattgagggtaaggtggtactcaccccttaggggcattttataaatctgaagacatgcttttatgtctgctaatattgtctctgagaatgtatgtattgaaacaagtattttgttaaattttaaattagtttctttatggtactcttttatattaccagtaagaaatcattttttaaaatggtgtgttggtagattatgactatcctttgatgttgatgaagaggtatcacaaaatatttgtcataagaaagaggtactgggtttgatatggttgagaactactggtccgtgttctatactgtggtacccagaagtttggaagtgatggtagtataatcatgtatcagattgagtggtagatattgctaatgatgtgtgaaattagaaaaagtaaagattgttctggacttgggtagccatgaaatcttcagtgggaggagaggattgttagaggggatcttacattcagcattatgataaacccttgacatgacataccttatcttgaagaaatgaatgaccagacttgtccgagagactaagaaggtactttccaagtagggtaagtcatagaatttaaagctggaaaggccctaagaatcacctaggccagacatttttagttcagggttgttgccctttgaagttcatggatggatttcaaggaacttgtgaatcacttgacattgtgtgtatcatttagcatgtctttctgaggggaattgggttcctcgttctcattctcaaaaaggcccatcatctctaagaggttaaggcctgctgatctagtgtggtcccagactgaggtagatggtttgctcaaggttacacagccagttaggggcagagatgaggattgacacccagtgacttccagtttctttctcatttcactgtactcaactaaattacatgaacaaaggcacaggcaggattaagctaccattttatattagatggtataaaaacaatcaactagcctggggtcaattgaattaagtctgtcagtctgtttctacaaaagttgcagaaggatgggcttcagtttgtctcttcaaagtgaactaatattttgatttttctggttgaaatatgctacaactcaccgaagtagctttctcagttgaaggtaagctccttaaaaaatgttcctattcttgggccgggtgtggtggcccccgcctgtaatcccagcactttgggaggccattgagggcagatagcttgagtccaggattttgagaacagcctgagcaacaatggcaaaaccccgtctctacaaaaaatggaaaaaaactagccaggcatggtgatgcacatctgtgttcccagctactcgggaggctgaggtgggaggatcttttgagtccgggaggcagaggttgcagtgagctgagatcatgccactgcactctggcccgtgtgacaaagtgagaccttgtctcaaaaaaaaaaaaaaaaaaaaaagaaagaaaagaaatattactattcttgagcctgtttctgcggtttctttccaatggcactgtttttctaacctgcagcagcccccagctttccacataatccaatcaaaattactttgcctgatttgttagattttgtaactaccgtagcgtatttagtcaagcgtatttagcgtatttagtgtatgctgtgccccagtcagactagtgtccttgctattggtacttcctattctcccaaagtcctttcattcccaccttcgtatcttttttcatatggtccctgagcctggaataccttccattcctctttcatttctagatgcccaacataaggtccagcttaaatctaatctccacaaagcctctcctagttactcttggccattttgcacttcctctgaactccttttgcatttattgcttatactactgcctacactgcacatggtagttatgtattagttatgtattaccacaaggcttttcagtggaaatgctttagtggtcaccttgggagttgggattccgggaattctggggcaggactctggacatccccaaaccctgttttggccagagcaactccactttagtgttatatatgggcagtttccagtagtgtttattagaagagatggtttaattgcaccccctgtccccgttcccccaaacagttgcaaaaatactggatctatcttgtgtgatagttgactcataagtgttaacttataatggccaagggccaggaattaatactacttcagacttgtattaccactcctaggcaactggtgcagttttgagcacaaagtggacatgtaggaaatgattttacaattgtattgctcccatgtgggaaatagtagatagtaaatagcattacctgagaaatttaccttaatgaagaactcagaataaggtttctgggttgacctttgagaaataaatctaagttgatagtttctgccccacccccccctttggatataaacctaacactatttaaagatgtctagtttacatgcacatgtttaagagaaatcttattattggcataccctattctaccaaagttttgacaaacttaaatatcatattcatgcatttgtgtaagcattaaggttgttattcaactcacagaatgatatgcagagtaccagtacacctagaaacctagaaaaaaataaattcagaagttgatgtgctcaaagacatttacgtcaataatgattacaaatggaaaatgccagcctttcagaccagttatttcagctttctgtaattaattgtgtaaactaataaagacctgagtatttaaatcaattgtgctatcaacttgttaatattcttttgtttttgttttttgttttttgtttttatttttcctgctctctgcttggttcattgtcatcacctacaggcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagctaaatgtgctcaccattattttgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaaggtaaagtattttggtgcttttcatttatgttttaaagaggaagacacatttgttttatcataaatcgagtgcgttttaagtatgctggcattctattatagtgctgtgtaaaactactcagaagccgctcatagcttctgtatgttcatttaagagcatttttagagttttatgctttggatagtattttaattgcttgtttgaatatactaatattagagaatgtatcactttaacagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcgtaagtgccttgtgtttttggaggggggagaggagggtctttgcttgcatgtgagaattgttttgagatgctcttgttttcacagtaggtgttgtttagccattttacacattaattatgtccataatacggcatgtaatattgtggctaaaagatatccgatgactcctgttaagtatggtaacttgtaagaactaatatgggaattggcagctttaagggatgtgatttacacttttattttccaattggaaatgaattgtaactgaaagagttggagtttgggggtattttgggggggtgatatacaaagagtaatgattaaaagaacaaaaaaccatttctcaggataattcaaattcattgcttcactttgagacctcttatttgacttattctattttacgtgtgaaatatgcatgtgacagctggaattggcattagatatgttagaaagtaaaattgagtatatttctaatactcaagcatttgttgttgccattgtttaagaaataaacaatgtattgtcacatactaagtactctgttgtttgttgaatgaaatataacactgtaagttaggattatagagcttaaatttcaaacaaaaaatagataatatgaaaatgatcccctatgtacccattacccactttcaacgatgaacagcttgtgaaagtggctatttttaaccacattgtttctggttaccaatctagagctgaattttcagttctttctaagtttagcagatgtcctttgattctaactgatcttggtttatgttatctctggtggctcctaaggagtagatctccttgatctctctaattaaggtgtggaggtcaccaatcacattggacattggactcactaaaacagcttcttagaaggagtaagaacattatctgtggctgatcttatgacttaagatcctcaagattttcaaggacttatccattctttggaggctatggccaatgaaagtgtgtatcaagaagaagccctagctgggccagtctgacctgaattaagagttcagccagtacctattggccttgagcatctaaattgacagatttttgatcagctgtggcagtgcgagtgtttctgggtttcttcaggtttaggaagtgagagttctgggaatttgtaaggaaaactttgggctcccagggagtttgaagcaaggttgaaggatggtaacagagactatgaaatcaaattaaaatatacaatgtctttgtgtctctaagtgtaactattattaaagactgacttcaataatatccatttctaatagatgtttattacttaatatttgtgtttatttttattatgtagttgtgactttatatgccacacttggcaaagaagcagtagttcatgggctaaatgaatctgaggcttcctatctgattaccagtgttgaacttctggaaagtaaacttaaggtaaatatgaaattttcttttaattcatggttgcgttgtctggcaggacagaaaaatattcattcagtaagtgaatttttgttgcaggcttaagtttaatagctgtttttttttctttctgctcaacagactgcattgttagatatcagttgtgttaaacatatcatttatgtggacaataaggctatcaataaagcagagtaccctgaaggatttgagattcacagcatgcaatcagtagaagagttgggatctaacccagaaaactgtaagtaaagcagtaaaaacaattttatttacctattccaagtttgttattttggtaggttagggaaacaaatgacatgagtaaatccacaaaagttctttgactgaaaaaaaaaagttcaaaatctttaaaaaccatcaagaccatatatgattaagattttccctccatttctcctcaaaaaaaataagttagtaaatttcactaagtggttgagatgtaatctgtggttcagacttcatggcagttgctgccaaatgtttcttcattttttaaataacccactataaccttccaatttgggcctcataaaagaaaaatatttcaggccttccattcagtaaactttctgaaataaatgcttaatgctagttatcttaaggatgtttcagaggatgcaaagctgtttaccaagattaatgcttggatttattttaccactgaggtggtagttggtatttcatttgaaacaagtaagtgtaccttgtagcaaaatgtcagttggccatcagggcagagagttgaggaaattaatactccatttgaagagttttcttattatgtttaatgcgatggtcaaaataccatactataatgagaaaaggattcatttttgcaggagaaaatgttggtcgaacctctactcagcttctgaacattttaccattagagaatgagcatgcgtttataataacaggtgttattatacacatctgccatgtgtccagaatggcagagagtcagattttaccctgcttgccggcaaacagatgagcctgcaaaacttcctggtgccatagacttttgggtctgagatgagggacagttttttactcacaacaatagcagtagccagagtatcatatcagcatttgtgtcataagagaggaactctgagcttaaagagcctgaatatcttattatcttattgtactggacagtaagcatgcctgctgtttgctctggggagagacactatctctgtgcaaatatccttgtaaagatagtctggaacaaagtcaatgtctctgcttgcaagatgtgcagaacatgagacccatagagaattgtttttctacactaggttgaccctgtaagattgggataaacttgactgagaagtcctgattggtagggatcagttacagttctgctgattgaccacaaagggtgttggcagcaagctaaggggtcagcagtcttcataattttgtgtgagcaataatgtaataggccacatatcccacttagttctactcatgtctgcaatagataggatacatatgtttttgtggtacagacagttattgtgatgccacttttttgcatatttacttaaaagtgggcagaagcaaagtatcacatgtgcttagattaagaagaatttagctactgctgttgctttggttaatcatcagaggaaatatgcagtccttatttgcttggtttataaactatgactatatctttaaaaagcattaaaattagccagtttaagtgtaactatctttgtttcagtggtatagctcactgttttaaaaaaatgttattttaactggtatataaaaatgtaaataatttgtgtaaagatttttaaatgtgataatcctgttaaacttgtatttcattctgatgatatatatgtggcttcttagccattttggtatattctcggaaggaaaagtggttactaggctagcactatacactgtcttgaaagtggaagctccagggttctgtttaaaacttatcaccttcaaatgttagcattgaagtcaccttaaagatcagatccagtggttttcaatcaggggcatatatgagaatcacttgtggagctttgttctatcccagacatattgaatctgaattttcagaaagggggttcagaaataatattttatttaagttctgcacgtgattctgatacccactagtggttagtaaccacaatctgtccagctgtcttattttagagatgagaaactgaggcctaagaagtttatacacatactctgtcctcctgatactccaaagtcccagaaatctttccacaacattgctctgtatacaacactgtggagaggcaatgcacagacagagattaggttaaacatccagaaaatgggccaaattgagtccaaaatgctcactgtaatcagaatttgataaacatttttgttttctagcccaggctggagcacaatggtatgaccatagctcaccatagcctcaaccttctaggctcacccagtcctcctgccttatcttcttgagtagcaaggactgcaggtgcatgccactgcatccggctaacttttttagtttttgtagcgacagagtcttgccatgttggccaggctggtctcgaaatccagggctcaagtgatcctcccaccttggcctctcaaagtactaggattacaggcatgagccacctcacccagctcgttttgatgatttaaagcaaatactgtctattgatagcttatcgttatgcaaaatctaaatatcctattattctttagtaatttaacttttgaactgaagtaaatgtgatatttttcattcattcatttagtgggcattcctccaagtagaccaacgccttcagacatggccattgttatgtatactagtggttctactggccgacctaagggagtgatgatgcatcatagcaatttgatagctggaatgacaggccagtgtgaaagaatacctggactggggtaagataattctttaactttcttcttagaaatcagagttcatgttcagcattctctaaactcaatctatattaaaatgataaagctcttggtatttctaacttcaaatgccttttcaagaatggttaaaatatttctcttattttgttttagaccgaaggacacatatattggctacttgcctttggctcatgtgctagaactgacagcagagatatcttgctttacctatggctgcaggattggatattcttctccgcttacactctctgaccaggtgacaaacttttcagtatattggcatgatcgtatgatgctgcatggtttggctgagaacatattactaggactcgagatattttaattcagctaaagctttctccttgacctcaaaatagcttccatgaacaatatgtagctataggagattaccctgtagatttgttagcattgctttagctatatattttaaaattattttttttttcttttcttttgctctgtcacccagactggagtgcaatggtatgatcttggctcactgcaacctttgcctctcgggttcaagcgattctcctgcctcagcctctagagtagctgggattgcaggcgcccgccaccatgccctgctattttttttgtatttttagtagagatggggtttcgccatgttggccaggctagtctcgaactcctgacctccagtgatctgtccgcctcggcctcccaaagtgctgggattacagatgtgagccactgtgcccagccttaaaattatttaaaaatgaataattacttttatctttttctactagatttttactcttgagaactacgatagagaatataaatgcaatgagcctttttgacacactacccatgagcattggtgggtttctgggaggagatatgttagggtcttggcccagttttcccgagatttttctagagcagtaccgtctgatacagtagccactaggcagatatttaaataaaaattaagggccgggcgcggtggctcatgcctgtaatcccagcactttgggaggccgaggcgggtggatcacaaggtcaggagattgagaccatcctggctaacatggtgaaaccccgtctctactaaaaaaatacaaaagaattagctgggcgaggtggtgggcgcctgtagtcccagctactcgggaggctgaggcaggagaatggcgtgaacctgggaggtggagcttgcagtgagccaagatcgcgccactgcactccagcctgggcgacagagcgagactccgtctcaaaaaaaaaaaaattaagtaaaattgaaaaaaatttttttatttgctttagccacatttcaagctctcaatagctacgtgtgaccaacggctaccatattaggcagcaaagataaagaatatttttatcatcacagaaagttctattggtaggggctgaggcatctccaaaggtagtctcagctcaccatactaagttaggattcttccttctctctgtagttcatagcagaaatcccaacaatgggtggggctaactcatatatgttatacccatttgaaattacacacctaatactattgtccacagttctgttttatgtcttctttggaatagttgctgtagaaaagcttcaaccaggcttaggggaaaaaaaaaaagagccactaaagaagctgtggggttctggatgctgaaagacaaagcaagtataggtaggaatgacttgtctatacgtggctctgctcctccaacactgggggcccagctgttgtttttcagaccgccccccaccaggcaatgctgccttttgtttgagagtctccatggagcatgtagttggtaagatacgtcctcagtgttcacagttagaaattgtaatactttatttgtagaaataccattttagggagaggctagataggttgtatactattaaaacaaaaaaagttaaatagttttttttggacttgagattccaatcacctttgtgttttttttttttttgatatatgacttaaagtgcacaaatattaagtgtactgcttgatgagatttaataagcatatacacatatagacctctgtgatcatcaccgtctagattaggaaaacaaagaacattttcagcacccgtgaatgtcccttgggtcccctcctggtcattaccacattggattctctttgaaggaagaatccagccttcttttaaagtggctttttctgtgagaacgcattctgttccaaacaactcctagctttgtactttaagaaacacaatctttgtatgacagggtgctgctgtgtttgactataccactcagctataaattcacacttaaaatctgctagaatagtaatggtatgaataaatacactatccgattgatagcagaacttgacctggtgaaatcaaagtagacctatcaataagactaaggcttaaactctaaaacaaatttagtaaaatctctgatcattatgttttgttgtcatgggtttttcttatgctcagagacattatcaaaatgtagaaaacatttcagtaaactttgagtataatttttttttccctttgtgaatttggaagccaggactagccgttctttgatttttcactgcctttctgagaacaatagcctcagtgtgggaaaggagggacagttggagtctgttgctggtctgacttaattcttgctgtctcttaggctaagctagtacattagaagcctgttcagtaaaattcacacctactttttaaatgaactttactgtaaagactctcaatcttactaggaatctaaaacactggaacttgcttcacataggaaatcagaaggatgcaggagactagaagcaccacatttggagccaactgatgatagcaatattgtcataaccaggattactatgatcacaagaagacaaaataactgataaaattactaagagtaaaaaaaacaaagaagggcttcttgtggcttctgctatcctggaactgctctctgtagcaagagctggtcagtagcatgcagagggcaactccgacctgaaggacatgagagcccattttgtttctgcagagcagccctcctgtgtgtggtgtacatggtttctgtgtaggtttccacttgcaaatgtgcacatccttgcacatatgtaaaatgagttattttatctcctttatccatattaaagaaaagtaggagaaaggcaacttagttctatcgggagaaccatcctctatatggccatttgtgcacatttatgtgtatctctactttgtccctggcagtgttctcagtatcttaccaactagaatattaccaaattagagtttcagtatgatgttaattgatgttcatagtggtgtcttcaggatgtggctttgcctattgttaatcaaagaaagttaaaatcaccttcaattttgttttagtgttatatctgtcttaatcaagtttttttgaaaatgtagtaatagtctgtgctatatttgatagtatgttattaataagaatgtttgattcatcacaatgtcattctcttgttatcctggatcaaggtttctcctctaaggaaggtgaaatgtgctagaagcagttatctgtagcactaaaatacttacatttgagacttgtaggttatgatagttgttaacagataatcacagagcaataaaagctcaaattccaagtgtaacttctgtatttgttattaatacttgaattacaacatgttttaaggttggttttcctgatcatatttattttttctttaatatagtccagcaaaattaaaaaaggaagcaaaggagactgtactgtactgaagcccacacttatggctgctgttccggtgagtacagaatatgaatatgaacataagaggattgtttatataatttattgatcgtacttggaccttttaaaaagtaatactcttagatatgtctacattttaaaataattttaccttgttgaaatcacagcaaatgtgttcattaaaatcttaggtaccatactagggaagacaaaatggcaagattttgaaatgcacgcctgtttgagtttgctgatacatgaaaattaggtgatgaaaatgacctagttcaggttacctactgtgagaattggtcagaccgttttaaggtagaatatattctaaagatcatcttgtttaatctcttaattaaaaaaatgaggaaactttaggccatcctagggagctgaagaatcgtatacaaggtcaaggatctaagccctcccaactctcttatggtgattaagtaaactgaaaattggagagagctcccaaaggaaaaaagtttaattctatatattcggaatcttcatgtgaaatactgccttaaaaaaaaaagatgttacattttatagccttgtaatgatgaattttgaaacatttaacaccatgtttcagatttgtgtaatcaaatatgttctagctttttttatgcttcagaaacttcagaaagactatgtatcactactgcttatattatgatcagacttgaaatcttaccccaatatctttcacagaattacttttgtatatggaaactctgagattagataagaaagtgttcagtccaagttgttctgagaattacagatggaagatactttatggtccttttagcttctaattgcaaaattaccaaataacaaagaagtagaataggtcagagaagactttgcctttttatttagaggttctgtgtaattcataaagttttcaaacagaaagaagaggcatctgactaaaaccataaaaaagttgctaataatagctagtgcagtgcttcctatgtgctaggtaggcactgtgcaaaatgccttagataaattatctcacttaattctaagactgcaaggtgggccctgttactctatcttataaagaaggaaagttgccccaaagccacacagctcataggtgatggaatcaaagtttgaactctaccaatctgatactggtggagtatcagtctatcagtcttcttaaccactatggctgtctatttaggactgtttcacattcagaattccctagcaaaccttatcagataacataggaagaggtaagagctgaggtgttaaagaagtaatctccgattttaggcctgaaggataagcacagttagcacataggctccttatcctctaattgcccattgtccattcttccctgctttactttgtgtcttgaggggctatgttctgtgcacgaattaccagtgcatccttgccttatgacttctggttgggttcagccaattggagggcctcatgagagatcagagggcagaaagatagagagtctgcacacttattacctttgctcctttcctgctgggctgcaaattttagcagctgtcaggagaccctgttggatagtctccttcccgttggttgtaaccaggtctttcccatggctagagtcctcatccaggttccaatgacacttgtcttatgtcttgcggcctcgagatagtaatgttccctatgttgctagtccattggcacctcatcaaatattattgggtttcctttttagcccctcctgtttctccagaaataggccatttaaaaaaaaaacaactctttattgagaattatttttggtagagtctgttttttgagtttgtttctttcctgggtcagaatgaaagattgattgaatactataacattcacagtgaaaattcagaataagtcactacttatcagctgtggctccattgaacatcatgtaatgttaggttgagataaagggtgacttaatgtgctaacaataaactctgccaatgtgttacaactgtattatgttccttactcatcaaggccttgctgatgtctatgattagtatccagtgctggaaggagcagtagacatggttctcacacatctgtctcattcccaagcccctgccccctctcccctccccacccccattttttttttaagatctcatatactttttaagaaggatggatataggatgctcaagtcctgctagggaatgatgggggattctgtcacagatgtagagaaatatttcagttatataatagtgattccttttgtggaaatggagaaaacaatattgtaccatgtttgagtgctatggtaactttttttttttttttttttttttttagtatttattgatcattcttgggtgtttctcagagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactgttaacgagcatgctgccttcaagcatctgtttaacaaagcacatcttgcaccacccttaatccatttaacccttagtggacacagcacatgtttcagagagcatggggttgggggtaaggttatagactaacagcatcccaaggcagaagaatttttcttagtacagaacaaaacggagtctcctatgtctacttctctctacacagacacagaaacaatctgatctctctttcttttccccacatttcccccttttctatttgacaaaaccgccatcgtcatcatggcccgttctcaatgagctattgggtacacctcccagatggggtggcgacctggcagaggggctcctcacctcccagacggggcggccaggcagaggcgcccgcctgccacctcccggacggggtggctggtcgggcgggggctgccccccacctcccggatggggtggctggccaggcgggggctgccccccagctcccgggcggggcggctggccgggcggaggggctcctcacttctcagacggggaggccggtcagagacgctcctcatctcccagacggggcggcggcggggcagagacactcctcagttcccagacggggtcgcggctgggcagaggcgctcttcacatctcagatggggcggcagggcagaggtgctccccacatcccagaggatgggcggctgggcagagacactcctcacttcctagacaggatgacggccgggaagaggcgctcctcacttcccagactgggcggccgggcagaggggctcctcacatcccagacgatgggcggccaggcagagacgctcctcacttcctagacggggtggcggccgagcagaggctgcaatctcggcactttgggaggccaaggcaggcggctgggaggtggaggttgtagccagccgagatcacgccactgcactccagcctgggcaacattgagcactgagtgagtgagactccgtctgcaatcccagcacctcgggaggccgaggctggcagatcactcacggtcaggagctggagaccagcctggccagcatggcgaaaccccgtctccaccaaaaaatacgaaaaccagtcaggcgtggcggcacgcgcctgcaatcccaggcactcggcaggctgaggcaggagaatcaggcagggaggttgcagtgagtcgagatggcggcagtacagtccagcctccgctcggcatcagagggagaccgtgcaaaggggaagggagagggagagggagaggagggagaggagggagagggagagctttttttttttttttgagacggagtcttgctctgtcacccaggctagagtgcagtggtgtgatgtcggctcactgcaacctccacctcccgggttcaagcgattctcctgcctcagcctccctagtagctgggattataggcgcctgccaccacgcccggctaatttttgtatttttggtagagacggggtttcaccatcttggccaggctgatctcgaactcctgacctcgcaatccacccacctcagcctcccaaagtgctggaattacaggcgtgagccactatgcccagcctgtggtaacctttttaagggatggttctgctgtcttcatttgtgagtggctctattctaatattgaaagaactgcccattaagttattcattatagcataccttaatttgtactgataattgatattttaagtatttggaaacacgtatttataaacagatgtgctttatgtaataattcttaatttgtgttaaataatttcaagaaaacatcatttagtggtagtctgggctgtttgctgtttatttttttttgttttgttttgtattaaccttagagtcggtatatcttaaacctggtcctacctccagttttccaagtttgtgtgagcaagaatcgtgttctttgcttccgttaaaatgtaatagaaatgcttaaactatagatacttaggattttaagaaactaatgctttctgccatgctgtaagaaggtcacaaagttgtagtaaaaaaagagaaaagcatcatgaatagattcaacatagtcaggtattttggtactgtttgagaataagtgaatatattgtaacagagattaatttttttttctgcgacagctgagtgaattctctaaactcgagctaacatttcttaaaaatttagattaacttggctgggcacggtggctcacgcctgtaatcccaacactttgggaggccgaggtggcggatcacgaagtcaggagttcgacaccagcctggctaacacattgaaaccttgtctctactaaaaatacaaaaaattagccgggtgtggtggcaggcgcctgtagtcccagctactggggaggctgaggcaggagaatgggatgaacccaggaggtggagcttgcagtgagccgagatcccgccactgcactccagcctgggcagcagagtgagactccgtctcaaaaaaaaaaaaaaaaatttagattaacttaatgtatagaactgaagaaacccctatatctgtccttagtctttttgaagtagtgaacaagtagtcagtgaaattaattacataattaaagaaacaaatatgtccattatgctaaagacttttacccaagatgttgcaagtaaggtatcttcaactaaagactgtctccattcctttcagattattgaatattttgtttaactttcaggaaatcatggatagaatttataagaatgttatgagcaaagtccaagagatgaattatattcagaaaactctgttcaagatagggtatgattacaaattggaacagatcaaaaagggatatgatgcacctctttgcaatctgtaagtacatttcataggctctgtggtttgagcctttaaatttttttatgcttttaaatccagaagatgaataaataaatggcaagttaattcatttgaatatcaccaccatgatcataaggttgaaattctcttttattctaagtcttattgtttatacagcaagcagaggactctgatcttggcaatttaacaaattttaataattgagtgtatatttaagatttatttataaaatttagtttcatgaagaaaaactaaaatagacttttgaatcaagacacttgagcttaaaaaatgtcatttctaactaaaaaaagtgacctccattgcatgaaggtttctgatttattgtattcataaaatagtgtagtaagtatatgaatataacttattttaaatgtgatgctgaggagtggggatggggaagcattttttattggaagtgagataagataggtgattaaatgttccaaagataattaaaatttttttacctctgatgtctgttttctttcatttacttgtgtcagcatagtttcccgatgctacacattatctttcttcatttttaaagagttttttctggcatttttacaaggcgttactagttgttgccttgttaacctctcattctcaccgtgattctgacattgagatgttcaaccagttgaggaatctttcccagagcttataaattagtgtgttgccaagaataatgtatgcgtacattaaaatcatttatcctccctttattaaggttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaaggtaagcattattaatgtggtaaatattctgtatcagctgctactaataaaatacattcgcattacctttggaaaccatggtaactttaaaatacctcttaactaatatcagattcattgcaaatcagtgtagttttggtttatgaattcttaattataagtatcatgtggaccctttcattttaagccttataattttttttttttttgagatggagtttcactcttgttgcccaggctggagtgcaatagcataatctcagctcactgcaacctccacctcctgggttcaaacaattctcctgcctcagcctcccaagtagctgggattacaggcgtgtgccaccatgcccagctaatttttgtatttttagatggggtttcaccatgttgaccaggctggtctcgaactcctgacctcaggtgatctgcctgcctcggcctcccaaagtgctgggattacaggcggtgagccaccacgcccggtcgccttataaatatttatgccacacagtcggtcctcaaaatcctgtcaccctggtcctttagtcttctttctctaaatgatcacttctttggagaactgtactattaaaaatgaagtatcacttttatgctccctcttaaatctgtgttcctgtcctaacttcttctttggtttcccttttgttattttcaacagcctgaagcgaggtttcccaaccctgacactgttcaaattttgaatccgataattctttgttgttgagggctgttgtatgcattgcagaatatttagttgccaaagcagatgtttatgggctcaccccagctgtgacaatgaaacatatccccaaacattgccagatatcccctggggggcaaaatcactttaggttgagaaacactggggtataggaattgtttttttggataatcttattttcgctttaaactcattgtgtccaaaatcaatgccattattctaaactgtctctctattgacaaattatttgtttgtgtcaatggtgataccatccttaaagtcattccaggtatcagctttgaagtcatctgtttattttaaaatatctttaaatgtcatcagatcattccttcattaggtttctcctttccctccatatcacctctgtcgtccaactttttattgctccattctgctccgacctaacagcctttttatttttgagacagagtcttgctctgttgcccaggctggagtgcagtggcacaatctcagctcactgcaacctccgcctcccgggttcaagcaattctcttcccttagcctcctgagtagctgggactacaggcgtgtgccaccacacctgactaatttttgtatttttagtagaagcggggttttaccatgttggccaggctggtctcgaactcctgacctcaggtgatccacccacctcagcttcccagagtattaggattacaggcgggagccactgcgcctgccctgacctaacagccttgtaacagctgtgtctgcctacattacatcacttctgatttatcctgtatccttctattagatgcatccacctcatccactgcttgatacctgatgtatcaaatctaaacacctctttacctagctttgacatctttaatctgatgctagtgtacttatccaacatcattttccattattccccacatatacacaatgcctggctcttctctccagacccaccagtcttcttactgtttcttatgaaggcattcttggtctcacctctatgtattttcttttcccttctcttggaatgtcctttttgcttattgatcacaaccatcttttaatgcccacttttcaataatgtctttcctaactacttcattttacattcattgtttaagtctctaagctactattgtgcttaccttcagtgcccatgcagtttagtatttaaatgttctctgaattgtttcacatgcatttcttcccagttcatttgtaaggtcattgagtgcagggtctccttatctctcatgtgctgtttacataatgggctgtccataaatatttgtttattgctagcaataatcacaaattgcaaatggatatcatcatcatgatgatgtttgacaacagcagctaacatcttttgaaggcttagcttgtgccaagaagtgttaagcattgtccatgtatcatctcatttaatcctcacagcatatccctgtatgaagtaggttttgttactatctccatttcatagatgaggaaatggaggcttagagaggctaagttacttgtccatgttacatagccaatgagtggtagagcaggaattccaatcaaaatctatcttatgacaagcttaggtagataacggtggagccatctctcctcctttaacagatattttgtacttaattacataaaatataaccatgaaaagcaaaaatgatgtaacaacaatggaatccattgcactattgaagtggagttgaaatactgaaaaatgatcacactttgcactccttcttttgtcatttttctgactctggttctaactctaatattcccagtgcattggtacaaatctggaatgtggtatgctaatatctctgttactttttccctcacagtaactgactatactactggcagagttggagcacctcttatttgctgtgaaattaagctaaaagactggcaagaaggtaagaattttatgaaaagctctagtgattcaagatatgctgaaaactactgtcagctttatgactttcatttctttaaagtctggggaagcaaataattctctgctgttttgctgttgcctgtccccatgcattctttttcctcagtgatatctttaggttcccaagaggaaaataaaatctctagaatctaggattaatgattctgaacttgacaatacttgaaggtaaagagaaaaaaaattcttactggagctttctgggtttggagaaggtgaggatccttgaaacttgactttactagtgagaatgtttgggctgagaaaccccagatttttaggggatagaatgatgggttgcactcatacacacaccaacttcttagatcttgatcccagaaaagattttcatagttgagactcaactgtccagctatttgtatagttgaatttttatatgtacctgcacagacaagccacttagaagaaaactagagacattgatgatcatcctttctataaattagctgaaggcaaatatcaaccagtcttcttaatgaaagatactaaatatacacagtaactacaataaagtagattgttaaataaaacaaataattaacagcctagccatgtcagataaaggaagagtaattaaaatgcttaagattttaaaagagaatatttaccttaggatggaacacggactaaaaatttaaagtacaagttaccgtgtaggatgcaacccttaggttgtccaaaccctgagaaaatgaatacgtttttatctaacataaactttaagtttctaaagcattttttattatgtgtgttattgtcagtgctttatgagcaaatgactatttcttttttaaaaacacattttaaaaagccagttgcattcccaagagttttacaccttgggacttagtcttccctttttccatggtaatggcattccaattttaccatgaaaatctgaagaaaatagtttgtgtgtatgtgttttggacatcaacatcagaattattttattaggtaagtttttaattgttaggcagtggaatcagagaaatgtttaaaggcaaaaatctccttaccaagttttactataatttttattttctgatttcctggtactgggccttaatgtcagttttggggagtaggtcccttgttgaacatgtatttggagttttccttgctgtgaagactctttggctttatactgtatgaatgatctcagtttttttttaacatacaatgggttttatcatgttgaaatattgaatagttttaagtttatcagagcagctaacagctgaaaggaaccctgattttaatccttttatgacacaaaatctagtctatatcttattttgcaaatttagatttttgtatattttccttaaagtaagcttccttcagtaatacagaggtaatgagtagtgatgaaatatattagtatttattatcaattagtttagtgtttgaacttctaaagtcatgactggccacaggcaaaattaatacaattttcttcctgtttcccatagtcccccctttccctctcactttatgatgctaccatttttgggtacttactgcatgttctttttggttaaaacctccttagaaaaaatttgaaatgcattgatatcagtatgtcagtaatttacttataacagcttcaagtgttactcttcctgggggtgattttatcttaacagaactctgtgaacactaagctctaatggtgttctaagtgtgaaatgttatggtatgggaaggtttgagatgggtgattgttggtggtgattatcattgagcctttcttggtgttcttaaaatcacagtcacccagtatcctcatgtaaattttagtaaatataaactaatgttctctcataaagtgatataaaatctgatcagcagaaaaatactaacatacgtataagctttaagaattaatgaaatttgttgtagaacaataactaatttacttttatgatttccaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattataggtcagaatgttttctttttatggttttctttagtttttataacttcagtatatatgaaaggtaatattgatcagtcattaataaagttgatggttccattagttcaaactttggacaagttatttaacttatgtatgagcttctccatcagcaaaacaaggacaataccaacctcatagggctgtcgttaagattaaatgagttgatatatgtaaaatattctaaacagagcctgaaccttagcgtaagtactagcagcactagcaacagcagcattgagtgtagagagaatgggcagggaaatagcaaacaggtaatgagaaaacaaaaagagctcagaggacgtctttcttggtcaaccacatgtgattttatataactgtttcctataacatactctatgctaggccttcctcactcttcacctctccacccaaggggcagcatgggcacatatatttttttttactgttggctatttatatgtgtctaacgaggcctgaaccttagaaaattaatatcaatccttagcactagtcagttctgagaatgtcagttactttggcattgtcctcattgagtctactgaagtggacctttatgttcaaaaaatgactccaaaatgggcccttgtgctattcacttggatgaggcaaaagttaaaacttgctgatgagaacccctcagcaagatcccagtcaggtcttttttaagacatagagtttcctcacctatatgtagtgactgatttcaatccatcgctggacctcacgatatctgacctgaatatagttagagatttcctgggaaaattggttcttcatctagaaatttgaaccaggaaccatggttcagttgagaaacaataagcttttttcccccttgttccttaattgcactggaatcaaaggttatttctgtagagtgggttcccaggctacgggtaggcaaatcagcactcatactcattccaaggccatgtgatgattattcaagctgtgccatcctgtgctagcactttcttagagaactgtcattttaacaagataatgtcaaaagtggaaaaggagaattaacatgtgttaaatgtgttctatatgccagacattgtgggatatgtctgtatgaggtaggcatcattatcctgataaaacttgaggattagaaggttaactgacatgccgaggatcacttagctagtaccaggcagagttaccattcagatagaatgttccaaagtcctagttccctctattaaattgattataatatttaagattataataagatgctaaagctttgggtttaaggtgtaacttttagccaatacttacttaagtaggcattttatttttaactggtgtgtatgggcaacattatatatatgcagtttttgccattttaaaagtaatggcaaaaaccacaattacttttgcaccaacctaataataattttagaagaagtagttttgtaaataacgattaaggcaatgatattcaaagaagacagtcagaattgcatataccttagttaaacagacttaacattctttatgacttaacagatcgtaagaaagatctagtgaagttacaagcaggagagtatgtatctcttgggaaagtagaagctgcactgaagaattgtccacttattgacaacatctgtgcttttgccaaaaggtaactttccaaagttgtattttttgtttcataagtcaaaagatatttagaaaataatgtgattacatattatcataagggtaacatagtcttctcttagaattttcatcagatctggggaattgtacatttatgtaagttagtgaattcaacagcttaaagatcattttagataactcagacgtgttaactatttattggacacctgcatcttgctaaatacttagctatgcaacaagttatttcatttaacatccatgacaactgagacttagtataagtaattttcccaaaaatgtaacacaactactacatgttgagatgaattttgaacccaagtttttctaaatcaaaagcctaagagattgagccattttctttatatgttgatatgtcttatttttatgggttttattcttttttaaaaattgtaattgtggtaaaaagcatataacgtaagatttaccatcttaaccatttctaaatgtacagttcagtagtgttgtgtatatttacattggtgtgcagccaatctccagacctttttttcttgcaaaatggaaactctatacccattaaacagcaactcctattcctcctccctccttcccctgggaaccaccattctactttctgtttctatgaatttgacttctctagaaatctcacacaagtagaattatacagtttttgcctttttgtgattggcttaattcccttagtataatgtcctcaaggattatccatgttgtagcatatgtcagaatttccttcattttgaaggcttaacaatattccattgtatccatataatgtattttgtttatatattcattgtcagtgcacattttggttgcctccccctcttggttgttgtgaataatgctcctaggaaaatgcgtatgcaaatatctctttgagatcctgctttcaattatgtggatagatacctagatttagaattgctggatcatatgacagttctatttttaattttttaaggaactgcaatactgttttccatagcaacagcaccatttttacatttcctacaacagtacacaaacattctagttcctccacttcttcactagcacttgtttgttttatatagtagtcatcctcatggatgtgaggggatattttgttttagttttgatttgtattttcctaatgattagtgccactgagcaccttttcctatgattgttggccattcatatattatcgctggagaaatgtctattcaagttctttgttcattatttaattgagctatttggttttttgttactgagttgtggaaattatatattctgtttattaaccccttatcagatatatgatttgcaaattttttttttctattccatagattgcctttttactctgctgattgagtcttttgatacacacaagtttttaattttgttgtagtcccagttatctgttttttgcttttgttgcctttgcttttggtgtcacacccaagaaatattgccaaatctattctcataaagtgtttcttctgtttttttttttctagcagttttatagttttatcagattggtgcaaaagtaattttggtttttgccattaatgtcaattacttttgcaccgacttaatagctcttcgatgtttagatttttgatccattttgagctaatttttgtatatgttgtaaggtgaaggtccaccttcattcattgcatgtggatatccagttttcctagtaccatttgttgacgagactgtcctttcctcattgagtggtcttaacacccttgtcaaagatcgtttctccatagatacaagggtttacttctagtttctctattccattggtctatatgtccttctttatgctggtactatgggttttatcatttcctaatgaaactttaataaataagagaaatatatatttggaattatctgtactgtactatgtcattgactagtttatgaataacttttctcaatgttttcatttctattttattttctgtttttttagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccagtaagtaagaaattgctagactggtatagtccctaaaagtcatctaatgatgtcttttgcattaggctcttcaatatgtttgctttaataataaaatacaggattttaagaaacctatttcttaaatatgtataatggatttccatgttggaaggatccttcaatgtcatatagtagaataacctatgtagttctttattgcatgtttcaacatctttcccaaagtggtcatctagcctgtgtttggaatggtccatctttgggtagatctgttatataaatctactttgtgtctgtaaagcagaaattagtaactctaagtttagtaaatagtgttataaccatgattatgctttgtgtgtatactgtggctctgtaaatggactatcttcagatggtacattaataaccaattggagaaaatctgcttatatagtatatgccaggaattgtgttacacactaggaatacagaaagtagtaagactcatttcttgctctcatgtagttcattatcaggtgagaggggcacatgagagagacaacaatcttaacagcaatagagagatgaacagagaatcatggtaccacagatgagggtacctaacctacttgggaggacatggaagagatgtcacttcagctcatccttaagggttaattagaagttaactaggttgggcattctaggccaagaagcaacatgagaaaggcaaataggtatgaaaaggatgatgtgtgcagggaactacaagggagtctggtgttaccggtacagtgcaaagtatgaggtaaggctgtagaggttagcagaggccaagttgtgtagtaccttctatgcttgttcagaaatttggatgtaatcctgtagacagtgaggagccattggcaggttttactaggttagtgatgtggtcaggtttgcattttggagagatgcagtcactctggaggccatgctgcagatgaatttgagggggactggactgaggcagaaggccagttgaagaggactgtaggagatacctagactggggggtggtgagtaatgagggcgtgaagcagggaatcaggaaatgtttatgaagcaaaattggcacacttcagtgattaattggataacatagataagggaaaagaggagtctaggatagcccccagatttgtagctgaagcgacaaggtaaatactactactgattgagctagaaaatacaagaggaagagctggcatatacaagaagatgatgaggtcagtatgggatacatgtagtttgaaacacgttttgacaaccccatcaaaaagtgggcaaagaatatgaacagacacttctcaaaagaagacatttatgcagccaacagacacatgaaaaaatgctcatcatcactggccatcagagaaatgcaaatcaaaaccacaatgagatgccatctcacaccagttagaatggcaatcattaaaaagtcagggaacaacaggtgctggagaggatatggagaaataggaacacttttacactgttggtgggactgtaaactagttcgaccattgtggaagacactgtggtgattcctcaaggatctagaactagaaataccatttgacccagccatcccattactgggtatatacccaaaggattataaataatgctgctgtaaagacacatgcacacatatgtttattgcagcactattcacaagagcaaagacttggaaccaacccagatatccatcaataatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatattctcactcataggtgggaattgaacaacgagaacacttggacacaggaaggggaacatcacacactggggcctgttgtggggtggggggacgggggagggatagcattaggagatatacctaatgttaaatgatgaggattaatgggtgcagcacaccaacatggcacatgtatacatatgtaacaaacctgcatgttgtgcacatgtaccctagaacttaaagtataaaaaaataaaaataaaaaacacgttttggataatcaaagttaaaatgtccagcaggcggttgtgtgtagtccaaatcttattgggagaggcctggactctgctatagactcggggataattgaaaccacgaaagtagatgggccaaccttgggtgagattgtaaagggagaacaggaggctgtggatgggtctctggataacaccagcatataaggaatggatgaagaaagagatgtgtgtgggaagcatgattggcaagatgccaggagagcaatgcccatgcagaccactgctaagagagtttcaggaaagagagtaatcaacagttttacattagcagaaaggactgacaaagcttattggaacattgattggaaaattaaagagattaaaaattaatgctcaagttcaatagtaggctttttttttttcttttttcccaacgagggattccatgtgggtggctgattttataacctttttttaagtttcagttttatcagtataacaagtatatatagtttaaaaaatgtcagtattaaggacttgcaacaaaaagcagcccatattgtatccctcttttccccaagtctcatctgtcttcaactttagttgtttttttaaagtttctggcattcgtctccatttttctaaagaaaatggttatgttgctccttcttgaatttttcatttgcgatgttatggacttttatggacctctaaccatagaagatgatttacctttcttatgaccattctccttgccttccctaccacactttttcttttccaatagatagtacaatttgcattttacacccaggtttccgttatgattatgaaaatattcacagctgaactacatagtgttttatgattatatttcctttcttggacaattttttgtgtttccctggatcttaaaatttcctctcttcattagttttttgtatactattcttaactcttccactaaactctgttaaaattgtaaaaattctccctaatacaggaaaggatagcatgtctgtatttttgttctcggagacatacttcttagagccctttatcctcatgctgaaatttagactatttgcttccaaaggcttccctttactatcatcctgggaatttcctttgcttctctcctatgttggatcctgtttcctggatctcatatctgtctctttcctggtttactcgccggtttgggtagagcacatccttcagcagcttcctgagaaaggtgcatgggaggtaaatttttgagactgtgcttgcgtgtctgaatatgtttttattctgtcctcacccttgagatgtgtcttggcatattttagagtgataaattctaaatcatttttcctgaatactttgcagacttggctttgttgtcttccagctccagtgttgcatcctgattcccattcctttgtgtatgatctattttatctctcctagctttcagagtcattatgttaatttctggtgttttgatagttcataatgatgtatcttagtgtgggtctttgatcatttatcattgtgcatacttgctgtgggccctttccatatggagatctctgcccttcagttctgggaaatgttaatttatcttttgtttgttcatttgtttttttccccataattccccccaccctgtgtgtctgtttctgagactacttttatatggctgttggacttccagctttcatcctctaattttattatcctttttaaaattttctatttctctttttgttttatattctggcagagtctctcaactttatcatctcttctgtctactgaatttccaatttccactatcagaattttaattttcaagagcttgttcctgtcctctcagtgttccttttaatagcaccctgttgctctttcatggatgcagtcaatgcattgtctcttattcctctgaggatattaaaaggaatcctttttatgtagttttcttctcctgttattgtctcttttacctccaagttgcactttatgcttgccttggtcattgagtcccaagtgtctgctgatccttgtatgtccatattcaggaaccaggtactaaaaaactgtttggaaagcttactgggcttcactgaaaaggcattccaacgttagtgtctttttctcttaagtcattctgtttctccaaaggagatttctccagtcttttgcccgggcaatattagcctgactgccagaattctggtagccaaaagaggtaaaggagttattgagggggatgggagagcagtgggtctcaccctcactgaatccttctcttttcagccttactccctccttctgttgtacctaatgtccatgagtcccgagtctctgcttcagtttttccaaaaagtagacctgcctacaaatggctttgagaagagcagcatagggtgcgggagaacttttctctaaacaggctggagaccagtgctgctctttccagctttacccctcatctcttatcttcagaggcacaggcttagtgggcacttgcccgggctctactatgagggcagtttgctgcttgttggcaacctcttttgttggtagttgctttggcttcctcagccctaagttaattaccacaaattcctttgctttttgtcttctaagattttgttgcactttctcattcagtgcccattttctcttgtttcactttttgccttgtggttaatacctttttcatttttaaattattctaaacaatttaaattcttttttaggcagaacagagaaaaactatatactcttcgtgttttgttggaagctgttaacctaatttcaacccattgtttttctcttacaaataaaaatatcatttttctgattataggttatctatattcattataaaatattggacaacagaatattacaaagaaggaagtaaaaatcacttgagagtagtttatctttgggtggcaagattacattttggtatatatacttaagctgtcaacataatcgaagtttttctgtgtcagtaaatagaaaattacggtatcattttaaatactaaatagtcccagtgcataaatagccatttaagtccctattagatttttaggtgaatttcaccttcttccccatcactgtaaacaaatataacacgaatcttgtatactccattattttcttatgtgattattttcttagtgtgaattcctagaaacagaatttctgagtcaaagagaatatatatatatatattttttcaaataaatttttttaaaaattattattatactttaagttttagggtacatgtgcacaatgtgcaggttagttacatatgtatacatgtgccatgctggtgtgctgcacccattaactcgtcatttagcattaggtatatctcctaatgctatccctcccccttccgcccaccccacaacagtccccagagtgtgatgttccccttcctgtgtccatgtgttctcattgttcaattcccatctataagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggctggttccaagtctttgctgttgtgaatagtgccgcaataaacatacgtgtgcatgtgtctttatagcagcatgatttatagtcctttgagtatatacccagtaatgggatggctgggtcaaatggtacttctagttctagatccctgaggaatcgccacactggacttccacaatggttgaactagtttacaatcccaccaacagtgtaaaagtgttcctatttctccacatcctctccagcacctgttgttccctgactttttaatgattgccattctaactggtgtgagatggtatctcattgtagttttgatttgcatttctctgatggccagtgatgatgagcattttttcatgtgtcttttggctgcataagaatatatattttaaagacttttttcctcattgccaaattgctgcctctccccaggaaaactgaaccggcttatattcctatcagagatatatgaatatacctatttctctaactgggctcctattatttctatttattaaaaatgttaactacttaggttacattttggtttaaaaatatagtttatagtaatagtttttctacctgaaaactaatttctccccaagaataattttctgaattctagacactgtgaagttttaaataacaatggcctgttaacataatcagattgaaaaagcttatttattttatacctataaaaacagtgtgacatgtattttatacttacaaaaatagtgtgacataatatttccttcttcaaggtggttttgttacaatattattgatataacacacttttatattaatgaaccaggctcccagaaccttttttgatacaaagcctgatttgctctcaatatagtatttctaaaaatatatagtattttctttaggtatttaagtatagcatttcaaatatagtattttctttaaatatagtatttcaagaaatatatagtatttcaaccaaaaggctaatcatcagaggtgcactgtagttactcttattcatcctctgaatatattaatggattagaatgtgacttgaataattttccattgcatatttaattgtgtagaagcaacaatgggggaagtcaaactgtatcccactttgttagaaggcagaataaaatcctaggacccactaggttctcataactttcctgtgcttagagtgaggcatgtaactcatgatttggataatgagtggtaatcatgagctaaatgtataaatcataaaccttttgtgccacaaaggatttatcttgccaacattttgcaaattataatttcagagacttatgcaaaaaagtgtgaaatagttttgattgtattcagcaaatctgtcagaaattatacatctttcatagcaggcctcttcatattttaagtataattgtgaggtatacatagtatcataagaatgcaaaatacttgtttttgggtgatttgagcaactactaatggctatgaaaattgctatttgctgccacctgcaagtcacatttcataatgttctagttaattcggataaaaatgccacatttttgtttgttttgtttgtttttccttctcctaacctttctcacttgttggcaatttattctatttacaggaatctgtgatagtccattgcttcctatggcttggagtattagataatgtttaggagttttcaagatgaaacttctatagcagtctttatttttttggctttaaagtaggaatttaactaagattgttttcagcctgctttcatttgcttgtgtgcaactgaaataatgtgtttgccttgtcccaattttgtcagtgtttctggactaggacctatgtatgtaagaaaagtaaaatgaaataaaaaattggggggccaaatctgtagctgagaatttaactgtttccttgagttccaaatgtgacgttgggagcagataagcttattttatgaaactctgtgtaactgagctgtactttaataacagagtagacctggttaattcaagcaagttttatgttcctttacgacccattcaggcattatttttaggaagttggttgtaatttatatttaaaagattatttttcatactcaactttatatttttctgtcattttagtgagaaactcactagttcaatcaagctttcataaaacgtagactagtactagaaaagaactttggtgaatgtgagttctttgtgcttgccactgaaaccaaatcatttctaaactcgtctaggctattttgtagtagtttttaaaaatgtgcgaatgtttgcttcttggcaattgctgttttaaataatcacataaaataacattttatgttgattaacataacatctgttgattaatattactgttaataggcctccataatttaaagaattacccttgtagtcataataaataacttgatggcatataatttatggaatttaaaagtattaatactgtattaattacctttatgtccttccttatattttgccaatatgtattaagttgtataactcaaatacaatattcattgcatcagtttttataccatttaaagatatgaaattcacaatccccttttttatctgcatttgaatatatagtaaagtttataaagaatatttgtctagagacttaattttctgtagaatgaattaataaacttgtatgtatttatggagggctctcaaccctatggatggcagtgaaaaaatcaaagaccttgcttttatggagcttacattttagctccatggtgaaacaaatatataatatgttgggtggtgataactactttgaacaaagcatagtgttaagaaggtatagagagacaaagggacttctcttttgtgtatttctttatttattattatactttaagttttagggtacatgtgcacaatgtgcaggttagttacatatgtatacatgtgccatgctggtgcgctgcacccactaacttgtcatctagcattaggtatatctcccaatgctatccctccccccttccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccctggtgtatatgtgccacattttcttaatccagtctatcattgttggacatttgggttggttccaagtctttgctattgtgaataatgccgcagtaaacatatgtgtgcatctgtctttatagcagcatgatttatagtcctctgggtatatacccagtaatgggatggctgggtcaaatggtatttctagttctagatccctgaggaatcaccacactgacttccacaacggttgaactagtttacagtcccaccaacagtgtaaaagtgtccctatttctcgacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagcaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcccatgcctatgtcctgaatggtaatgtctaggttttcttctagggtttttatggttttaggtctaacgtttaagtctttaatccattttgaattgatttttgtgtaaggtgtaaggaagggatccagtttcagctttctacatatggctagccagttttcccagcaccatttattaaatagggaatcctttccccattgcttgtttttcttaggtttgtcaaagatcagatagttgtagatatgtggcgttatttgtgaggcctctgttctgttccattgatctgtatctctgtgttggtaccagtaccatgctgttttggctactgtagccttgtagtatagtttgaagtcaggtagcgtgatgcccccagctttgttcttttggcttaggattgacttggcgatgctggctcttttttggttccatatgaactttaaagtagttttttccaattctgtgaagaaagtcattgatagcttgatggggatggcattgaatccgtaaattaccttgggcagtgtggccattttcacgatattgattcttcctacccatgagcatggaatgttcttccatttgtttgtatcctcttttatttccttgagcactggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgatcgccctggccagaacttccaacactctgttgaataggagtggtgagagagggcatccctgtcttgtgctggttttcaaagggaatgcttccagtttttgcccattcagtataatgttggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatactggattacatttattgatttgcgtatattaaaccagccttgcatcccagggatgaagcccacttgatcatggtggataagctttttgatatgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctcattttctattgattggaatagtttcagaaggaatggtatcagttcctccttgtacctctgatagaatttggctgtgaatccatctggtcatgggcttttttttgttggtaggctattaattactgcctcaatttcagcactttttattggtctattcagggattcaacttcttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgctgatcctttcaaaaaaccacctcctggattcattaattttttgaagggttttttgtgtctctatttccttcagttttgctctgatcttagttatttcttgccttctgctagcttttgaatgtgtttgttcttgcttctctagttcttttaattttgatgttagggtgtcaattttagatctttcctgctttctcttgtgggcatttagtgctataaatttccatctacacactgctttgaatgtgtcccagagattctggtatattgtgtctttgttcttgttggtttcaaagaacatctttatttctgtcttcatttcgttatgtacccagaagtcatccaggagcaggttgttcagtttccatgtagttgaccggttttgagtgagattcttaatcctgagttctagtttgattgcactgtggtctgagagacagtttgttataatttctgttcttttacatttgctgaggagagctttacttccaagtttgtggtcagttttggaataggtgtggtgtggtgctgaaaaaaatgtatattctgttgatttggagtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttttaggtcactcacgacttgctttgtgaatctaggtgctcctgtattaggtgcatatatatttaggatagttagctcttcttgttgaattgatccctttaccattatgtgatggccttctttgtctcttctgatctttgttggtttaaagtctgttttatcagagactaggattgcaacccctgccttttttttgttttccatttgcttggtagatcttcctccatccttttattttgagcctatgtgtgtctctgcacgtgagatgggtttcctgaatacagcacactgatgggtcttgactctgtatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagtggctggtaccggttgttcctttccatgtttagcacttccttcaggagctcttttagggcaggcctggtggtgacaaaatctctcagcatttgcttgtctgtaaagtattttatttctccttcacttatgaagcttagtttggccggatatgaaattctgggttgaaaattcttttctttaagaatgttgtatattggcccccactctcttctggcttgtagagtttctgccgagagatccgctgttagtctgatgggcttccctttgagggtaccccaacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatattctacagagtgttttccaacttggttccattctccccatcactttcaggtacaccaatcagatgtagatttggtcttttcacatagtcccatatttcttggaggctttgctcgtttctttttattcttttttctctaaacttccttctcactccatttcattcatttcatcttccatcattgatagcctttcatccagttgatcgcatcggctcctgaggcttctgcattcttcacgtagttctcgagccttggctttcagctccgtcagcttctttaagcacttctctgtattggttattctagttatacattcttctaaatttttttcaaagttttcaacttctttgcctttggtttgaatgtcctcccgtagctcggagtaatttgattgtctgaagccttcttctctcagctcgccagagtcattctccgtccagctttgttccgttgctggtgaggaactgcattcctttggaggaggagaggcgctctgctttttagagtttccagtttctctgctctgttttttccccatctttgtggttttatctacttttggtctttgatgatggtgatgtacagatcggtttttggtgtggatgtcctttctgtttgttagttttccttctaacagacaggaccctcagctgcaggtctgttggagtacccggccgtgtgaggtgtcagtctgcccctgctggggggtgcctcccatttaggctgctcgggggtcaggggtcagggacccacttgaggaggcagtctgcccattctcagatctccagctgcgtgctgggagaaccactgatctcttcaaagctgtcagacagggacatttaagtctgcagaggttactgctgtctttttgtttgtctgtgccctgcccccagaggtggagcctacagaggcaggcaggcctccttgagctgtggtgggctccaccccagttggagcttcccagctgctttgtttacctaagcaagcctgggcaatggcgggcgcccctcccccagcctccctgccaccttgcagtttgatctcagactgctgtgctagcaatcagcgagactccgtgggcgtaggaccctccgagccaggtgcgggctataatctcctggtgcaccgttttttaagcctgtcggaaaagcacagtatttgggtgggagtgacccgattttccaggtgacccgtttctttgactaggaaagggaactccctgaccccttgtgcttcccgagtgaggcaatgcctcgccctgcttcggctcgcgcatggtgcgcacacccactgacctgcgcccactgtctggcactccctagtgagatgaacctggtacctcagatggaaatgcagaaatcacccgtcttctgtgtcgctcaggctgggagctgtagaccagagctgttcgtatttggccatcttggctcctcccccttctcttttgttatgagtggtcagggatgtcctctccggggtggtggtatttgagcagacatatggataaagtatggaagtgacacacaactttattgagaaagaccatctcaggcaaatataaagtctctgaagaggaagatgtgtgtgtatgtgtgtgtgtgtgagtataaataatgtgtatatgtatgtatattttaataaccacatagactaaaactatccaactgaaacaacttaggtatactttgagaaatataaaatgaaattgtaaggtagaggtagcattaataaactatctagtataccattaaataagtttgtggtgattggtgattcaacacccgaatcatctaggtaaatcctgaaaaactcatattttattaattgcttctccttccccttctttccccgtccccactcctttctcgtctctttccccccctctccttttctcccatctttcacttctaatttcagtgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaagccaatttgtacttcattatgcattgagataaaatctccaagtttgaagattattaaccaaacttttaaacacatatttttaaagtactcatctccaggtttatggaattgcattaagcagttaaaccggcttgtatagtcccatccattagttcagagtatttgaatcccaaactgttactttggtccagtcaatagagtaaaacccctttgtaacactgatactttgggacaaaacatggattatcagtgggcgctaccaaattataactgctacttttaggctaattaatattttagagagaaattaatttgagttatatgagggtgtgtataaaatggcattaagagctctatttcctggctttgccactgtagttgtgtaaccttcagcaaattaattaacattttggagctgcatttcttcatctggaaaaattgggttgatggataataggatctgcctaataggattgttgtgagagttaaaatgtaaagtgtttagaacaatagcttatgttagctattattatcataattattattgtacctagacactattcatcagtcaggttgtttaaagtattgactagcatactcagggccttaaagaactgactgcccctgaagattttgtgaaaaaagttctagatctagaggtcaggagacctgggcttattgacactagctttgtaaccatgggccaatctcataaccttagccttagccttagtttcttcttcccattaaaaaacaaacaaacaaacaaacaaaaattcaaaaatgatgccttttgcaaaaagggaaagacaaatgacaaaagaaatagggaacatgatagtccttatggtccatcatgtctagctttagtattgtgatattactgttccaagctctattttcttaaatgatgccctaggttctgagtttcctatagggctatgaggctatggatcacaagaagttgaggattctactaggtataaggagtctgtgactcttttttttttttttttttaatgtatttttgtcttgagatagagtctcactctgtcacccaggctggagtacagtggctccatcatggctcactgcagccttgaactcctgggctcaagcgatcctctttctcactttagccgcccaagtagctgggactacaagcacgctccagcgtgcccagctaattatttttttttttttagagatggggtcttgctatgttgcccaggctggtcttgaactcctggcatcaagcaatcctcccacctcagccacccaaagcgctgggattacagatgtgagccacagtgcctgacccttaatgtttttttaaattttaatcagggttttgcacacataatgtaaaggagtgcttccaaacttctttttattgtgatccacaatgctgtgcacacatattttatgaaaatattttgtgaaaaaacaatactaatgagatgcacactggttttctattctatttcatttatttaaatgttggctcttactcactaaattgatttaattaccctgtaaaatagtgctgttcaatagaactttctgtgaagttgaaaatattcagtatctgcactatccactgtagtagctgccagccacatgtggctgtggatgatttaaaatgtggttattgttggccaggcccggtggctcacacctacaatcccagtactttggaaggccaagatgggaggatcgcttgaggccaagagtttgagacaagcctggttaacgtagtgggaccccagctctaaaaaaaaataaaaataaaataacaaaaatttaagagatctttaaaaaattaaatgtcgttagtatgaggaactggatttttatttttatgtccatattgggcagcatcactccagagagattgtaagtcatggtttgaaaagcacaggtttaaaggctgctattctacaaagtctctgaaaaacagctatccactgccttcatcctccccatttcctctgcctcagaggcaa

SEQ ID NO: 13140 - DNA, 18700 bp, Human
  misc_feature (1)...(18700): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttactagctgtggatgttagtcaacaacttagcctctctgggcctcaggctcctcatctgtgaaatggagctaagagtccctacctcctagggaacagtgcctacacgtggcttgcaatccactaatgggtgttgttattattaggaaatgttcagtgaaactgtatagcatgacaaacatcaagtgtgtcattacagagattatccctatagcaaccaaggccaaacgcctctgcctgactctcagctccctccacccccagtctggccccacctgccttccagccttgccacccaaggcctgatgacagcagcagttgggaggaagatgctgacagctgatccgagggggtggggcccctctcaccactccttggggcggggagccctgctctggagctacctgcccagcccagtgtcaagtcactgccgagccctgtggcagtttcggggaggaaggggcacctggaaaggcagagctgtgctggggaggatccttccctccaagtggggctccatccagcctgcagaccacagcccggagcgggagccgggcagaggagtcaaggagctgggctctgcctctccacctagtgactcctgccctggctgcctctttagaccacagtgagtttaaaggaggttgaaggtgctttttcacctgcctgacttggaactccatgaggggggatgtcatgaccagcataaattagggggaacctaatgacgtctgccccttgttcttttaagcttcaatagaaacactcagtccaagatctgggaagacccttgtgcccatttttaaaagatttcaactctggccattaggagaagtggagagatcaggtgacaatgagttcccagttcaatgctggatttactgctggcatccaacgtgctccactgagcaagcaccagctcctcatgctgcaccactgtgcaagcgagcctcaccctctgcgggggcggggtgggggggcagcattccgctccggcctccgcagcttcgcacgtgccgctgtctccggtggaacaccttttccctcccccatctgactgtgtttcactttttcctcaagactctgaaaggtttcctgactccctcaacgtgggcgaggagctcttttcccctactcccgtcccgctgcctgtccctactcccgttgtagttctgatcacactgatgtcctgcgtgtctaccattctaagccgtgggcttctcaaggcagggcctggattttgtcttaaacagttcagggtccccgggcccttgggcaccagggggacatctcatggtgcaataataagaaacactcacactttacagagggaaggttctatcgctttccctagatcgtggccagccacggtgtcaggtggctgcccacctgcagcagagcttcctggtgctgcgggagggggcaggccaggcctggtggggccagtgaagggggtcatccccttcccacctggcatgaaacgcctgtgttgtgctgcgtcctgagacccctggggaaatgcaccattcattcattcattcattcattcataaaggtcactggctcctgcctgggatctgggacccagcccctgagcacacccccgcccccactgtcatggtcccgctgtttgtcttctcccttccgacctcccgtggccccagcgcggccagctcacagtaggtgctcgggcagcgtttcttcagggacctagacggcctggagaggaagggccccagcccagccgcccgggcctctcacctggctctcggggcgcccggctcgcacttcctcccgccgccccgccccttccacattcctgccccgccgggcctgccccgcgcagtctgggtctctgcgccgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgaggtgagtgccccgcgcctccgcctcgcccggttccgctcgcgcgcccgggtgtacaggtccgtgccggagcggcccaggctgtgcgcctaacccggcctccgaggggtgtcccagcggggcctggggtccagggcagagttcttccgccccagccattgggaatgaaggcctcagtgatgttatctgtaaagccggaggaaatggcatccaccggggagaggtgtcacaaggactgagtgaggcgacctgggtgcacacaagatcctaagacagcacttggccacacaattccgctgagggcctgagagcttggaagccagactgccgaggttcaaattatggctttgcctcttatagctgtgtgcccttgggtaagtcccctaaccctgctgtgcctgtgtccctcactacatcacaggtgagtgacagtgcccaccacacagggtcactgtgacagagagttaatagacctcaagcactcagccccggcctgtgcacaggaaggactcacggagagttggcacatgtcgctcctgggaaacattgtctcccttccagctcttgccgctggaaagcacatgccatgggctctgccttggagggtgggagcacgccagctgtagcctcagctgctgggcccgcgtctctgctctcctctgagccccgtgcccttttgtaacctgcttagcttctctgagcctcagtttcctcacaacaaccccatggggtagagggactgtagggcagtggtgaagtggagcccaggggaggctgacaggcagctcccgtgcggtagctggcatgtccttggcgctgtaggcatgcccaccgttaatccttcctgacatgctcactgactgcccaggcagactccacgggcaccaggcggcccctgctctgccgcctctcagccctgttgtcctgggagtccatggagttgcttccagcatctcttctttttttttatttttattttttttgagaagagtctcactctgtcacccaggctggagtgatattggcacaatctcagctcactgcaacctccgcctcctgggttcaagcgattctcttgcctcagcctcctaagtagctgggattacaggcgcccaccaccacgcctagctaatttttaaaattattttattttattttatttttgagacggagtctcgctctgtcgccaggttagagtgcagtggcacaatctcggctcactgtaacctctgcctcccaggttcaagcgattctcccgcctcagcctcccgagtagctgggactacaggcgcgtgccaccgtgcccagctaatttttgtatatttttagtagagacagggtttcgccatgttggccagaatggtctcgatcatttgacctggtgatccgcccaccttggcctcccaaaatgctgggattacaggtgtgagccaccacacccagccaatttttttatttttagtagagatggagttttgccatgttggtcaggctggtctcgaactcctggcctcaagcgatctgcccgcctcggcctcccaaagtgctaggattactggcctgagccaccgcaactggcattcttcctccttttcttcccagcatcctctaagcccctggggttgtataggtgctggagcatctgagcacaagcaggacggtcgggcctaccccagttcttatcacactgtagttcttatcaggatgatatctgtctgcctgtctcccacccttggcccatgtgctttctgctgcagtggcattgagccacttttgtttagtagcttgcggagctggtgtcacctcctttgaccagtcatacatttttttaagttgggggaaacatgtttctgggcccctagatgctgcccatgggaacccaacaatgagggcacccggggaagagcaccacacagggacaggtggcccaggcccaggggaaggcacctgatgggcgggggctggagggctgatgcctcaccaccagctctgagatgtccttgatggtgagaccatcccaacttcagaggagttatgacgtggaaatgggcctcttccagttgataagatgtgaatgctttgagggacatgctggggctggccagaaatggggggagggcatgcttatcaccaggaaaatgggctggatttgtccaggctcctcccgtctgggggctctgagttccctggagcaggagagtcctcttcatttaaagaacccacaatgggccgggcgtaatggcccacacctgtaatcccagctctctgggaggccaaggtgggtggatcacctgaggtcaggaattcaagaccagcctggccaacatggtgaaaccccatgtctaccgaaaatacaaaaaaaattacccgggcatagtggcaggcgcctgtaatcccagctactcgggaagctgaggcaggagaatcgcttgaactcaggaggtggaggttgcagtgaaccgagatcgcgccattgcactccagctcggggacaacagagcgagactccgtctcaaaatatatataaatatatatatatatatgtaattaaataaattaattaaaagaacccacaacgtgtaagagttggaaaggcttcattttgcagatgggaaaactgagtccagaacccagaggcttacctgggggcacatggcccggcagtggcagcactgatctagagcccaggtcttccccctcccgaccagggccttctccacagcccccagtgctctgcctgctggacccagcctcctcctgcccctgtccctagcaccagactcttcctctaggcagccctcgaagcccaaggggccagcagccaggaggctggagtcccatctcccagacttcctgcacacagcaaagggctgagagcagcctgaggatttggagggacctcagtgaccctcatctggctgtgacccaaccctggattcagggcagcaggggagggcaaggtggagagagctcctaggacagggggaagccccaggctggggtgccagcctctgcccagtcctggctggcatttgtggctgcaaccattcccacaggttcaaagcctagcagcccccacaccagcatggggataggaggtggcagggagcacccggccctgctggctagagccccctgggtccttcctggttcgcacttggactcccatgggtgtcctaaccagggatgccccgacactccctcttgagccaggtcccccatcttggtaatgattcattttctgtctgtgagcccctggagggcagacctgagcctgagtcatctccgtcctggtccagcacaggcccagtccttcttttctggctgaggacggcttaacagataaaattaggtgccattgatcccatggacagagggtgaccctgcctgggggtcaaagaacaacacaacaaaaggtacagacagagtctctaggatgacgtcccgagtgggggaaagggctgtgacagttacaagccagaggggaaacccagcccctttctgtctccgggaactggagttggtaacctcaggaaaggcaggtggctgaggacaaggcctggtctctgcagccacaaagacctggctctgtcactagccagctgttcagtgtgtcaccttgaacaagtcatttcctctctctgggcatcatcagaaagtgaaggttgtactgacgttccgagcttgcaaggatcggagatggtgccagtacacagccacacacagaagatccttagagaatggtgggtggtggtgtcattaccatgggcatttgcaaagcactgaaacatgtctcccaagagatttccagcaggctgccttgcagctcagatcaagaaggtgactgagtgggtggtcaagctgggagctcagatgcaagggcaccagtgcccttcacaatgacaggcccctactctaggacaaaggtcagaagctgcggaggggctgggtgtattagtccattttcacattgctataaagaactacccgagactgggtaatttataaagaaaagaggtttaattgactcacagttctgcatggctggggaggcctcaggaaacttacaatcattgtggaaggtgaagtggaagcaaggcacttcttatgtggcagcaggagagagagagaagggggaagcaccacacttttaaaccatcagatctcgtaagaacttcctcactattggccaggcgtggtggctcacacctgtaatccctgctctttgggaggccaaggtgtgcagatcacttgaggtcaggaggagtccagcctggccaacactgtaaaaccccatctctattaaaagtacaaaaattaggctgggtacggtggctcacacctgtaatcccagcacttcgggaggccgaggcgggtggatcacctgaggtcggaagttcgagaccagcctgaccaacatggagaaaccccatctctactaaaaatacaaaattagccgggcgtggtggcacatgcctgtaatcccagttactcaggaggctgaggcaggagaatcgcttgaacctgggaggcagatgttgtggggagctgagatcgtgccattgcactccaacctgggcaacaagagcgaaactctgtctcaaaaaaaaaaaaaaaaatcaaacccgggaggcggaccttgcagtgagccgagatcaggccactgcactccagcctgtccaggaggcgacagagcgagaccctctctaaaaaaaaaaaaaaaaatatatatatatatatatatgtgtgtgtgtgtgtgtatatatatatatgtgtgtgtatatatatatgtgtgtgtgtgtgtgtgtgtgtgtatatatatattagccaggcgtggtgacacaccctgtaatcccagctactcaggaggctgaggcaggagaatcacttgaacccaggaggcagaggctgcagtgagcaagattgcactactgcgctccagcctgactccgtcgaaaaaaaaaaatctccctcactatcacaagaacagcatgggggaaaccgccttcatgattcaatcacctcccaccaggtccttccctcgacacgtggggattacaattcgagatgagatttgcttggggacacagccaatccatatcactggcgaaggtgtcaccacctggaaggatggacgggggctcgtgtggacactgcccctggccaccagcttccctggtggtgagcatttatgctggggcctcacctgccagtccatcctccctcccacatcatggcatgacactctccccctttaaccagtgaggagactgtcctaaggacacatagcaggtgagtgctggagcccggtcttaagccaggcatatctaaacctaaagctagtgctcctagctaccaggtcacactgccctggcaaaggcaaagggcctgagggagggcaccctgagcaggcaaggggggatggagaggtaggtgaggcccttgtctgttcctgttggttccttttggtagagggagtgatagcatgtctagagtctggggtggggccagcccttacctcaaggctatccagacttctccatcttcctcagctgcccactctgggacctgcctttctccccaccccactccctgcagcttccctggaggacggtgctgacccactgctcaggtgctgcccctcccagctggccagggcctgactcagagggccagcgggcaggcaggcgtgaaattctcctgagtcacgggcaggtgtgggccgcacccggcatgggaagggaagaggataggggccccccagactgtggccccatcaaccagccctgagcaggcagtcaaggcttagggacccaagagcgggcggcccagcatcccctcagagcagagggcacaggttgtggcagagttttgcaaacccatcttacaaaagctccctcttcattcctgcattttcatctgtgtacaaaacctggcctgctgcccgttcatctcaccttcatggaaaggcagcagtgagctcaggctgggcagggctggagtaaggggcctctgtcctgggtgacctcctcccaagcccaggcaggacaaagaagaaaggcccaaacatggggcactgggctgggcgtggtggctcacctgtaatcccagcactttgggaggccaaggcaggtggatcgtgtgagtccaggagttcaagaccagcctgggcaacatagcaagaccccatctctgcaaaaaatacaaaaaattactttgggaggccaaggtgggtggattgcttgagttcaggagttcgagaccagcctgggcaacatggcaaaaccctgtctctacgaaaaaagaagaaaaattagccaggcatggtggcccacacctgtaatcccagctactcaggaggctgaggtaggagaatcacctgagcctgggagacagaggttgcagtgagtcaagatcgcaccactgcactcaggcctgggtgacagagtgagaccctatctttttttttttttttttaaaaaaaaggccaggcgtggtggctcatgcctgtaatcccagcactttgggaggccgaggcgggtggatcacttgaggtcgggagttcaagaccagcctggctaatatggtgaaaccccatctctactaaaagtacaaaaaattagccaggtgtgctggcgtgtgcttgtaatcccagctactcacaaggctgaggcagaagaatcacttgaacccaggaggcagaagttgcattgacccaagagatcacaccattgcactccagcctgggtgacagagcaggactctctctcaaaaaaaaaaaaaaaaaaaaaaaagcccgggtacagtggctcatgcctgtaaccccagcactttgggaggccaaggtgggcagatcacgaggtcaggagttcgagaccagcctgaccaacatggtgaaaccccgtctctactaaaaatataaaaattagccgggtatggtggcacatgtctgtaatgccagctactcgggaggctgaggcaggagaatcccttgaacccagaaggcagaggttgcagtgagccaagatcacgccactgcactgcagcctgggtgacagagtgagactccgtctcaaaaaaaaaaaaaaaaaaaggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgaacctgggaggcggaggttgcagtgagccagatcacgccattgcactgcagcctgggtgacagagtgagactccctctcaaaaaaaaaaaaaaaggaaaaagagaaggaaaaaaaacggtagaggggcgcattggggcattctggtaagggatcaggaaaggcatcccagaaaggtgaaggtagcatttaatagtggtcttgtttggattgtgagaggttgagaggcaaaggaggaaccccaaaaagctgcgagttccccagagcaggtattgagtctttggtgcctgcttcccagtgtccagaactgggcctagagaaggtgctaatgctgctgaatgagtaggtgaatgaacaaatgaacaaagcaaggaatgaataaacatgtaggttaatgttgttctaggaaggggggacaacatgaatgaaggctcagaaatgggagtcccagcggtgtgtgccagtggtcccagctcttgggaggcagaggcaggaggattgcttgagcccaggagtttggggttgcagtgagctgtggtgcctgtgaatagctgctgcactccagcctgggaaacacagggagaccctgtctgtgaaaaaaaagaaaaacgggagtcccctgcccccatccagagggcaatgataaaaataacagtagctggcatgtagatgtgcttattttatgccaggccctgagctaagggctccgcatggaatatctcactgaatccttgtagcggcactgcggtagggactttttttttttttttgagacggagtctcactgtgtcacccagactggaatgcaatggcgcgatctcagctcaccgcaacgtccacctcccgggttcaagctattcccctgcctcagcctcccaagtagctaggattacaggcatgtgccaccacgcctggctaatttttgtatttttagtagagacagggtttcaccatgttggtcagcctggtctcaaactcctgacctcatgatccgcccacttcggcctcccaaagtgctgggattacaggcgtgagccagcacacccggccttttcgttgttgttgttgttgttttgagacagagtcttgctctgtcacctaggatggagtacagtggtgcgatctcgtctcactgcaacctcagtcccaagcaattctcgtgcctcagcctcttaagtagtgggattacaggcaggcccaccattcccagctaatttttgtatttttagtagagacggtttcaccatgttggccaggctggtctcgaactcctggcctcaaggcccacctcaacgtcccaaagtgctgggattacagggtgagctatggtgcctggctggtagggacttttaatattcccatttcacaactgagaacaaagctggggaggttcaggagtttgcaaaagcagacaggctctaggccgccaccccaggcaggccaaggaggaggcttctcacaaacaactacgctccactgacccccaaggagggagcagcgctgtggacagaccaagtccccagtgcctctccgaagcctcctcacaccctcccccgccctgcttctcctcagagctacacccccacggtgtttgagcggtacatggtcaacctgcaagtgaaaggcaaacctgtgcacctccacatctgggacacagcaggtgggtgtgcaggggtggggcagggtgggaggggcttctgtgggcccctgatgcctgggacagattccgctctgcttccttctgaaccagggaggccagccagtctccaagggacaggtgtgggccaggagtgggcccaggagtctgagccctccttgcctctgcagcagtgtctcctgcacccccagcaccccagggccgcccgctacgtcctggaggcaagcgggagtccagcactttgctttcaggactgttcctggccttctgagcactccactctgcttttagtttctgtaggatctgtctgtccgtggcctctgccctccagcctcctgaccttgcctataccagggtgagctctaagctaaactcagggcctcccagcagccctcttagttggacgggctaagatgtctttgccaggttcccacctaccccttatttctcactcctaagctcagggcaaagctggcttctgagcaattggccccagttcctccaggcggtgccaggcctggcctctgccttgcccgtcatcccttccagacatcccacaggcagaggtgagcactgccccaaaggggcactcacatggagtagccacctcagagccaaatttgtgccaaactctgaggcaaaaaactaggccctgtccccagaagctccccatctgatgaggtgacctcctgacattggggcagtgctgacaggggccaggagccctgaaggcagtgaccacctccactctgcccagggcaagatgactatgaccgcctgcggcccctgttctaccctgatgccagcgtcctgctgctttgcttcgatgtcaccagcccgaacagctttgacaacatctttaaccgggtaggtactggggggcagggaggcatagcccccatagccaggccactccactctgccacccaccctcgacccagctgactgtcagagcttggcaggcccaaaatgatattgattccagagcttttggtgtatatatggggaaactgaggctcagagtggggcagtggcttgcccagggttgctggcacagggatttggtggcagcgtctgcccttctgactcccagtacagtgctccttgcctaccctatgctgcagactccgaacactgtggctcttcccacggcggctctgcctgaggttgctgggtgagccagaggctgctacatctccccagcctgtgcccgcccaaggtgcatgaacagtcaagtcagagtccagcagctctgcgtggctgctggttctcagaggctgctcatgggcatcagggatgtggccccttgaattcctctgctccagctgcctttagccatggcacagcccctcacccactgctgccagggcctccgagtttccgcagggtacagcccatgacagtatttgcaacaacaacaacaacggtgacaattttaaggactgaccacgtgccaggcagtgttcttggtacttgcatgtatttactcatttactcccccggccaaccttatggagtattattattcccggatccagtcactcgtccaaagatacacatctattaaagtggtaacactgggatttgaacccaggcaggctgctccgcccattcattcagaacgaatgattgagcacattcgttctggtgctgttctgggcattgggtaccaggagagatggtggtgcctggggccagggtgctagcagtgggggtgacgagaagggggctgattctgaatcggtctagaaggcggagtttgctgatgatcagagtttcttgttggattggatgtgggtgggagggaggagtttttttgtttgtttgtttgttttttgaaacggagtcttgctctgtcacccaggctggagtgcagtggcgccatctcggctcactacaagctctgcctcccaggttgataccattctcctgcctcagcctcctgagtagctgggactacaggcgcccgccaccacgcccggctaattttttgtatttttagtagagacggggtttcaccatgttagccaggatggtcttgatctcctgacctcgtgatccgcccgcctcggcctcccaaagtgctgggattacaggcgtgagccaccacgcccagcctgggaggagtttttaccagagcagctggaaggtggagttgcccttggccaagatgacaaggagcaagctgggttcgggagtgggacatcctagtggaggtgtccggcaggcagtgcgatgcatgcgtctgcagttcctccgagcaggcagtccagctgggcagcctaaatgcagctgcacatttagaagctacgggtgcagtaaagcctgggggaggctgcccaggaagggagagcagctagaggagaggaaagaccacaggctgaaccccagggagaggaggaggagggcaaggccccataagacctaggagagccaggagagtggggtcctggggtgaagtgcaggctcagtcaggtaggagggagtgatgcccagggtcggggttatcgagggatcagtaggagcagggctaaggattctctgatggtggccgggtgcggtagctcacgccttgtaatcccagcactttgggaggctgaggagggtggattatttgaggagtttgagaccagcctgaccaacatggtgaaaccccgttgctactaaaaatacaaaaattagccgggcgtggtggcacatgcctataacccagctacttgggaggctgaggcaggagaattgcttgaacccgggaggcggaggttgcagtgagccaagatcgcaccactgcactccagtctgggcgacagagcgggactgtctcaaaaaagagaggattcactgctgggttcagtgggagccaccaaggaaacctttctcatgggcagtttcggtggatgcgggggtgtggggaatctgccagggaccccacaaaggccccatttgcttccaggaatgaggtagtttgatgccaatttttgtttgtttgtttgtttgtttgttttgagacagagtctcactctgtctcccaggctggagtgcagtggtacaatctgggctcactgcaacctccacctcctgggttcaagcgattctcctgcctcagcctcccgagtagctaggattgcaggcttgagccaccaagcccggctgatgccaatttttatcaggcaagtttcatgcccaaaccagccgacttcagccgacttagtgctcctggagataggaagccccctcccgggatccccggctccccagctgtagtccaggctgaaagaactcggccctggtggcctcacattctgcagagcagccctccctccaccaggcaagcagttgaggcagacagctgctgcaaccattttgtgagcagatttatttatttattatttttttgagacggagtctcactctgtagcccaggctggagtgcagtggctccatctcagctcactgcaacctccgcctcccaggttcaagcgattctcctgcctcagcctccagagtagctgggactacaggtgcacgccaccacgcccagctaatttttgtatttttagtagagacggggtttccccttgttggccaggctggtctcgaactcctgacctcaggtgatctgcctgccctcagcctcccaaagtgctgggattacaggcgtgagccaccgagcccggcctggattgattgatttatttttatctttttaattgatttatttatttattttgagatggagtttcactctgtcgcccaggctggaatgcagtggcgcgatctcagctccctgcaacctccgcctcccaggttcatgccattctcctgcctcagcctcccgagcagctgggattacaggcacccgccatcatgcccacctaaattttgtatttttactagagacagggtttcactgttggccaggctggtctcaaactcctgacctcaggtgttccacctgcctcaggctcccaaagtgctgggattacaggcgtgagccaccacacctggcccagatttgtttttaaaggatcccttacttccttatatgttttgctcagtttggtgggtgtccatgagggcccttaccctgcagagaggaaagattctagaacggcaggagcagggttctgagccccacccccaggctcaaatcctgccatttccagccaaggccaagttacatcgcctttctgtgcctcagttaccgcacctgtacagtgggattggttgtgaacttgctgccacggcctcggggaattaatgggtccatacgtgtaaattcttagatgaggttctggtaccaaatagtttctccctaggtgctggctttgctgattatccatatcagagctcaggctggggagcaagagagtggtccactgagagggccagaactctccagggctcacacatgccccccacatgccccctcgcccccctgcagtggtacccagaagtgaatcatttctgcaagaaggtacccatcatcgtcgtgggctgcaagactgacctgtgcaaggacaaatcactggtgaacaagctccgaagaaacggattggagcctgtgacctaccacagggtaggaaacccagcccgaggtgggagttggggaggactgagtgaggggacctctggatgcctctcagtggcaccaggtgtccagaacgctcagggtgtaggtcagagctgcggtcgtcttagaggctgtcagaggtcagaaacttccagcacttagaaatggtccctagaatattctgggagcctccacaggcaaaagggagaacaaggaagtaggcatatcagagtcagttccaccaccaacctgagacccagagagggggcccaggcaggcacccacatattcagaccgtgggtccctctctgctacacgtctgggttcatgggaagttcatttcttggtgccttgagaggcaaagaggcccagaacggaggttaaaaacaacgaaggctggcagggcgcaggggctcacgcctgtaatcccagcacttgggaggccgaggtgggtggatcacttgaagtcaggagttcgagaccagccagggcaaaatagcgagaccctgtctctaccaaaaatacaaaaaattagccaagtggtgtggtggcgggtgcctgtagtcctagctactctggaggcagaggcaggagaatcacttgaacccggttggaggagctgcagtgagctgagatcgcaccactgcactccagcctggacgacagagcaagactccgtctcaaaaaaataataataataaaaataaagaaaagaaaaacaaacatgatgaagtgcatgagggcgcttgggcaagcagggatacgggagccatgggtgctccgcagaccccaccttccactcttgtccgggaaaaggaagcgagaacgtgaggcctgcccagtgcccccttcaccgcagccccatccacctctccctctagggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtgaccgccgaactccactgcaacagacgggcgccaccaaagccaggccctgaggcctgggagtcctggactgagaaagggggttcctgggcccacctgctctgtgtagggctcgtcctgcggtgcccgagaatcactcgctaacccctatgcccggtcccggaccgacatcctggagccgcctgtgcagcctgatgccccctcgtggctgctcccagggctgcacctgccaggacctaatgttcttaggtccctctggccagaacccacacccggccccttcccacctgtcatactggtaactgtaacaagaaaaacgacatcacttatcattgtgtcgtgcctcttttttctgttttcttttttttgagacggagtctcgttctatcgcccaggctggagtgcagtggcgcatttcagctcactgcaacctgtgcctcctgggttcaagcgattctcctgtctcagcctcctgagtagctgggattacaggcgcgcgccaccacacccggataatttttgtattttctttagcagagacggggtttcaccatgttggtgaggctggtctcgaactcctgacctcatgatccacccgcctcggcctcccaaagtgctgggattacagccatgagccaccacgccctgcctatgcctcttgtttcaaggtgtctttacacacacgttccaaggtaggtaaaagcccaccccatctaggcactgggatgggactgcttggatccaaaccagctttattgcttccacgaccttgggcaagttcttctgggcctcagcttcctcacctgtgaaatggatcacagactaagccatggaactttcggatgagtaagagggtcatgaggaccaacacacgcaaagagcttagtaggtgcctagcacgcagtaagtgctcacaaaaggttcggccagggccgagcacagtgactcatgcctgtaatcccagcactttgggaggccgacgtgggtggatcacgaggtcaggagtttgagaccagcctgaccaacatggtgaaacccccatctctactaaaaatacaaaaattagccaggcgtggtggcccacacctgtaatcccagctactccagaggctgaggcaggagaataggttgcagtgagccgagatcacaccactgcactccagcccaggcaacacaacgagactccttctcaaaaaaaaaaaaggtgtagccaggtgctgtggcacacctgtcccagccacgattgtaccagtgcactccagcttgggctccaaagcagaaaaaaaaaaaaaaaaagaaaaaaaagtggccgggtgtgttggcttacgcctgtaattccaacactttgggaggctgaggcggatggatcacctgaggtcaggagttcgagaccagcctagtggtcacatggtgaaacccggtctttactaaaaatataaaaattagttggatgtggtggtacgtccctgtaatcccagctacttgggaggctgaggctggagaatcacttgaatccgggaagtggaagttgcagtgagctgagatcacgccactgcactccagcctgggtgacagagcgagactctgtcaaaaaaaaaaaaaaaaaaaaaaaaaaaaaaaggatcttgacttctgacttcagagcagttgaggcttgtgcaagaagaaaaatcctgcaagaagtctgcataaaaagcataannnnnnnnnnnnnnnnnnnnnnnnnnnncccggggggggggtccccccccccccccccccccggggggcccaaaggggattttccccaaaaaaaaaaaaaaaaaaaaaaaaaaaaggatcttgacttctgacttcagagcagttgaggcttgtgcaagaagaaaaatctgcaagaagtctgcataaaaagcataacagcaaaaaaacccatca

SEQ ID NO: 13141 - DNA, 20076 bp, Human
gctgggattacaggtgcctgccacctggtatttttagtagaaatgggggtttcaccatgttggccacgctggtctcgaactcctgacctcaggtgatctgcccgcctcagcctcccaaagtgctgggattacaggcgtgagccactgcgcatggctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactcttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcggctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccaccccaggggactctcctgggtgaggtgcctgcgtttgggcaagcaggtgggaggtgccaaggaccagacccctggctccttggagaatccggggctggaggcccatggagtcccgcaggaaagtggagaaggtgagggcggggcacgtgcccgatcccttgccccgttgccgccctccatgcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcatggcgggctccgggccgcgccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccaggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccttcgggccgggcgcggttgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaatttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagggaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctgtctctccctggggtcccacctggaagcccaaggccctcagaaaaggggtttccttgcctgtcatggccctaccctccaagctgtgtcctggatcttggcagtgtccccctgagcgccctggctcagacatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtccggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcgcctggcctatttattatttttatgtctcactctgtcacccagactgcagtgcagtggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttatttttagagacagtctcactcttgtcacccaggctggagtgcagtagcacgatcttggctcactgcaacctctgactcccgggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgccccttattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccagatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccacatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccaggtgagcccgggcccagggcataccgggcagtgagggtccctggggcgcctgggcctgacccgggtgtccgcctcccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcacacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggactccctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctctgtgtgtgtgcatgtccgcgtgttgctctgtgtgtgtgtgtgtgcatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaaggtgaggtctttctccgcatccactgcccgttcgcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacccccctctccccatgcagactatgagcacgacgatgaggatgactcctacctggagcctgactccccggagcccggaaggcttgagggtaggtggggcgggtgggcccggggagctctgggtgtgtaggaagcaggggctgggaccgggagcagagcccctcccaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcccctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgctgaccccagcccctgaccccgtatcctctctgcctcccatcccctcccaccttcaggctcccgggtccagcccctcttctcctgccgctccctccctccttccctctggggtcccagtgccaacagtccttcagcccaccagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccagggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctacagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttcggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcagcacgagccctacccggatctctgttgtcctgagctttttagggtcacaggggccatagcaggcagcttgccgtcctcacacagagggtggagtggggaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcggacgaggactatgagaaggcaaggctgagcggcaagcctgggtcccagtggccagtaggtggacaggtggtgggaaagccataggccagggcggcccctcacagaccgtcctgagcaaggaccccccgagaacccgggagcctagggggacacagcaccatgtaaagccccggatcccggcaccgggtggccaccgtccggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccactccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgtccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctgcgcctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtgg

SEQ ID NO: 13142 - DNA, 19157 bp, Human
tcaaaccactgcaaagtgaacaaaggtgtaagtgtcttcataatctgactcatactccagccctggggacctgtgttttgtgcttccaaatgctaatatcatgcaacagtcaaaagaaagagcaaaattaaaggctgtgatgtatggtagaaagagcaaagactagtcagatggacctagattcaatactggctctttaggagttgaaaagatggtcagccatttaacctctacaagccttgatttcttcatttgtaaaagaggcattgccaggcacagagttgactttaaatgtcattatttcaggggaaaaaaggctgacaatagtacatttgaaaataacccacattaaaatgtggtcatgtgagtgaattggatctctttaaaagagaatagaaattggcattaagaatagtgggatgtcctgtcagagatggacatcagcgatgaggaaagaatccaagagaaggtgatattcaaatagccaaaggagcatttggtttcaggaaaattggctaccaggtatctcaccacctaagtgggagggaggttggcaaaatcaagtcagggcttagaaattgggatactgggcagatttctaagatatctattaagtttaattactgtgctagacattggagattaaacgatgagtaagacacctaccttccagatagaacacaccatcttttgaatgaaatcagcaggtagacaagataaaaatacaatgcaatctgaagtgctagaaaaggctaggcacacagttaaggaacagatctgtgggagcctctgaagcctttagagaaaatatgacgtttgaatagaatagttcttgaaggatgaataagagtgcgcgtgccagggaagaagaactttcccagcagagagaaaaacgcaaagcttaggaattaaggactagaagataggaactcagaatcagttaaaagcccagttgtgcaaattgatcaatgagaccacaggcagaatattaacacagagccttactgctgactcctgcatcattgggctttaacttagaattttcctgcctaaaatgcatgtttgtcccacagactcagagaggagtgagtctagagatatgagtcaagtggttccagcatttaggaaaaaagaaatgcagagagactgatgaccagctaggtactgactcccactgaattagacagtactagggcccaaaggtgcttattagaagtgattcagctacatgaggaacagttgctattgacttcactgcattttttttcagctaaaataattattggattatatctacaacagggaacaatgaatgtctactcaagtaactcgtacatttgagtggcttcccggtgttcagtaaatgtccgttcaattaggttcccgaggatatacatggtaacactatctccaacactaaatgaaaaatccatccccagtatcgcaggataaaaacatcagacttcataggcctccgaagtcaagcagcccgaaggattcaacgtcctccttgaggactctcagtcttcaagactccagccacctaagtgaccactcgttcacttctgcccacgcagtcaccacgccggtccgcgtccacttgtggtctcgatatcggcccctcccaccctagccaaggagaccttggtccgagaaacaaagagagcctcacagctccggatggcaccgatctttcagcgatggggaacaaaggggaaggggagaagcgtcctcgatttttgagggtgccctttctgaggaatctgcaggcggcccggggtggagcggaatccccataggccccttctggcccctgtgcaatacaacgcgccccaggccaaggtcctaggtgcaggggccgccgcagagcctgagcccgcagggctgggatgcgggtcgtcagggatgcgggctggggaggggagggtgtgagcagcgggtgcccccagtccccgccagggcgcaagcgcaggcgcgcagggtgcggtcgcggaggggcgggcacagtcgggcggggagctcggcggcggcgggcgcgggaagatggcggcagcggcggcggcggctgcagaacaggtctgtgagtaccgccgcggccgcgggctggaggagcgggggaggccgcgtcctgccggctgggcccgcgggagccctggccgggggtgcggggggcgcgggccgcagggtctgggttcggcggggccgatcggggcggggcggggcgggaggagctgtgccccgccgaggatgctggcacaagctagggaccaggagccaggggcggcctcgggctcggcccggcctggctgatcctcggagggggtgaggaggggtctccttccggagagcctgggaggcggtcgagccagcctggaagcctgcgctgggacgtgccagggacgtaccccgttcagccgccagcagagatttggataaaaataaccgcagccccagcgagaaggctcctcttacaagaaacgggtcagctgttgccccggtgtcagcttgccatctttgttttttgtttctgccatctccaatatgcagacatcccagatttcccctcacgctttggtttttgaagatttagtcaccagtctaaaactatctcctgttcacttttaaaaatgatttatccaagatttcctgacctgcattgtaaacttgtaacttagaatggtttaaaaggctcctcatccccccaaaatctagttatacgtatgcatacatgtacatgcatatgtgtgtgtgttaatatatacatacacgtaatcgctagggtgatttattgtaatacagataattttcagtaactttcccccttacctaacttacttttcctttgaacaattatagtagtttctctttaaaaagtctcattctaaaacattgttgaaaaaaatgagtcaagttttgacctttggaacgattttcttagataattaactttttagagacctattagatatatgtcactggagggctcattctgaagataaaagacgtaaaatctctcttcaaggagcttaaagtcatacagccaaatacatgcagaaaaaatcagctaaagacaataggcaggctgcagatttgtaacagtaaaataaaacatagaggaatgagtgaaactgaaaggagacaaaacttcttggagttggtatttaaattgtgccttggctttcctcatttcccgcctaagttatcagcttctgtttcagatgattgtttttccatctggttctatttttgctttacacataagtggggcagtctgatccgttactcagtctccacttcaaatttacgcattacgtctccagccctgaacttaactgaattttccataggcacctcaaactcaaaaatgttcaaaactggactctgtcatacttactattaaaaaggctacaaccatccattcacttgtttaacctagccagaaacttaggaccaaggccattttaagggagctgagaaggacctgcacttggtttaatgttctgctgtcctgggcttgagatttaaacagtgagccccacattttcttttccccctgggccccacaaattatatagccagtcctatttgggagtcatcttcgacccctttgtgccacactcatatccaaacaatcacgagatcctgacagttctacctcttaacacctttccccagacttcagcttcaaagtcaaacctcagtcagtacctcattgggactcttagagaaacctgctgttgatatcttcacttctaggctcttcagttccagttcatctctttttggagtgattttactacaatgcaaatctgattgtataggaaacctattttaactcttcagtagttcccctttgccttcaggataaagtccattgttcttgtcatggtatttatgttgcttactggcccctaagcacatctctcattgtatttcttgcttcatccctacacctatccttctcaccatccacataaagtgaccaaaattagttctcccagagatggttgcctctcaaagtctccatgcttcttcctctgcctagagtgaccttcttagctcttttgcctggttaactcctgtccatccttcaagagttaactcaaccttcagcttttcttagaaactttccctgatgcccttgcctgctaggtggagatgcattcctcttctgtaccctttctgtattgtatgcattgctccactacagcacttgtcatgctttgtgaactgttagtcaccttgtctgtctacctgactggcctgtaattaagctccttgagggtggacactatgttcatcctggtagcttggagcacctggcttatagtaactattcaataaatgttaaatgcatcaagatgaagacagtaatgtgcatggtttggcagagaagagtaaagactacgtctcaggagggatgaattttgtcctttctctcttttatgtggacctatattcaaactttggctaacacttttaagttgcccatctgttagggctgtcagaagcctgaggttcttttttggaacctgactacaaattctgttaagtcttctcttaaagtatctacttaatctctcctttttcatcccactttagtttaggtcctcttaacctcaatcctccattactacaacatccccagcagcttacttactggtactcctctttcttctctctcgtacaaatgcccacacctttaacactctgaatttgtgctcaaaaacctccagtgactcccaattaaatagaacataaagactagaatttgtaccctgctgtccaagaaccttcacaacctggccctacttttccaacttcctcttccctgccttgccatatctgacccatctacttctccccatttccctaacaactccaggtcatcctgtctctcctccctttgaactctgcagtgtgtattgcctagactattgattttggcacctgaacatacagagtgctttattgcattgttaaatattttatgttaacatgtacacaaatcatatctgttaatacatagaggataaggaccctttcctatagttcttttgtattcctatctatggaattagtgtttaagcgtaaagtgcttaatacatgcgtattcaacaactgaattttctcagagctttaagaaataagtaggacagtatccatttctgcccatttcttttgtgctcttgatattcaagattattacccaaaatgtcattcaaccatagtctaggtcagaggttctcaaatcattttggtctcaggttctctttacactcttaaaaaatggaggattccaaagagctttggtttatgtgggttatattcattgatatttactataggagaagttaaaatggagaaatttttaaagtacagggctatacaagcatacattctgttgagtgatgatgccatcacattggtcatgtagcctttacattcatgggcctaggagagtaaaaacagcaaacagtatctcagtgttatttcaaaaatacagccccccaaagggtttgtggaaccctcccaggactccccaccctgcatttgaaaactactgatctagggtaatgtgagctagtcagtgaaattataagtaacaaactatgtcagcctttccggtcttattttcatataaatgaaaatatataccgttgtccctcaatatctatgggggattggtctcaggacccccaaaggatagccaaatccattgatgctcaagtcccttatataaagtggtgcagtttttgcatgtaacctctgcacatcctcctgtatactttaaatccatctgcagattacttacaacactgaacacaatgtaaacactatgtaaacagttgttatactgtattgtttagggaataatgacaaggaaaaagtcgtacatgttctgtacaaatgcaaccattcacttttttttttttttttttttttttttttgagacggagtctcgctctgtcacccaggctggagtgcagtggcgcgatcttggctcactgcaacctccgcccctccaggtttaagcaattctctgcctcagcctccggagtagctgggattacaggtgcgtgccaccatgcccagctaattttcttgtgtttttagtagagacagggtttcaccatcttggccaggctggtcttgaactcctgacctcgtgatccacccgcctcagcctcccaaagtgctgggattacaggcttgagccaccgcgcctggcctcaaatatttttgatccacagtggttaaatccatggatatggatcccatggatatggagggccagttgtatacgtaaaaaaattaataaattattaataaaagcagttactcactataggatacgtatgacaactctgctcagaaacaagctgtatactttgacagtgggactgttgaaagcagagaggaaaaatatcagatagtgaccttgaagtttcttctgtactttccttctaagcacagttatgcccttatttggaactgcaactcaatgtgatttgcagtttattcatggaaaatgtgtcagtaaccaattcagcttgctatagctatgaatttgcacctaatagataaatgcaccaaaacgagagggtatagctgttccattatgttgtatttcatttttagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaatagtgagtatttgtaagaatactcattttaattgccatggggaattttttatctgctttatagtgaaatcatagactttattttctccttttctatacatgtcttgtctcttactgaattttaatgaatactttattaaaaaaactagtgtgctaatattttcatatattaatttcatttacaaaaaaatgtgcatgggtttatccctttaatggacttaatttttagcaaggatagaattatgaggctcccacctagctcaatcggtagagcatgagacttttaataaggataggatcaactcaatagaagagaactttgccaagatgattttattgctttcacatctccttaaaaatataatcctttctgttttcatttaacttttcctacatttaatgttgcctcctcagctggattttaaaattttaaaccctttgatggcagtaaaaggttatattttatagtcctaagtccccgttgtcaaaggatgcaagaatctggtaggctgattcacactaaagtactgaggacctgataggatgccttttccaaagatatttgcttttttaatgaagaaatccttttaatctgaagttgtgactgtctggggttaaatctgaaactctggcatgtgcatgtacagatattttcagaaggaatgattattgatatacttaagactgatcatgaacatagtctgcagcagttttgaagtgattctttttgtgttattttctacttctaatgcatgcaaggcagtctttttgtatttatgtatgtccaaagcacttctgtctaattcttcactcaaatcagaaagacctcttcctatatatttcatattagatatataaatttttactaggagcacaaatctgaatgcattttattttataaatgtattttatcggagacttctggtcaagatggcagcataaagacatttttatcttcttctctaaaaagctcgttccaaagtaacaatgtcacgaaacagaaatatctttgaagaaagtcggaagcaactgaaatcctaaatcataataaatgaagacacaaagtaggaggaacaatggcagataacttatcagagaggagaatctgcttgttggggaggggatgttggtggaagtaccttgtagaaccctaaaaagccttgggaattagaagttccagtaccttgaaaagcagaagtgaggcaagaactgaaaacagagaagtcatttgaaaatctgtataagaagcagtgagatccctaggcctcctctcccttccagccagcagttagacagctacccctcctaatgtcatacaaaactagtgtgtctctggacacactggaccagagaggattctatctgcctgcggatactggagggtaggggttgggtttccatactgaaacaggaaagtctgggtcctgagactccctttcccacgctctcttttcctcattctccacctccagctccctggcagccaggcaagagacagaagagccttctctgggattcctgatgcatatagaaaaaagatctgaagatactgtcatttggcaagtcccggtgaaaaagccatgtaatttccctcttgtgacacctgtcagtcacaagccctacccctcaaataattttctatgaattcatcactaagtatgaatactgagccagggatcaatagacttttgaggaaagtgccaagaattgaaaaatgatagagatgaaaactcctaaaccatggaaaaaatagaaactcatggaatagagaaaatgccacaaaaactaccaaaaaaacaaaagccctaaattcagtattttcagagaaataagaatatactgcatcaatgaaacaagaataacatgccatttaaaaggcacaagccaggcacagtggctcatgcctgataaagtgagaccctgtctctaccaaaaaaaaaaaaaaattaaaaggaacaattaagaactcatagatatgcgcgtgcacacacacacacacacacacacatacacacacacacagagatgaatgggtgggtgggtagatggatataggtaggtaggtaggtaggtaggtagatagacagaagacattagaagataaaaaaactcttccagaaatttcaacaaaattaatcaactcaggagctctaacatgctgttaataggagtttcagaaagagcacagaaaacactgggggggaaatgatcaaatacataagtcaagaaaatttcctagaacagattgaaaactaccatactgggtccagcgtaatgcataaaaagacacaacaaggccattattatgaaatttaagaaaaccagtaataaaagatcctaatatcttccagagggggcaaaaaagcaggttatgtataaagaatacaaaatcagaatggaataggacctcccaaaagcagcattgggacctggaaggcaataaagcaatggctttcaaaattcagaaagaaaataattttccatctagaattgtatacttagccagtccagcaatcaaatatgaagcattataaagacgtatttttgccatgcacactttccaaaaaattttacttctcatacattgcttagaagccactggaggatgtgctctaccaaaagaaagatgaggatacaggaaactgggtgtctatcagaagagaaagacaaaaggaagttcagcatgaacgtaagggaaagtttatgattacagctgtgcagggggcccatacagaccagtccagcccacgcagaccaaaccagaaagatacaggttccagaaagatttcccgagagagaaaaatagaactaatatattatctgagaggctcagacctacagaaaattgtattgagagattttacagaaatagtggaggatttgagattaattagatttttaaagaaactaaggaaaatgaagtattaaactctgagagacaaggtacaggaaagaaactgccattataggacatatttggtttggtaatgaacaatatttatatggttgtaatactgaaaataatgaccttggatttaattaaaacttgagattggagctggaaaagaaaagagatataaatgagctaaatttatcatctgctaaaatagaaaattaataataaaacctaaattatgataaatgaagaaataacatatttagaagaaatatttgttagatattttagaaatatatgtttagaagaaatacatatatttagaaataaggagataaattctagatgaaatagctaaatttgttgaaagtgattgttcctgggaatgagatgtggagagggtagaaaaaataagaaactattcattttaaattatagacctttagcacattttgacttttagctatttgcatgtaataccttaataaaaataaaattcgttttgtttataagtggaaaattaattgatatatttacctcactgataaaacattttaggaggtctttaacattttggtgataatattttctatttgttttccaattacattaaatgtatgcggcctaccaacagcggacttgtgttctttttcagataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctgtaagttgccacattaactgaaagaaatgcaaacaggagaggggcattagagaaaaatactttgcaaaaacctagttgattattggaaagagatattttcccttagaaaaattagtatatttataatatatctataaatgtatgaatatagtgaatacagtttaaaacatccataaatattaatatttaatactactattgcttttatcatctgttaaaattagatgatttcttaatatttgagattttgttcaatggtagcattttctatgacagatgtaatttgtatgagaatacataggttactcttttctcctccatatgaggaagccattaagaaagcactttcccaggtgagaatactctgtagttttgggggctcttgaagagaatatgccaatctagtcagtggcatcccatgccaagagttgaaaacatagttttcaactgaataaaacctcaaggaggtattcttaccaccacccctgcctatcttaggccttgggccatgttcctccatgactcatgcatttttgcagagctaatgagcaaataaatgtataaaccttcattctaaagaactcttcttccaagtggatggagggagaacagacagagttaaacgtatttgaagttagtctgttattggggtttttaaatttctgtaatttttgtaatttttaaaatatattgttcaggaattttgtttgcagtcttctttgaaaatatattcacaataaactgttttttttgaagattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaagggtatgatttattggctttgttttactaatgggagagaattattctctagagttataaagtgggaagagagttatactgttgttgttttttttttgagacggagtttcgctctgtcgcccaggctggagtgcagtggcgcgatctcgactcactgcaagctccgcctcccagattcacgccattctcctgcctcagcctcccgtgtagctgggactacaggcgcgcgccaccatgcccggctaagttttgtatttttagtagagacggggtttcaccgtgttagtcaggatggtctcgatctcctgacctcgtgatccgcccgtctcggcctcccaaagtgctgggattacaggcgtgagccaccgctcccggctgagagttatactgttttaaagtagtataaaagaatatattccagaacaccggaaaggattaattctagatttgtaattaactagcttgtgtgatcattatcaagtcatctttatctcaatttccacatctctaaaacattaatagaaacatttgactttcatctctcatgactgaagcttctatttctctatctctgataacaattctcacattaatttagaaactctttttagtacttgttttttaaattttcagattaccagcaatgctaccagtgatttaaatataaaagttgatgggcgtgctattgtgcgtggaaatgaaggtgtattcattatgggcaaaaccattgaatttcacatgggtggtaatatggagttaaaggcggtgagtattcttttaagagcttaagagaattattaggttcttgggtacataaatccatatgtggaatagtatacaattattgaaaatgatataattgtctattttttgacatggaaagatgttcaaagtgggttgtgaagtaaaagaaagttacaaaacaatttgtgaaattcattatttttatttttcagaacatatgtatgtttataaaaacctagcagggtgtgccagaatgtcaacaatgtttagctgtggatagcaagataacagattatttgttttatttttatttctactagcctgtattttctgtttctttctctctttttttttttgtataatgatcacttgtattgttttagaaggcaaaaaaaaaaaccttctaaaagagaattctggaagatcaaagtaaatattcatgccttggagttgttgtttttaattaaagatttttcacatccctccctgagtttcatatccaatgatgtgaaaaaaaacaattagcaaatttataaaattattttatttagatatttttattaaaaatgtatttttaatctattattaattgtaaaggaaagaggtttttgtctttatcgtggctgttgaaagtgaattttctttgtgcttaacagattaaatctgaactttaacaggtatggtatttcatgtgccataagtccaaaaactttttaatgtctcacaattctggtcaaagtatacttattcaaaatgcctttgggtacctgcaatatgctatttaattaaagcgaattaaatttgtcttaccaagtattacatgacaaaagtgaacttaaacgtagggacttatcattctttcttattaaaaaaaatttcaatttcatagttcctgggaaaaatactttttaaaagtagttgttttacttttataagcagtttttcccccagaacacataatcccatctctaaataataaagatggacataaaatgtaattcttgccagaaactcagttgcctacagagttaatttgtatgtatattgtggtgtaagaagccattcttctaagaacactgttgaagaatagccacagtacaactgctgttctcagcagtagaaagtcacagaagcaagagatttgtttagagaccattagcaacttaccaaaccttttatttttttctacctgccacttcttgtcccattctaccttgtagttaatatgacaaatatttaaatactttgaaatatacatatacacatatcagtttctctactgttaaaggaaaataacctagtattaaaaagataattagctttataacttcgttaatatcagtggttagttctaaagtgtataagccaatcattagaaataattttatcaattaaactgcttttttgaaaaagctgtttaagaagcaatttaggccgggcgcgatgacttacgcctgtaatctcagcactttaggaagctaaggcgggtggatcacaaggtcaggaattcgagaccagcctggccaacatggcgaaaccccgtctctactaaaaatacaaaaattacctgggcgtggtggcgggcgcctgtaatcccagctacccgggaggctgaggcaggagaatcgcttgaaaccaggaggcagagattgcagtgaacccagatcgcgccactgcactccagcctgggagacagagcaaaactccgtctcaaaaaaaaaaaaaaaaaaaaaaaaaaccaacaacaaaaaacaatttaaagaaagtaaaattaaatgaccacaagatggcagcattggaacaaattggaaaactagtcacttaagaattactgtctattccatatactaccactgcataatcagttaaccatctccattatttataaccaattttctctctttgctttaaataccctctgtaagccgatgcctcccaaatttggaattgtgctttaacctctcctctgaactaagagtcacatatctagctgcctgcttaacattatccattttgatatctgataggcatctcacatttaacaattgaaaagttagattctccatccccacaagcatgcatttctttcagtattcttgtaccattaaatgacacccatcagtccatagcaaagccttctggctctaccttcagaagatacagagtcttgctgtttctcaccacctcggccatcaccaccctgatgtaaactgccatcattccctgcctggatggttggaacagcctcctggctgatcttcttacttccaagtattcactcccatagtctgttttctacccaacagccagagtggccattttaaaaagatcaagtcatttctgtattcagaatcctccaaatgcttcccgtataatttggaataaaatctaaagtctattccctgcctacatgtctgatcctcagttatttctttgactcatctcctactggttgttcccttcaccctccgtgcttcttccacactggcctcatagctgtccctggaatccaggcacatcttcacctcggggcctttgcagacactgttacctctgctttgagtacccttccccagttacctagacagcttcctccctcacttcctctagtttctgttggaatgtgaccttatcaaaccacaggtggtccttcctgagcaccctgtgtaaaactcagtccccatctgctcactctctacttatcctgctttatttctcctcatagcatttatcccacctgatgtcttatgtgttttactgttcattttttttattgtctccccctaccccattaaaacatcaactcaataagaacttgggctttgcctgttttacttactgctgtattccccagcacctagaatagtgtctggcatacagcaggcactcagtaattatttgttgagtgaatgaaaagaagaaaggaggaaagggagaaagcaagagagtcctaagagtcactaaaaagaaggattttaaggaactacaataagagaatgtttctggaacagtgggcgtgaagaacctccagactagagtgcctggtcttcaaattatatggtttgaatcttcatttgcagtgttgcaaaaacattggaaattaaaattaattccctctaggaggaaaagtcttttttttttttttttttttttttttgagacagtgtctcgctcagtcacccaggctggagtgcagcggtgtgatctctgctcactgcaagctccgcctcccgggttcacgccattctccttcctcagcctcccaagtagctgggactacaggtgcccaccaccacgtcccgctaagtttttgtatttttagtagagacgaggtttcaccgtgttagccaggatggtctcgatctcctgaacttgtgatccgcccacctcggcctcccaaagtgctgggattacaggcatgagccaccgcgcttggccaggaaaagtctttttgtactcatgatcacaaacttaccaatcagtacctttgttatagttctcttaggacttacaaatgaaaatgatctgaaactttatcaacatcaattttattatgaacttaggaattctgatgtaattttaactaacaatagaggaattatgttgcagatttatttacatatgttatggatatatgaagtgaagaagtcactcattgaatcctgatattttgttttttattgttgctgttgttgttttgtttgtgactttactctttcttactgcttgcttttctcattgatatttcaggaagttttgtttactgactttgttctgtaccccctcatggaggtaaataaatcatattactattctcctaataggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagtgcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttctta

SEQ ID NO: 13143 - DNA, 17764 bp, Human
taatataaaaattaattcaccttcacaatgtctgtctaatgcatttcaacaactgtctgtgttttcctcatgtatcttggttgtcattcctgtggggcggctcctcccacgcacctgacctttcataaagggtttctcccacggctgtccaggcatcagcctgatgaaggggattgttgccgctgctcctccccactcccccaaactcagtgtcagctcaagattgtgcccagcagggatgggaccaacgccagtctcacactcacctgtggggcagagcagacgcccatgtcagaccaccgtggattgaatctgtttctcacacacaggggaggggctgagcactgaccatggcctccagtgagtgagcagagaccccccagcgcctgtccacacacacaggggagggggagccacagcttccagcgtcacccagagccctgacccctccctgcctgggaggacgtggggttcctcttctgtcccacacggaggtgggagcctcctcctccctaatgaccctgggtggtcccagacacctgtggccactcagcattgaactctgctcatggaaggggatgcgtctcaatgtgaggaactgttcttcctctttctgtgcccgtggctgtgatgatctgcatatttcagatgtatcacaaggagaatttcatggtatttggagccgatgtgggctcttgagtgggggcgtcaatcatcctcctggactgtggagcccagcaccaggatcctctcccgtccccaccctcctgtctgaactggtctggaaattcaccatggctgagcctcccatgtcctgggcaccactgacccccacagccactgtgatgagtggggttcacgacagcaggctcagaggtgacattcatgtccaaagtcacataaaccctggatgataatcaggaattaaatacaaatcagctcaccttccccagaatcagattacagacctaacaaattcttctgaaaactctgaacatggacggaggtgccgagggaaggccaaggacgcaagggacactgagggggcgggaccgactcagagcctcattcccggggtgggggtgggtgatgttgcaacaaagagaaaaggggaagtacaggagagggacggtttggtaggaaggaaacacacactctcaagacagaacaaatatgttttattatagttaatccctgcatttccccttttgagacagggtctcactctgtcactgaggctggaatgctaagggatgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatggtaaggaccccgcaacgctgagctgatggacgggctgaaggagggagggagaccccatggggaagctctgagaaggaagaggaagcctctgctcaccctcatctggaagggcagacgcaggagggcaccagttctatttgctgctacatcccaggtctcaaggagatgaggataaaccagacagacagtggctggggggcaggaaagaccccatttctgtctgaaatgtctgcagagggcctggtgcctgcccccacctcagccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcggtgagatttgaagagggaggggagcttctaacctaggagggacctcaccccacagccaaactctggtccctaaggagaccccaggggctcacaaagatcccagggaggggaggacctgcccaggcttcaggggaaaaatccctcacagggaactctcttccagggctgagtctgggccccaggacccacgtgcaggcaggtgagtctgttcccagctgtcccaggtccctcctcctcactagggacaaggggccacccccgtgcagctggggatggggaatagcagttctgggctgactgatgggggtgtctggagggtcctgcagctgagagctgagatctgttgggtgggaaatgacttagaatccgacctctgatttccttccagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggtgagaggacactcaggagtcccagccccaggctctgccctcaggaagggggtcggctctcaggggcatctccgctctcacagctcaaccctggggatgatgtgggaggtgggagccccatttaacacagtgcctccttctctcctaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgagaaattcacagaattgcttggagttccctgagtctccctgagtctccaggcaggtggggagcagccgcgtctcagggcagctccaggtgggatgatgttggggcgagagggctcagggctcctggggccggagacacaggaagatcagcgggggagagggagggtttgtggggaagcctgagggtcggctcctggaaaccatgaacaccttttcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggtgaggagcccagcgggttcagtcagggacccaggctctgcacaggccctgccaggggagcccaggtggtgatggccggaatgagggttgggggtcccaagggagggagagacagagagagacaggggatgggcggggaggggagactcagagaaaacagagacagagagactaagggtcccagggagaggcctggggaggtctcagctcagaacaaggtggggcagcccctcacccatccttcttctctctaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcaggtgagggccctgatcttgtcctctccgagctcaaaggctcagctcaggccctgcccccagcagagctctgggacaataatgaatgaggggagtgaagcgggagggtccacaggggagggtccagcccatgggagagtggaaataggcagggacctcccacccctggctcccacccctgaagtctcagtaaagagcatgaagggctgggaggagacgggggcgggggggcgggtggtgaacctcagagatgtgattagactgagggtggaagacggagaccccacccgctcccctcctgatgtctccacctcagaatcagagcctctgggggtcccaaaccctatgtcctgaccccatgggtgacaaaaccagccactcccagctcaagagaagtttctagactcatctcaatgctacctccaatattcagggtctgatttccagggcagcagcggggagggtggacagtaagggtgtggtctgcgtggcttcctggggcttcagggatggggcaggtgttccctccgtggtgttcagaggggagggaggtgtctgaggttcagcattgatgagcggagcagagggatctttccccctccctgagcaggattcccaggagccgtcacctctcatgggggagccagggtcaggggagatcacagtcaggtacttggtctaggagtcaggtgggaggagcccggggaggtggggctgggtctgtgatggctcagcctctccttgggaggtggaacttctgaaagagcccattccccttgcaccctggactcctcatctgaataagggggagctgcctggatgtgactgccccaaagccccttcatttctgaccttctggggcatctgggatgtggctcatcctagacctgctcccgtctacagccctctctggccctctcctaattctcccaataactgagacttgttaagagttaaaaaaccaacggagatgggggcaggtgcatgcagttttacccatccctcctggaatctcagcttagtaagacaaagacacaatattttggaaaaaacaaaagtttacaaaaccccgctggttgagagtctcccctctctcgtgtacaagagaaaatgtctccaattttctaccaaaatcaatagctggcacagctctgcaggacccccagcccctggccttgtcctgcaggatgtgtgatgagtagaggaaggagaacaggctgggtggggaggatttggggtccaggcctgacttggacactgggaagatgctggggctgatggaggaggaagagaggcaggtgagttggagagaggacagatggacagtgtattggcagctctcatttctcatttccaagagcccctgagtataagcccttcacccacacctgcggggtccctgggccatctcaagacaagagaggaggctgcttgggcctcggtgggatctgactgtgatgaggctggagtccaccccagatgtgctcctttagagagaagcaccccagctgtgggtgccgctcacactgcccctcctgtgctcacctggaggcctctgtgctcagggcatccctgagaataaggaggggccctgcacctgctccctggacaagtcaggcaagtattcacagcacgtctttctgtttaactcatttctactctgcattttctgtatgcacttgtcctttgttactttttttctaaaacttttaaaacagtatttgaatatatgaatttataatatatgaacttaaaattgtatgcatatattatttaaaaatccttatttatactcccctttaattgagtcttgatttaatttatacattcaatgtagaaacaaatttctcattaatatcaactcttcctccttcacacattaaaaatgaagattttcttaatgaatttaagacatgttttgaaattttactcctaagaatattgtatgctcattttaacttaaagaattattcaacatctttaacaattgataagtgaggtatttgatttctttttatatatatatatattttattattatagtttaagttccagggtacatgtgcacaatgtgcaggtttgttacgtaggtatacaggtgccatgttggtttgctgcacccatcaactcgtcattcacattagtatttctcctaatgctatccttctcccagccccccacccctagactggccccggtgtgtgatgttccccgccctgtgtccatgtgttctcattgttcaactcccattatgagtgagaacatgcggtgtttggttttctgttcttgtgacagtttgctgagtgatggtttccaggttcatcaatgtccctgcaaaggacatgaactcatcctttttaacggctgcatagtattccatggtgtatatgtgccacattttcttaatgcagtccactgatggacatttgggttggttccaagtctttgctattgtgattagtgccacagtaaacatatgtgtgcatgtgtctttgtcgtagaatggtttataaccctttgggtatatgcccagtaatgggattgctgggtcaaatggtagttctagttgtagattcttgaggaatcgtcacactgtcttccacaatggttgaactaatttacactcccaccaacagtgtaaaagcgttcctatttttccacatcctctccagcatctgtagtttcctgactttttaatgattgccattctaactggcatgagatggtatctcactgctgttttgatgtgcatttctctgatgaccagtgatgataagcatttttgcatatgtctgttgcctgcataaatgtcttctcttgagaagtgtctgttcatatcctttgcccactttttgattttttttttttgtaaatgtgtttaagttctttatagattctggatattagcactttgccaaatgggtagattgcaaaaattttctcccattctgtaggctgcctgttcactctcatgatagtttcttttgctgtgcagaagctctttaattagatcccatttgtctattttggcttttggtgccattgcttgtggtgttttagtcatgaagtccttgcccatgcctatgtcctgaatggtattgcctaggttttcttctagggtttttatggtgttaggtcttacatttaagtctttaatccatcttgacttaattatcgtatagggtgtaaggaagggatccagtttcagctttctacatgtggctagccagtttttctagcaccatttattaaatagggaattctttccccatttcttgtttttgtcaagtttgtcaaagatcagatggttgtagatgtgtggttttatttttgagggctctgttctgttccattggtctatgcatctgttttggtaccagtaccatgctgctttggttactgtagccttgaagggtagtttgaagtcaggtagcgtgatgcctccaactttgttctttttgcttaggattgtcttggcaatgcgggcttttttttggttccatatgaactttaaagtagttttttccaattatgtgaagaaagtcagtggtagcttgatggggatagcattgaatctataaatccctttgggcagtgtggccattttcacaatattgattcttcctatccatgagcatggaatgttcttccatttgtctgtgttctcttttaattcattgagcagtggtttgtagttctctttgaagaggtccttcacatcctttgttagttggattcctaggtattttattctctttgtagtaattgcaaatgggagttcactcatgacttggctctctgtttgtctattattggtttataggaatgcttgtaatttttgcacattgattttgtatcctgagactttgctgaagttgcttatcagcttaaggagattttgggctgagtcaatggggttttaaatatataatcatgtcatctgcaagcagagataatttgactttctcttttcctaattgaatacactttatttctttctcttgcgtgattgccctagccagaacttccaacactatgttgaataggagtggtgagagaggaaattcttgtcttgtgccggttttctttttttttttttttttttttattatactctaagttttagggtacatgtgcacattgtgcaggttagttacatatgtatacatgtgccatgctggtgtgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgtgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgctacaaaccactgctcaaggaaataaaagaggacacaaacaaatggaagaacattccatgctcatgggtaagaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgtgccggttttcaaagggaatacttctttgcccattcagtatgatattggctgtgggtttgctataaatagctgttattattttgagatatgttccatcagtaccgagtttattgagagtttttagcatgaagggctgttgaattttgtcaaaggccctttctgcatctattaagataatcatgtggtttttgtcattggttctgtttatgtgatggattacatttagtgatttgcctatgttgaaccagccttgcatcccagggatgaagctgacttggtcatggtgggtaagctttttgatgtgctgctggatttggtttgccagtattttattgaggagttttgcatcaatgttcatcagggatattgacctaaaattatccttttttgttgtgtgtctacgaggctttggtatcaggatgatgctagcctcataaaatgagttagggaggattccctctttttccattgactggagtagtttcagagagagtggtaccagctcctctttgtacctctggtagaattcggctgcgaatccttctggtcctggattttttttggttggtaggctattaattattgccttcatttcagaacctgttattggtttattcatagattcaacttctttctggtttagtcttgggagggtgtatgtgtccaggaatttatccatttcttctagattttctagtttatttgtgtagaggtgtttacagtattctctgatggtagtttgtatttctgtggaatcggtggtgatatcccctttatcatttttcattgcatctatttgattcttctctcttttcttgtttattagtcttcctagcggtctatcaattttgttgatcttttcaaaaaaccagctccaggattcattgatttttttgaagggttttttgtgtctctatctccttcagttctgctctgatcttagttatgtcttgccttctgctagcttttgaatttgtttgctcttgcttctctagttcttttaattgtgatgttagggtgtcgattttagatctttcctgctttctcttttgggcatttagtgctataaatttccctctacacactgctttaaatgtgtcccagagattctgttatgttttgtctttgttctcattggttccaaagaacatctttatttctgccttcatttcattatttacccagtagtcattcaggaacaggttggtcagtttccatgtagttgtgtggttttgagtgagtttattaatcctgagttgtaatttgattgcactgtggtgtgagagacagtttgttgtgatttctgttcttttacatttgctgaggagtggtttactaccaattatgtggtcaattttggaataagtgcaaagtgatgctgagaagaatgtgtattctgttgatttggggtgtagagttcagtagatgtctattaggtctgcttggttcagacctgagttcaagtcctggatatccttgttaaccttatgtgtcattgatctaatattgacagaggggtgttaaagtctcctattattattgtgtgggagtctaagtctttttgtaggtctctaaggacttggtttttgaatctgggtgctcctgtattgggtgcatatatatttaggatagttaactcttcttgttgaattgatccctttaccataatgtagtggccttgtctcttttgatctttgttggtttaaagtctgtattatcagagactaggattgcaactcctgctttttttttttctttccatttgcttggtagatcttcctccatacctttattttgagcctatgtgtgtctctgcacatgagatgggtctcctgaatacagcacactgatgggtcttgattctttatccaatttgctggtctgtgtcttttaattggagcatttaacccatttacatttaaggttaatactgttatgtttgagtttgatcatgtcattatgatgttagctggttattttgtccattaattgatgcagtttcttcatagtgtcagtggtctttaccatttggcatgtttttgcagtggctggcactgattgttcctttccatgtttagtgcttccttcaggagctcttttaaggcaggcctggtggtgacaaaatctctcagcatttgcttggctgtaaaggattttatttctccttcactgatgaagcttagtttggcttgatatgacagtctgggttgaaaattattttctttaagaatgttgaatattggcctccactctcttctggcttgtagagtttctgccaagagatccgctgttagtctgatgggcttttctttttgggtaaccagacctttctctctggctgcccttaatattttttccttcatttcaaccttggtgaatctgataattatgtgtctttgggttgctcttctcaaggagtgtctttgtggtgttctctgtatttcctgaatttgaatgttggcttgcctttgtaggttagggaagttctcctggataatattctgaagagtgttttctaacttggttccattctcctcgtcactttccggtacactagtcaaacataaatttggtcttttcacatagtcccatatttcttggaggctttgttcatttcttttcattctcttttctctaatcttgtcttcttgctttatttcattaatttgatcttcagtcactgatatcctttcttccacttgatcgaatcagctattgaagcttgtgcatgcatcacgaagttcttgtgccgtggttttcagctgcatcaggtcatttaaggtcttctctacacggtttattgtagttagccattcatctaaccatttttcaaggtttttagcttccttgcaatgggttagaacatgcttctttagcttgaagaagtttgttattaccgaccttctgaaacctacttccatcaacttgtcaaactcattcttcatccagtcttgttctgttgccggtgaggagctgcgatcctttggaagagaagaggcactctgtttttggaattttcagcttttctgctctggtttctccccatctttgtggttttatctacctttggtctttgatgttggtgacctagggatggggttttggtgtggatgtcctttttgttgacattgatgctattcctttctgtttgttagttttccttctaagagtcagacccctcagcagcaggtctgttggtgtttgctggaggtccagtccagccagaccttatttgcctgggtatcaccagcagaggctgcagaacagcaaatattgctgcctgacccttcctttcgaagcttcatcccagaggggcacccacctgtttgaggtgtctgttggcccctactgggaggtgtttcccagtcaggctacacgggggtcagggacccacttgaggatgcagtctgtccgttgttggagctctaatgcggtgctgagagaaccactgctgtcttcagggctatcagacagggacgtttaagtctgcagaagctacctgctgccctttgttctactatgccctgcccccagaagtggaatctgtagaggcagtaggccttgctgagctgtggtgggctccacccagttcgtgcttccaggcatctttgtttacactgtgagctactccaacctcagcaatggtggatgcccttccctccatccagctgcagcatcgcaggtcgatctcagactgctgcgctagcagtgagcaaggctccgtgggtgtgagacctgccgagccaggcacgggagggtatctcctggtctgccagttgctaagactgtgggaatagtgcagtagttggtcaggagggtactgtttctccggatacagtctgtcacggcttcccttggctaggaaagggaaatcctccgaccccttgtgcttcccaggtgaggcgacaccccatcctgcttcagctcgccctttgtgggctgcagccacagtccaaccagtcccaatgagataaaccaggtacctcagttggaaatgcagaaatccagctgcagaccggagccattcctattcgaccatcttggaagcgacacctatattttttttaaagaaggataggtatccatgagaaagtgactggtttcattatgttctttttatttgttattcacccactagagaatggctcctttctaattactcttcaatgatctcctttaatttctggtacaattttagaaatcataatacatggaaattttatttctttatttctaaattacatgccaatatttctcaaatattaacgtgtatataactacataataaatacatttctgaagttttacatatatacacaggttctatacattacacatgatgtgagtggaggtatatctaaacacatttttatatgtattcatccatatgcttcacatatttgacatgacaggtctttacaggtttgttattggtcttcttatctagactcacacttgctggagcagaagtattcatttatgaacctcggatagcaccagcatttaacatatgcatatttgtgtgtgtgggtgggtgtgcatgcacgtgtattgcattctaggggttactgcctgtatgaggaattagttacctaaggattaaacggaagatgaaaccccaggtgaagtggttgagggcatgaaggggaggcagacccagactttcacccctttgtgttcctgacattcaagagcccctgaggtccaacccctcctccatggagcctgggtcctcagctggcggatccgtgaaactcatctctggggagcattggcttctgtggtcctgcacctgctccttgcagccagttagggctcagagaggacacagagagcacacaaggtcccaggctgcacagagagcacataaggtcctggttatttctgtattggggaccacttaccatatccatgctgagctcccgggatgcaggaaaactctcccaaatgactcaggagctgagtttggatttgtagaacacaggaagtctgaaataattcaatgaggagactggagggaaccctgctacagcagaggaagggtttattgaggaactccataaaactcatgtcaagagacacaggggaaaagaagaatgcagagcccaggagtgaggctgggctcagggctcttctccactgttttgattctcagaagcagctgagaccctcagcccatcacaaaacaagacagactccacgactagtgagtgaggagatgctctcagttatgggactggcacagagggtcaggtcctgtaaaggggaggtgggtgccctgggtggacatacaggagtcccggggtgattccgatctgccctgacctctgtgacctctttgtccagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaatgttgacttcccttgactggatcccctttttttcccatccccagacatgaggctccatcccacatggcaccgttgggtccacacctccacacacctgtgtgctctggtccacggcatgtgacacagtcttccttattcctcattgtcacactccttgatgtcacttactgagtccccgtctcttcagttcagagatccaaacctgaaccaccaactaaatcaacgacaggagatcagattccaaccaggaaaacataaatccaccctgctgccctgacaccctctctgtaccttatgagcccttccctctttctcagatgctatctgtgtaatttctcctgaaatatcaccacttggaatcatcacactggcatttcaagtgacaccacagctatgctgattcagaaaaagacatctctaaaatactgtaattagtggtatctaccaatttctgtgacataaatatttttctcatggcccaaatcaaggtgccaatgggttctcactgaatacagggttgggaagcaagggacagaactgtcttcactaatgagcaccagggacctgtggcacatcccactgagagctcacccatatacctacagtcctttctatttcagaggcaatgatcacttctacttcagtgttatggcacaggtcaaatgaaattctgacactgttatcctagcatatccacaaaagacaaacctattaatatctgatgtgggagataacacggctcacctaaaaatcaaagtacatgccgggcgcggtggctcacgcctgtaatcccagcactttgggaggccaaggcaggcagatcacgaggtcaggagatctagaccatcctggctaacatggtgaaaccccgtctctactaaatacacaaaaaaatattggccgggcgtggtggtgggcgcctgtagtcccagctactcaggaggctgaggcaggagaatggcgtgaacctgggaggcggagcttgcaatgggccgagattgcgacactgccctccagcctgggcgacagagcaagactccgtctcaaaaaaaaaaaaaaatccaagtacaacataagaaaaatgttaacagaactatgcagtttcgatgaaagaattttttttgagatggagttttgctttgttgcccaggctggagtgcaatggtgcaatctcggctcactgcaacctccacttcccaggttcaagcaattctcctgcctctgcctcccgagttactggactacaggtgtgcaccaccattcccggctattttttgtatttttagtagagacgggggtctcgccatgttagtgaggctggtcttgaactcctgacctcaggttatccacctgcctcagcctcccagagtgctgggattacaggtgtaagccactgtgcccggctgatggaagaattcttaaatgactcgttctactttctgctggtccaggcactccttggcttggggcagcatcccaccagtttctgcctccatcttctcaatgcttacacctacctggttgcctctgtcttcacacccattcttctgtgtgtgtcttttctcttcttcagattatgatatcactcagatcagattaggactcatcctaattcgttatgatcccttgatcataacttaaatgcatttgcaaagactctatttccaactatgttcacatttatagctaatggggctcaggatttcaacgtgtatattagggggaacaagtcaatttatgacagtgtctacaagaaaagtatgcatagaaatacatttaaccaaatacaaaaattaggtgggtgtggtggtacacgcctgtaatcccagctactcaggaggctgagacaggagaatcgcgtcaacccaggaaacagaggttgcagtgagctgagatcttgccattgcactccagcctgggcaacagagtgagactctgtctcaaaaaaagagaaatacatttaaccaaagagatgcaatacgtatacattgacaa

SEQ ID NO: 13144 - DNA, 112239 bp, Human
acttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacatattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtgtgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctaggcatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcatctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaattcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcatgccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccattgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgctgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagtttcgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcagaggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggttttttctttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggggtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagacagtagttgtatttaaattataggattaatgagttcatgcatggcaaaagcatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaacttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccgattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttcccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagcgaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttagagagatctggctatgagcctgtatttcattacagcttaaataatcatattatttcccatttccttagttgctctctggacttttaagattctactgccttaggctggtcagcggacagctgccttcattgccatgcatatagtaataggcagccggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagaactcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacggggtcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaagatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctgtgtctagcactatcagtcaagtatggagataaaagcatttttagacttgcaaggattctcatgcatcctttattaggaaactactaaaggatgtgcttcaacacaatcagggagtaaaagcaagagatagacatggaatccaggaaacatgggcttttcaacacagaagtgaaggaagtcccaaaaagatcattttccatcaagtctgtagagcaaatgatccagtttcgagcaagaagactaaagacttcaggaaagaggatctctgggaaacaagaggacagaactgctcaattatttgatgtgtttaaggtagaaaaaaatgattgctagatgttttacaggtttgttaaaacacttgcttggaaaaagcagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactctcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccaggagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcctcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcacccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcgggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtcggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaacgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcgatgctgagggattaaacagaggcaaatacggaagtgagcagatttttctctcttgctctctgcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccgtaggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttccataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaagataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccgcagaagcaaagcccccctctctgctccctgctccaaggaggcggcaccatttctcgtgggcttctgtcttctgtctctcccgttgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggcccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcaactttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccggatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgttttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctcttcatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgttgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctcagacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttattctcagcaagtctcccccaaccccaccccaggcctctaattccacacatatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctagccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtacgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatc

SEQ ID NO: 13145 - DNA, 17527 bp, Human
  misc_feature (1)...(17527): n = A,T,C or G
cttgaagtagtcatccacagacaaggtggttttccatgagttcatcaaggaggccttgtttgaccacttctcccagcttttggtagcttggagtgatgggagggagggcatcttcttagtattggactgtaaagtgtttgctctctgggagtaaagtccaaccagctcagggttgatgatttgaggctgtttttcttgacgtagaaaggctgaggacaggaaggtcgaccagtctttatctgctgcaggctcaactaggggcccttgatcaaaatgtaagtggtcagaagagacatggctcatcaactccttgtagacctccctggtagtactgccaacaaagttatcaatatccattttttcaatggctttgggatccagttcaccagccagatggttatacagggctccggccccctcaatgtggaaagagtctaagaagtttctatcagagacccgtacggcagccgcctggaccacgacctcatttctaagcttcaaagtaatggtcactggctgtgggtgaagtggaaaggatttggggggctgggggtcccactgcccagaggcttcttcctcctggaggttcctcaacatcttctccagctcctccaggcgatgccctgcagctgggtgacgggtcacaacccccaggagaggaggcaggcctgagtccagtggtgggtagcgagtcccctccaacttcatcttctttatcaactgcttcagatcctcagccacgatgagcccagtcagctctggtttgctctctgtagccaagaccagcggggttaaggggcgagatgggagtggaggaaggcccaactcatctgccagcctccagccctcacgcagggagggcatggattggcctctccggagctcagggcagaaaggcgagggggaagccctgctggtgggggccacaggatagctgggcagcgacaccatctgtgaggaactgatgtcgatttctctcttctttcctatggagggcagccagtggaaaggctttttcctcttcaaccgagggatggacttcaattccttcactggatccatccttcctggctcattgagaaactctggtggacggctgagttggatgaggtagttcaggttgaggttagagcactgcacttgggcgaagccagtgctgtgaggccaggggatagggcacagcttgaacgtcccagcggggcagacagggtgcagcttgtccacatccccagaggcctgctctgccctcagcagggcctggaagtcggcaagcaggccacggtagacgttgggactagtaaggaagagtgtgcagtccctggcgaggctggcggccaaccgggtgagggtggctgattcagtgaagacccccctgggagtcgacatggtcaccagcaggtgcaggtagcgcaagaagagctgctcgctgctcagcagcacgtaggcctcgagccgcttccgcagcttctggttgtttttgtggctcagactaagttcggcgggcggctcccgccagctgcacttcagctcgtccaggatgaccttgatgagacgtagtcgggcctcaggaggcactcccgctgctatcccgctgccggccagcagcttggccacctggctgcacagcgacgccaccgtcagcttcgccagagggaaggactgcagaatccggccctcctgcggggggcgcttctgaggctctggggacgtcgtcctagtggggaagagcgacagcggacgcagcagccggtggtaaaaccgctggagctcaggctcgggcttcgggggctccatcatagagccggcggccgccaccgtccaggaacagaaagccgaggggttactaaggcaaccaggagcccgacggcccgagtgcgcctgcgcggccgccacccggtggctgacgaagcagggccttgcgtgcgcacgcactaggaggaggagttaagggtggctttagaggctcagtccccgcgacgccgcgctggttggtgctcctgcgccggaggagttctgcgtctcggggtggtgactgggtccagaatggcttcggattcggggaaccaggggaccctctgcacggtgagggtcgaggcttcgtgtggagcctcgccgggcagagagcctcggcccctgggatgatcgttaccttgggaagaggagaaggagtgggcacttgggttggggcctggggccatgggatgaaactagggtgcgagggtagcaggggccctgcgtgagtgttggggggtgactcccatggtcctggaatggtcatgagagatcatgaagaaggtgcttgaagaggggttaagtggggcttgttcccagacccttgcggtggtcatagggtaggtggtgaaacaaagtcataccaaggcacttccccagcgatcatcggttggtccctgccgcccttgcagttggagttcgcggtgcagatgacctgtcagagctgtgtggacgcggtgcgcaaatccctgcaaggggtggcaggtaagaacagggtaaacttttctgcagacagtccagaagcctctgggagggaccaggcgaatctattaggcgaaccctactcccattttacagatgcagaaagtgaaccccagagagtgaaaggcatgttctcagagttacacacagacctggaggcagagcctagagtacagctgtccagcttgccctgacagattctaactgcctgtcttgttgtcctgaacctcaggtgccccagagactgaggagctaggctgagggagttcctgggaaaacaggcagtttttgcttgggaaacaacataatcttgacaaagcaaacagcagctcaggccctataccatcctgggtagctttctataccactgggtgtggtggctcatgcctgtaatcccagcactttgggaggccgaggtgggtggatcaccaggtcaggagatcgagaccatcctggctaacacagttaaatcctgtctctactaaaaaatacaaaaaattagccgggcgtggtggtgggcgcctgtagtcccagctacttgggaggcagaggcaggagaatggcgtgaacccgggaggcggagcttgcagttagccgagatcgcgccactgcactctagcctgggcaacagagtgagactccgtctcaaaaaaataataataataaataaaaggccagctggtctggaggtgacctggcacaatgagaaagatctggaaaggtagagccaccagcatggctctgggaactggcttcctttgattctgttaagtgtttatccaggccaggctcagtggctcacgcctgtaatcccagcactttgggacaccaaagtaggtagattgctcaagtccatgagtttgagagcagcctgagcaacatggcgaaaaccctcctctataaaatatacaaaaattagctgggcgtcatggtgcactcctgtagtcccagctactggggaggccaaagcaggaggattgcttgagtccaggaggtggaggctgcagtgagttggatcgctccactgcactccaggctgggtgacagagtgagaccctctctcaaaaaaaaaaaaaaaaaaaacaagttcacccagtcattcggcaggtatggaccagacactggggctttttagggagaagagttcacatgggtatcaggcacatcccctgcactcaggtggaaatgagcatgcaagcgttgcctggatggcattcgcagaatgcttcgtggaaagagcaatggtgagagggaatgagataagatggcttctgaagctgggaccctggtagtggtggactctgtaaagtgattaggggtatgagctctagagttcaaaccccctctttgccacttaatggcactaagacttcatgcatgttactttttgtgtctctgtttcttctgtgttaaatgggggatgataatagaagctaatctggaggattgtcctgaagagtaaccgagttaatacaaaaaaagcatttagaaaagtctttggcatgtaataacagcccagtaaatcctaggggattatgagaagaagggcttacaggtggtgatctggatggaaggaggctggaggggacaatgttgaagctgggtttgcttagactacgcgttttgggtggtgaatgggccctccacttcctgtactacttgcttgcgaggagagcagacagctggcctttctcttggacccggagcagttttcagccctcagcatgtttcttaggcaacagataaagacttctggtgactctgtgttttctggtccggcttggctttctcatggggccagggagggaagctgtagttttctagaatacacacacacagagaaagagagttgccatctcaggaggcctgggggaaggccttctcaggaggtaagcaggaggatcccccagcccaaggctcacccccttgaatctctatcacttgccctggtgttctctgtggccttctgttttctctctcactgggctctgagccaaccaagggtgggcctggctacattccagggtctaccagtcttaactcaaggagcaaactgaatggctgcttggctaaggtaccagcctccctcttggtttagactcagtcaataattcaggaggtacatagtgacaaggaacttcccacttcaggagcagagaatcagctcttctctggagacctgagggtctgggaaccctcctatgctgaggcctgtcatcaggacatcttatctgctatgtgtccaaaacatacttaggcctccacactgctccaggccaccccacctctccctagcctgtgtaagaacctcatcctttgatgggttccccattgcttctgttgccccctctaatagcttttgcacataaaagccagggtcttgttctgctctgttgcccaggctggagtgcggtggcaccatctcagctcactgcaacctccacctcccggttcatttgattctcccacctcagcctcctgagtagctgggattacaggtgtgcaccaccatgcctggctaattttcatacttttactaaagatggagttttgccatgttggcaaggctagtatcgaactcctggcctcatgtgatccacctgcctcaacctcccaaagtgctgggattatgggtgtgcgccaccacgcctggccatctgacaactgactttttttttttttttttgagacggaatctcgctctgttgcccaggctggagtgcagtggcgcaatctcggctcactgcaagctccgcctcccgggttcatgccattctcctgcttcagcctcctgagtagctgggactacaggcgcccgccaccatgcccggctaactttttagtatttttagtagagatggggtttcaccgtgttagccaggatggtctcgatctcctgaccttgtgatccacccaccttggcctcccaaagtgctgggattacaggcatgagccaccgcgcccggccgacaactgacttttgaacttgacccttgtggacctcacagagctcctgccctcacagagctggcggcctaggagtgaaacaggattgtagtcagtgcaatgtgaattacaggagggggagtgtgagctgctacaggaccacaaggggtgtggtcctaacccagcttggagcctaagggctgcttcctagggtgagtacaatatctgggttaagtgctggggctctggagctaggctgcatggtcagaggtccagttgcacaacttactacagtgcgactttgagcaagtttcttcatctttctgtgcctcagttttctcatctgtaaaatggggatcattgtacctaacttagaggcttagtaggagtaccaaatatgttaagacaggtaaaacacaggattcgctcaccgtccatgcccagtaagtgttagctctactaatgatggcaatagtccctgccttttatgtgtgtaatagctttattaagatataattcggctgggcgcagtggctcacacctgtaattccagcactttgggaggctgaggcaggcagatcatgaggtgaggagatcgagaccattctggctaacacggtgaaaccctgtctctactaaaaacacaaaaaatcagctgggcgtgatggcgggcacctgttgtcccagctactcgggaggctgaggcaggagaatggctagaacccaggaggtggagcttgcagtgagccgagattgtgccactgcactccagcctgggtgacagagcgagactccatttcaaaaagaaaaaaaggccaggtgtggtggctcatgcctgtattcccagcactttgggaggccaaggcgggcagatcacgaggtcaggagattgagaccatcctggctaacacggtgaaaccccgtctttactaaaaatacaaaaaattagccgggcttggtggcgggcgcctgtagtccctgctactcgggaggctgaggcaggagaatggcgtgaacccaggaggtgaagcttgcagtgagcccagatggcgccactgcactccagcctgggcgacagagtgagactctgtctcaaaaaaaaaaaaaagatataattcataggctgggcagctaggcacagtggctcacgcctgtaattccagcactttgggaggcttgcttgaacccaggaggcagaggttgcagtgagccaagattatgccactgctctccagcctaggtgacaaagcgagactccatcttgaaaataaaaaaagatataattcatgtactataaaaatcacccatttaggccaggcgcagtggctcacgcctgtagtcccaacagtttgggaggctgaggttgcagtgagccgagattgtgccattacactccagcctgggtgacacagcgagactctgtctcaaaaaaaaaaaaagaaaaaaaattcacccatttaaaggatacagttcatctgtttgtagtattttcagagttgtacaaccatctctccactgtcagttttacatttttatcacttcataaagaaatcctaggccacagccaggcgtgatggctcatgcctgtaatctcagtactttgggagactgaggcaggcagatgacctgaggtcaggagttcgagagcagcctggccaacatggtgaaaccccatgtctactaaaagaaaaaaatacaaaaaaattagctgggcatggtggtggtgtgtgcctgtagtccctgctactcgggaggctaaggcaggagaatcgcttgaacccgggagnnnnnnnnnnnnnnnnnnnntagtctcagctacttgggagtctgaagtgagaggatctcttaatcacaggaggttgaggttgcagtgaaccataattatgccactgcactacagcgtgagtgacagggcaagaccctgtttcaaaaaaaacaaaaaaaaagggccggacgcagtggctcacgcctgtaatcccaacactttgggaggccgaggcaggtggatcacgaggccaggagatggagaccatcctggctaacacggtaaaaccccatctctactaaaaatacaaaaaattagccgggcgtggtggcaggcgcctgcagtcccagctactcgggaggctgaggcaggagaatggcgtgaacctgggaggcggagcttgcaatgagccgagattgcgccactgcactccagcctgggtgacacagcgagactctgtctccaaaaaaaaaaaagaaaaaaaattcacccatttaaaggatacagttcatctgtttgtagtattttcagagttgtacaaccatctctccactgtcagttttacatttttatcacttcataaagaaatcctaggccacagccaggcgtgatggctcatgcctgtaatctcagtactttgggagactgaggcaggcagatgacctgaggtcaggagttcgagagcagcctggccaacatggtgaaaccccatgtctactaaaagaaaaaaatacaaaaaaattagctgggcatggtggtggtgtgtgcctgtagtccctgctactcgggaggctaaggcaggagaatcgcttgaacccgggagatggaggtttcagtgagctgagatcgtgccactgcactccagcctgagcaacagagagagactctgtttcaaaaaaaaaaaaatattttttaagctatctcctacaggaagaatattttctgtttgtggatttgcctattctagatatctaatatacatggcattatatatgtggctttgtgactggctttcttgtagcataatgtttcaaggtccgtccatgttgtagcatgtatcagcacttcgttcctgaatagtatttcattgtatggataccacattttatctgttcattagttgatgggcatttgggttatttttatcttttggctattgtgaataatgccactatggatagcccacttaaaaaaaaaacaaaacactgctttaaaaagaatgatgtatgtttccaaagttataaataatgcctggcgtgtattagaactcacagaaatcctgggggcaaggtggcattatccccatttatatgaaaagagacagactcagaagtgaagaggcttactcagggttacacagttacgaagtagcttgcctctgaccatgggaagtttggtggaaatggggatggagaattgctgtctgtttttctgttccctgctgccagcactgggtgccagcctctgttgccctcttccctctctttcttgccaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccgggtaagtgtctgtctgggtttgggcttgggctgagagaggacccaaagtctcagaggcagggcaggcagctcttgggatcataacagtgtgattcctttttggtggagtcttttcctctcattttattttgctgagtttggaaacatttgttgacactttctgtgatcaaggcccaggggatacaatagattacagccccagtgcctgacccaaggagcacacagtctctgggggagattactgaattccatggtttccaggcagtgagatcatccttgcaggagcctgcaagaggtcctggagcccacagtgaatagttcatctgcctgaggggcaggggcagtgggaggaagtgaaatatggaagttgagggttttacctaaactgaaaaggctgtccctggtgttccctaacaccccggtcctggagtttcatttttcagcagagaatcatttcccaatcttcagggaattgtgtgttgccttaatgatttttgccttatctgagtactagttgtatttttagttactcaatcatttggtttttttattttattttctgagatggagttttgttcttattgcccaggctagagtgcaatggcgcagtcccagctcattgcaacctccgcctcccaagttcaaacgattctcctgcctcagcctccctaatagctgggactacaggtgcacaccaccacacccgggtaatttttgtatttttagtagagatggggtttcaccaggttggccaggcagtcttgaactcctgacctcaagtgatccacccacctcagcctcccaaagtgctgggattacaggcgtgagccactgtgcccggctctgactgggctattttctatcttgatgggtttgcaaccttgtgccacaaaacaattgaaaccatggtatgtgttgcttaatgcatgttactgattttttggacttttcacagctctgttacctatcatgcttttcttttcttctgtttcttttccttttcctttctcccctcccctcccctcccctctcctttccgagataggatctcactctgttgcccatgctggagtgcagtgctgtgatcatggctcactacagccttgaactcatgggctcaagcaatcctcccacctcacctgatagctgggaccacaagcatgtaccattatgcccagctaatttttttttgttgtttttttggtggtagaaatagggtgtcactatgttcctcaggctggtctcaaactgctgggcttgagcagacctccctcctcggcctcccagtgttaggattatgagcatgagccagcatgcctggcctctgccacattttttttttttctttttcttttttttatttttagtagaaacgaggttttgccatgttggccaggctggtcttgaagtcccaacctcaagtgatccgcctgccttggcctcccaaagtgctgggattacaggcatgagccactgtgcccaaccaccctgtcacatttctaatgatcaaaagtttttactccctgttctgggaaattggagaggcatttcttatagagtccattgcacagtgccatgcttatgctcagtgattagtaatctgctgctgcaaatcaaatgactccaaagttaggagtttaaaacaacaaacatatactgtctctggggcaggaatttgtgtgtgacttagctgggtgcctgcagctcagggtctctctcggggctgcagtcatctcagggccccacgtggggagaatctgcttccaggtttgctcatgttgctgttggcaggccccaggtcctccttggctgttggccagagacatcagttctttgccacatgggtctctccctagggcagctaacaacacggcagttggcttctctcagagtgaatgagcgagagagagagagattgagattgagagagggcgtccaagactcaagccacattctttttgtaacctaatcttagaagtgacactaggtccagcccacactcaagggaggcacatcatagaggccattcgcctcatgcagccttgaaagatgatgggcaggaagtaggcattgaagagggtaagagtgggattggcaagcccagcaaaagaaactgcccgggcaaagccctcaaggcatggaatggcagggagtgtttctgaagggcaggagcctgtcttgtgacctgtgttttcttcctgggccccaggtggggcagggaatcagaaggggctggcatcagcagctgtacctcacccaatcccttaacttagacaaggaagaactgagcaggagctgaccagccaaggccacggtgactggcaagttgctgttgggttttagcatctgcttttcccaggtggaaaagaattccatgtgggaatttgcattcaagcctggttgtcccttgcacatctcctaactgatctctaagctcccttctgttctctcctcaccctgctccagtctttacttttcatagactgcactagaaggattgttctgaagcctggagtaaccaggccatgcccctgcctgaaacttgtcttggctcccagtgcctgagagtacaagctgggcctagcttcttgatgtggacattcaataccccactccccctgcctattgcccctgcctgtgtgctgaggaaacagcctggaaaggctgcctttccctgaactcctgctgggtcatgcctccagccacactgtccaggctgccccctgccttgaggccgctcctccagccgggcacagtggctcacgcctgcaaccctagcactttgggaggccgaggcagacggatcacttgagttcaggagttcgagaccaggctggccaatatggtgaaaccctgtctctactaaaaatacaaaaattaggccaggtgcaatggctcatgcctgtaatcccagcactttgggaggctgaggcggatgggtcacttgaggtcaggagtttgagatcagcttgaccaacatggtgaaaccctgtctctattaaaaatacaaaagttgggccgggcacagtggctcatgcctgtaatcccagcactttgggaggccgaggcgggcagatcacaaggtcaggagatcgagaccatcctggttaacattgtgaaaccccgtctctactaaaaatacaaaaaattagccaggcgtggtggcgggcgcctgtagtcccagctacttgggaggttgaggcaggagaatagcgtgaacctgggaggcggagcttgcagtgagccgaggtcgcgccactgcactccagcctgggcgacagagcaagactccatctcaacaaaacaaaacaaaacaaaacaaaacaaaagttggccaggtatggtggcgtgctctgtagtcacagctactcgggaagctgagacaggagaattgcttgaacctggggggtggggaggttgcagtgagcccagatcgcaccactgcactccagcctgggcaacagagtgagactctgtctcaataaataaataaataaataaattaattaattaattaaaagaaatacaaaaactagccaggcgtagtggcgcgtgcctgtaatctcagctacttaggaggctgaggcaggagaattgcttgaacccgggaagcagagactgcagtgagccgagatcacaccattgcattccagcctgggcattgcaatgagactttgtatcaaaacaaaacaaaacaagcaaaaaaaaccgctcttcagggctctgtatcccctcccccttcttgatctttctactgttcaaatctccaacgcagggcgtaaaaaaaagtaccaggtgcaggcagcagatatccctctggaaaacgagataaagcagaactgccacttcttcctgcccatcagttggtggcacagtgagatgcctggttactcagcagcaaggtcatgggagcccacctgtactggcacaggcacttgtttctgcccaaaatgtcaggttggggacaatttatttgcacagatgtgggtttctgtggctcactagtaaggccttgtcaccccaaaacacaccaactgttgtattcatcctgtgtgtcatcacccctagtctgttctgtatctgggcccccaccatgttctgagtcccttgaggatggtgacctgcatactccctgccatgttgggtagtgtgtctgacctaggaggtgctcataggtgtgttatgacaatttttattaccgtcaaaggagaaggagggcagagccagcttcgaggggctaggacaggccctttgccccttgcatttccttctgttcctggaatctgggagtcagggaaatgacactggctgcctatgatggtcagggaagccaagcttggccaacttaagcctataggaattgaagacagccaagggctcacagagccatcaggaggctgcacaactgagctaactggaggctgagaagcagagctgggcaattgcctcgccggaaaaacagtctgatccaatgggaatgactgcacaggcaggggaaacttccactggctcttttcagcccactgtcatcctgcccaggatttcagttccagggagggagtgttcagatggtccgggacttcctggaccactttccacttccagacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctgaaggtaaggtggaaaagaaggtgggcacccttcctaacagggtccatcatctgaagctgtcgtctcccctcaaaggtgtgggatgtgattggccgcagcctgattattgatgagggagaagatgacctgggccggggaggccatcccttatccaagatcacagggaactccggggagaggtgagtggtgtcggcccctgtaggaggctgtgctctgcggatggtgcatgaggaacccaggggtgggggccaaacaggtacccacccctgaccacacattcttctgcaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttgggacttggtgttttgtgcttgtctccatgccccttatgggcttggtgaacatagctctgcttctttcctttgtatcagggccaccccttagcattggagccaaacaaacctgaattcaaacctacacacacactgaagtccccatcttcctccttggagccataatgaagagccactacagtcaaatttctgtttgtggcctcccccaacccctcactatggctgattggaaccaaaatggacacctgacccatggtggcccatgctttccctgagaaatcagggcagatccagctttagttttttcctgtggttggacccataacatgggaatatgggaagttttggtggccctcttctccctgccttattgactgagcatcagaaaaagccagtcggctaaggaggaaaaatgaggcagggagaatctaagagttgctggagaatcccagtcactctggagtcccctctctgagcctttcgtgaggccagctgcctcctgcctgggattgaagagatgctcccgaatcctcctaatgcatccccctgttaaaataatctggcttgaggctgggcacggtagctcacacctgtaatcccagcacttcggaaggccaaggcgggaggatctcttgagcccaggagtttgagaccagctgggggaacagagtaagaccctgtctctacaaaaaaaaaaaatttaattagctgggtgtgatggtgcatgcttgtggtcccagctatttgggaggctgaggtgggaggattgcttcagcctgggaggttgaggctgcagtgaaccatgatcacgccactgcattccagcctgggcaacagagcaagactccatctcaaaaaaaaaacaaaaccaaaaacaaacaaacaaaaatctgactttattcctttcagtcataagtaaaaattatcaattaacataagtgaagtgcttggcacacagcctgtcatataaagttaagggagcagcagctatgattctgaggctgcgtgggaccctcggaggcagccctagccaagctcccctttcctatggttggatgagctgctaaccagggtacagtttgtggggcctcgggttcagagcctccctactcgtctattatttccctgtacccccatccccatggggtgccttgctcatccttgacaaagctgcttttatgacagggtaagctggcagactacaaactttgccccaagctggcagactacaaacgttgtccctacactgcctgcttggaactgggtgggtggtttcgcagttagttgtccttggcttcgaggcagagcccctggctcggatcccattccccagtccctgtctgttttccctttcaaggctgtgggtgggttccacctctagccccaacccttggactctgctctttcttgccaaacctatgctggttcttttccagctccctgtggttgctgggagccaaacccttttaagcccagactcaggctgtctttccccacttccaagtcattgcagaaattcatcctggattctgcccacagctaacccctgacatcctctcacctccattctggaatgatgcctgggttttaacctttttaagcctaaacggttcaccatgacacgactctattagcctcttttttttttttttcctttttttgagacagagtttcactctgttgcccaggctggagtgcagtggtgcaatcaagactcactgcagggtggatgcagtgactcacgcctgtaataccagcactttgggaggccaaggtgggtggatcacttgaggtcaggagtttgagaccagcctggccaacatagcgaaaccccatctctactaaaaatacaaaagttagccaggtgtagtgggattacagtgcctgaaatcccatctacttatgaggctgagacaggagaattgct

SEQ ID NO: 13146 - DNA, 58829 bp, Human
  misc_feature (1)...(58829): n = A,T,C or G
agccacatagcatctctgaaatatagcatatcatagcatctctgaaacatagcatatctgaaaataaatacaccctctttgcttacctcacaggttcttgggggaatattaaatgatatattatgtacgtgctttataagcagtaaaatattacataatgctgtggtaaccctcacagggttgataagctagggagccttaagcatcacctattaccccgtatttattgtgtactgggccttcttctaggcacttcaccgatcttaagcccttgaatctgctgagcatcccaatggggcaggtactgaacagggaagttaagtggcttgtctagggtcacacagtaagtggcagagctgacattcaaggccaggtagtcaggttccagaacacacattgttaaacaccagaccaagctgcctcctgtgtgccccactgacacttcctgtgtcctcctccatgagcccctggcagagatgacaattgcttgccttaacaatagataagctaccagaagtcagggcctgtgcctcattcacacacgtccacagtgcctgccacatagctagagttcagtagatatttgttgaatgaacaaataccctccagggagggatacaataagtctgatacaactactgtatttttccttcattttttcttggctaaccacactcatttccttcagttgtttccaaaaggaggttggcatctctcactgtcctcattgacctcctttgcactttctccacgtcaacagtgacccatctaaagccgactactgtgacatgaacactgcacttgaagagcctgaccagcgctgggctcagtagaactatcctttcttctcccatggtgtatcctcactgtccaggactctcttctcagaagcccactccttcccctgtactgtttatatgcttaatgaaaccaagtacccaaagtgaccgttcaactgttactaggcagctaagtagactccattaaaccttttccttccttcctccccttctttctttctctcccattcttctttcattcttctcgtccttccttctatcctttcttccttcctgcctccttttcttcctctcctctgccctttctttcaggtcttttttgtggtaggaactggtaagaaaaggaaaggaattccctaagattttaaggaaacaacaacaaaaaccaggttatgtttggtgagagagttggggcaagaaactgcatcttctaatatggaatccaggtaatttatcagttttttttcatagcatgactacggtgagatttcttgtaagaaaaaaaaaaaaataccagcatcgctggcctcatatattggattatacttaaggggatcaagggataagatgtttgaatttggagatgtcttgaaaaatcctgtggtgagcacaaatgtttgcagtgtctctgctggactcctcaaattgggaaaaaagagactctggttctcatcatagactcaaaacctgaggaaaagcgagatgcgattattagataaactggcaatgacacgcacaaaaatgtgtctattccagccagggcttttcttttcagttgtttgttttggttagagatgactttggggaactgcatgtcccactggacattccaagctgcgttgtcggagtcgcgggtcgcggcctccagtcagcggagccgccgcccccagggtccgccacccagaagtcggcggaggggggcccgccggcgggagcgcgcgccccggtcgccgtctgcgggtagaagcagaggaaagacggtggcctgggagcgcgcgaggccgcacgtgcgcgcgcccgcccgcccgccagccagtccgctcgcccacgcgcccacgcacgcgcccgcccgcccgttggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtgtaaggcccggaggagggcgagggcgggaggtgcgggctggggtgggccccgttactccacgggagccccgtttcccctgtgtccgtctggtgtcgggggccttccgaaagagtaggcaaccaggaagtgagaacttggcttattttcatttgtttgggtctccgaagtggggacggacgctgtccttcctcctccacacacccctttagcaggccctacaggcccgggcgatgtgacgatcccagtaggcacgggttttcattagggtctgccctgcgggccacccttcctcttcagggtggaagtacgtgtattgacagggagcctccttgttttctcgcccagttaccctgtggttgtctgtgcctttgcacccagtgacatggctcagaggccagatctgggccgtgtgagaccccagtgacaattggcagcgaagctccgtttcgtgtctatttcacacatacccacaggtctcccagtttttccactaatttccgcagaactaatgcaagttcttgtaattgtacgtgataaaaatatatagttgaacacaaatttaagatatacagaaagaaatatgtttacaacaacaacaacaacaactacgtgagggacatacactctgctcaggttactgagggaaaattgtagtcctgaagctcctccttggggcacgaacttggggcttgttaatttggaaagtcccactagtaacattaaaagtctgatattaataaggaatgaaagctttcggaaagaccatgacaaaggaatgtgaagccttgaaccaaataatgagctgtccggaagcaggaagttttgtaatgtttcactatgaagtccacagttttgtaccacttgatgtattacattgatactctctcattttagatctcttgttcaaataatagatcagacttccatacttgtcaggtatctctgtacttcttcaccttttcagtgaaacaaaagagccagcaagtctgagaatgtctggaatagtcttcattatattttggtgaagagtgagtgggatgtgctgtgaataacttagggaaacagtaagacttctcatataagtttgtcagcaaaataattgcatttctcgtatgaccagccatattgttgtttgagtatgcttatgtaatgctttaatttctttagtacctgttagtttatgttcaggtgacttaacagggtaaaaacactgcataattgccatcacagcaccatgacaagacagtggaatttaattcaccacaataatactttctaagtgttgtcaccagcttaagaagtataaccaaatatcatggatattaaacttttaacatatatcacagaattcataacctgccatttgattttattttgacttttaggacctttttgcactgttttaagcctaaggagtatgtggatgcttaaagaagtgatttccaaactttgtcatgccatctatccctccttctacattcctcatgtcaaagaaaagctagagaattttgtcatttaaaaaggcgacgctgtagttgtaatgtttcctctgttaaggagaagaaaagctaagcactttgttgggcaagtggaaaatgcaatagtgggcaaagtgctcagaacctaggtaatcagtaaacttgattgtagttggctacgtggagaggttaatagggtagaaaataattattagtggttttcaaacttagctgtccattagaatcctgggtgtctttaaaaaaagaccattgtctttgctccaccccaggccagttgaaggccaaatactaagtgagggtcctaggagtggacagttaaaataataaataaataaataaataaataaataaaatctcacaggtgattctaatgtgtagccaagattgaaaactattccaggttatagggagggactatctatcatcaataaacagtatgcctttctacattgtgagttaaatctctgattttcctcagcaacttccttcttctcccatttatcttggttctaggctctgggttaaaatctatctcagctacttcctggataaattgtttattcatgacctttagttgagatggggatagttatagtcgataccttttaagattattaaggattaaatgagatagtacatgaaaagaatttattgcactgtgtggtactatgttcaatagatactagtttttattattctcctcctcagatatagttttccactttgagaaacaggtgtaaaacaaagtactaaaaaattagaactgccattatcaaacataacaatgattcaccttagtcttatttttccatttctaagcaatgtgtatgtgcttaaattactgtgtttgaagtattttgatgacaataaggatctttctgcattgaaaacttaacctgttttgtggcgacataggtaataatagaaaacttttttttttaacatggctctgtcatgcataattcccaggcacactagcacaccatgccagtgggtagcccagttaacatctataaaggtttttagaattggtgcatatgtattactataactgttgagcacattcaatttttcttgctttaaatataaatgggaagagctattagaacagttgtagtaagactggctaaatttaacaccccctcctccaccttttttttttattaggtgctgatcagagcagtcttcccttaccaatttgaaagtaattgaccatgtaaactgaatcatctgtagtctagatcagtctagaaggatatagatcaatccatatgtttttcacagatgtaacttttgagtagccctttacaattgactatttctgctctttttttctactttaatatattacagtattactgtttattttagaaactggtattctcacgtgacgtgattggcatgtcattgtggtgatgtgagaaagaaagttaccttccattctctaggttagtctctaggcataatcagatttttgtgacataggatgcaacatgtttaatttgcctaaagtctgctttaaagtggcttttaatgcaaatattttcctttttttaaatacaaatgttttcatcgtgacccccaaatcagacttactttttatacttctctcatgatcagtattcttttctgacattcttctgtttaagtataatatttcccttcattgttagatttctaggtagcaatatggggaaatcttgtgcagaagcatattttgaggaaagtggtattggaaggaaggaaaataaatgataaattcctgttattgcatagtatttaggtacatgtaacctaaaaggcttacagtcaccattcaattaaaagtagatttcctttttgctttcatggtgacttctcatataattgacgatgaggaaaaatagtttctaaaataaacagtaatactgtaaaaagactattaggtagtcttgaccagattggttaatattttaaaattatggagttccttatgcttcaaaatatatttgcaaaatatgttgatcatttattgaagagtttcgtttttcacagtggtaactctaaaggatgtgtcagtctaaaagttagaatttaaaagtagttttaggccaatatttcctaggtaatctgtcattataacagacattatttgctcccatctccactttctacccttcttgtatcagaatcaaagttggggctttcctagagtatgtataatctttgacttctaactcaagccctatcatagagccaagttattttgctgaggtttgtttctaatgttattctcttgtaattttaccgtgtcttcatgtactctcttctgaggtgtaatcttaccatctccacaaataattccttatccttcaacaccagtttttatcaatggctgtcagaaaccactttttgcttgttttcattccagatatgttatggaagattaaagatttagaaatgtgacttgaaaatgtttgggaactacactgggatggaatatgacttttgaataagagacatcacaagaacaccttagtgtttattgatctttcaaatggtagagttagtaaaaaattgtcttgaaatgtgtcagtatttcaggactgctgctagatgctgtggttagcagtaagagacctgaatgtgagttgccaaattacagaatcatgtcaataaaacaattttgttaaactttataattcctacttctttctcccacccagcataatatttaagacacattctatttatttctaaagattaagctttctgttttgaaatttttgaaggcttcattgatgtatctccacaggctataagttcttgagggcagaggttgtgtctattgatctttctttactatttaatatagtgtccagaatattatagttcctataatattttctaaatgaatgaagtaattgtatacatctttggattttgtcagaattgccaaatgaatcactgttttcttctctgcacctccgaacaaaggcaaacaatgttctataatagaatacttatcacactgaaaagataaatagctcctctgttttaaaaaatgaaatctggtaattgtgaggaaattatcaaattaaggtagattttttttttataacttttttttttttctccagagatttttgttttctttttttagagacagaatctttccctgtcacctaagctggtgggcaggggcctgatcacagcctactgtggccttgacctcctggctctagtgatcctcctttctcagtctctgaagtagctagaactacaggtacacgctgctatgcctagctaattttttaaaaaaattagttttttggtttttgtagagatggggcttcactgtattgccaggctggttttgaactcctggcttcaagtgttcctcctgcctcagcccccacaaatgctgggattgtatgtataaaccaccatgcgtggcttcccagagatttttcttattccatatagtttgagaggaaattaatttgattataatttggtaatttgatataatacatatctttggtaatgtgaagaaaaaattctatgcattttatttggaccaactactaaaacttcttaatgcacagattttcttgaagaaatgagaaatatgataattaactgaggtttcaaagtttttactgtatttgaatttgagaatttatatgacatttggtccaaagagttcagtgttggatttttgcctaccaagggatatgaaattgattagtacttaaaattttatatgactagctaagtggaaaagagggattaaatggtgaaaagtaaattatatgtaattattatgatactaatcaaatactattctaaataatttaaataaataatattactctaaagcagaattccagctggagtttatactgtcaacaggttaaaggcccaggatattaggccagctgtatactcagaaagaaatctttcaaatctctaatagctgtgtctggcttaggtttctaatctgctataaagctatttagattttattaataaaattaagctttaaatataacatgtagcaacagatgctcttaagtatccttcaggtatcttctgtgtaagattgtgtgtgtgtgtgtgtgtgtgtgtgtgtgtgtgtgtgtatgtgtgtatgtgtgtatgtgacttttgacccaatcagaatattgggtctggaagggaagagtctagggatttttatttttggtaggagtgttatgtgattctatcagacatatttggaaagtaatagatggtactgtggaaaaagtgtggtctttgatatgaggcagattggtttcaattctcagtcacttcctgacagtaaccataagcagattaacctttccgaacttcagttttttcatctgcgaaagagataatatccaccttagaggttacgtgtgagagtcagaatttatctaattaataggcattcaataaattattacttatgacatattttgatgtttaaccctgcatgcacatttttttggttattctttaccattttgtgggaagtcagtctaaaatgtgaagtatgcttttctgctttaaaacaagattctgagcatagctcagaattatctaattgactagaggaatcatttaatcaaaagcggctatcagattgatacacagtgatgccttagtggccctgaggtatgttggagtttgagaaccttctctaaatggcactttcatttaaatttcatatgtgggctgttctttttggtttgctttcttctgtctttgtaattggtcagctgttcttggaagcaaaacaaccaaccagccttattagaactgcatataaagtaagagaagttcatcctgattgttgaatgtagatgcttgggttttgatgcttgggttttacaatatttattttgttttctcagagtattttttgcttaatctttgattatcagctgtcttgttgaggtttcctgataagtaatttaatgagtatttgttaaatgcccatttttctgccaggtattgcacaaagctctgggtatataatgaaacccaaaatgaaacacacatagtttctgccctcatggagtttacagctaatagacaaattttatctgataaagttgcactgaaggaaatggatgagatcctgtgattgaaaataatgtgattaggaagaacctctctgaggaagctaacatttaggaaggatgagagtcctgtcaggagcccctggatctggagaacagcaggtgccaagactccaagccaaaacaagcttgacttgcctgaggaactgaaaggatacctctatattatggctagaatatagtgaacaaaggggataatgtcttgaaatgaggttggagggttcagtaggggccagaaaggattgtaaaggaattagaatgaaatttagaaggttatagaagcagcttccataagacatgatagtggccccagctagggtgttgatctctagattaaaggagttattacagttctgtgtgtaaaccatcaaatttcacagcttttcctatgaggtatggaaatacatagcagtggccacttttgctgtctaattcctcagttcttatgtttgttttggtctgtttattttttaattttagctttgtgtaggctgaggttaaataactggctacccttactgttcactgggagtgattttgatggcatacctgcactttctgttctgctgctggggcagctagtatgccaagagaatagcacatgccagaagtagagagtgtttcccacaagatcatagattttgaagtgggaaccctcgtaaatgtgatatcctttagctgtaaggtgtgtagtatgtgacagccctcagtacatgattcattagatttgaggaaaaaaattgtgttttttatatcttacatttaaaactcagttgcatccgtaggagctgaaatgttctcacagtgtccctgaagaataatttttttgttcttaagctttttttctctcccactatctacttaggatagagttggttggacttgaaggtaacctaactttgttattttgattgataaaaaaagtgaatgtactatatatagtgagcttcctgcaagaacttcttgttttattctctttgatcttgcattgtagtcataatgtgggccttggttagttcagtggtggagttcctatgtacccagtctcctttcttggtcttttctaaactgctcaattataaatgttacttgaaatgagtatttttgttagtctatattgtaaatcaattcaaccatatattttgcttaaatgaacataatttagcatcattattttgctcttaagatttatagaagtatgaagaatattctaaaatatgtataaatcagatatacaaaaatcttttttctgtagttcagaaaatttaaaagttgttaagttagatcagctgcatccctatatcgccagaagttagttatactgtgcattttcatcagtatacacttatatagctttcactgcttaacaacatatttaatctgttaataatggaaattataaccttaataattaaaaattgataaaatgctaatgctagattattataagactatgtataatggtgaggtttatgatagagtaaatttaacacatgctttggagaattaagtctttgatttcactagtttcctgaatgagattaaactttcataaaaccagatgaactcaaatattgttcagaatgtggttacagagttaagatttttagaattattctgaaacccaaatatacgtctccaactccagggtctctgtatcttttgtataaatagagtatactttcaattagatcccatcctccttgagctacattgatattcagacgtatgttgaatcaaccagataaacttaaagcatgatttatatgcatcaaagcctgttaatttttttccatagttatgactttatctccaaaactagctaaaaatttgagttcattgagctcaaagttcaacattaggaaataagcactctcttcatgtgccatctgcataaccaatatgttcagtttgaaatttctagttcatatgctcataggtcttgtcatatctgtaggaacataaaaattctctgtatctatagatttgtacaggtggaatgtctcagaatccagaatatccaaaatggaattcataatctacaccccaaatcagcttcaacggcagccttccattctcagttgatggcagatcgaggaccctgtttgtttagatcaaaaactttttgatgtattcttgattttcctctttctctttcactacatccattctgtcttgacatcttggctctgtcttcaaaatttggccctattttgccacctacacgactggagtgaattgccagtctcccttctgccttacgcttaatgtatttcttaagtcagttatggtggcatgtacctataatcccagctacacgggaggctgaggcagaaagatcacttgagcccaggagtttgagactacactgggcaacatagcaagaatccatctaaattacaaaaaatatatatatatttttttcttccccctgtctccacctttccacctttgcctctcctcttatacaaccattttggtacatctgctatagtgatccttttaaaacataagtcagttcaagtcttttctctgtatcaggcccctcaaaggttccccatctccttcagagtccttttaatgttctaccagaccctccctgatctggcccatcattacttgtctggtgatctcagtttctgcttactattggcttcagtttattttgatttctaattatcgatggctttactacatcttgacttcaatttaagccctctctctgtcagctctgcatgttaccatctatttgtcttatgttcagatacctcaagagagagctgattgagttagttaatgttatctaagttaggcaggactgtttggccttgccattccatgtgctgctacccagcccagggattagctgttcttaaagcagatgcccacttgtgatctaattagccaaagtatagggagttcctagttaggcatgcggagtaacagactactctctctagtatacatggttttgagctgtgtagcatcttttcagattgttgtattataattaatttaattataagatatttctgttttaaaaatttcactgttaaaaatatcactgtaactcagaagaaaagaaacattgaacatatatttttgattaagggcaaaacaagttgaagcagtggattcttgcatttctgcatttaaaaagcaaaattcgttatgagttcaaaacatgtcttaatttaaaatgatagctcagtagtgaatgccaagagacattgttaatatgaggagatacaaggaacatagaagaagttaaaactgaagtaagaaggacagaggattagatggacttgaactatggaaaacattgaaatgcattcaagaaaactattgattagtgaacctaaatttccttgtttacttatcttaaaatacctagttaataccaaataaaatattcaaataagaaaacaaaattagggtggtattgtacattataaaatatttgtctgccgggtgtagtggctcacgcctgtaatcccaatactttgggaggccaaggtgggcggatcacttgtcaggtgtttgtgaccagcctggccaacatggtgaaaccccgtctctactaaaaatacaaaaattagcccagcatggtggcgagcacctgtaatcccaggtacttgggaagctgaggcacgagaatcgnnnnnnnnnnnnnnnnnnnntatcactgcagatactttttattcattaacatatctgtgccatgttgcattttctcttgatacatttctggaagtagaattactgggtcaaagggtaggaattttttttttttttttttttttttgagactgagtctcactgttgtcagcccgggctggagtgcagtgacgcaatcttggctcactgcaacctccgcctccgggttccagcaattctcctacctcagcctcctgagtagctgagattacaggtgcccaccaccacatccagctatttttgcatttttagtagtgatggggtttcaccatgttggccaggttggtctcgaactcctgacctcaggtgatccacctgccttggcctcccaaagtgctgggatcacaggtgtgagccaccacacccagccagggtaggaatattttttaagacccgttttacatactaccagatggcactcctgaaaattctatcaacttgcaagatttttgttcttttcagttaatatcatggtatattgaattttcttcttcaacattttcctccattgagaaagatggtaaaaatactgaagatacataaataaatctaaaaatgaaagggagggaaggtaaataagtttatgttcaatggtatttctgtgtttttagtttgcaaatttcatttttaatggttgtttaatattctgttatattgagataagataattttcttaaccattcctaaaatgttgtaaatagatacatatttatatttgtgaataaagattcaatgaacttgtttatgcataaatttaatccacatttcaagttattttttaggtaatattacatttctaaagagaaaacagtatgacaaaggtataaatattttcaatgccaaataattttaatggttgtaacaatttatagttccattgacagtgtgtgatatttttccatcttgaccttcttgccaacataaaatattttttaaaatttaattagtcttgtagataactgaattaagatgccacctactttaaatcatatttttaaaaattatccaagtgttacttctggctttttggattagtagaatgtttggttattagagtctgaagggggttcagcttcctactcaatgcaggaatcattgctcttctttcaagtacatcaaattattattttatgggatgaaacttggcctttctaatactgtgctgagccagttgtactttgtcttagaataaaggaaattatttttaccatatataaaaagttttatgtaaacttgtaggtacatttataatgctgtcaattgaaaacaaaacatagatgccattttcattctaacagtctctgcctcctgctgaacttaaaaaagaagccagaactaaggtattgtcaaaattaagtggtttatgtcaaaaataaatcattagaggtgatattttacagttatattatcaaacaagaagtgtgacttttcctatccatttaataaaataagaccgtcttgctaaaattctacctgctactattgttttggttggtctagatttggattaaaaaaaaagaaggttttggcagggatgaaaaacatagcaaaggagatatttgctgtggcctgtgccaaataagaaattctgacattcaagctctttgccaggagaaagcatgctatatgaaagaagacttgctgaaaagagttgttttcaactactctgatgagaacagtcttattagtaaagaagtgtgtaggaaagcctggattgtggtagtttgaataatgaatgggaggtaacgtaaagatagttaatgtaaaggagtctttcaaaacattagttgaggaaggaaagaaatagatgccatcagacattgagagagaagaagaaataaggattcacatcctcaggtggatagactaattcagatttgtaggctatgtttaaggagcctgaagcgaggtagaaatacagtgaattgcagaggagactggaggagatgcactcagaagtaaatggttagtttttggaagctttcctccattgagagatggtaaaaatactgaagatatataagtaaatccaaaaataaaagggagggaaggtaaagcagtttatattccatgacatttttttctctcagagttgacaactgtggttatttgcaaaaaaatgttggttgtgaggataaagtggagtacctaaagacaggcacaacaactacggagcatggaaaagagaacttactggggatgaataaagattgttacaataatactcatgagattagaaataagatatgtatgttatatatatatttattattggtgatacatttataaatgtgatttttctccagtagctccaggcagtgtgaagaaggtaaacaatttaattgaacctgggttggcaagggacactgtagagatgattaaaggtgtttgttggagtatgttcaaaatgattgactatgtagttctggcaaataaggaaggaaatggagtcatagggagctatggaggggtgggaagcaatatattacaaccagaggccaaaaaacaaatttagtaaggatgggagaaatgaaatgattgatggcagtggtaagagaagaattttacagttcagaatttcagaggtgatacagtcccaagtgatgacaatatgcagaatatatcacagtgagtaggttgctgaattagatggaggtgcaggaggtaaagttctttagaatagataaggtcaggagtgaactgtagttgaggatttctaaggaaagagtggcatttcaacagggtttttggttaaagtgaagatatatacaagtatgtggtgcttaactatggggactactctgataaatgggtcagtaggcaatttcatcattgtgcagacatcacagagtgtgtgtatacaaacttaaaatggtgtagcctactacacatctaggctatatggtatagcccatagcccttaggctacaaacctgtacagtatgttactgtactgtgtattgtaggcagttataacacagtggtaagtttttgtgtatctaaacatagaaaaggtacagtaaaaatacagtattaaaatcttgtgggaccaccttctagtatgtcctgactgaaacgttgttatgtggcacatgactgtatgtatttaaggtttgttttgttttttaagataagatataaggaggtatcctgatagctgcagatcaacagattgagggtttcaaggtctatcaggaaagataaacttgaatatgatgatcatgagaaagcaggataacagattggagtggtttgcagagttatgactatagactggaggaatgtagagatagtgaaatggatgtatgtgggatatgagtaaaacaagcctgtttcaagattccatttagatttaggtgtaaagttggagtccccccttcaaaactttacagtgtattacatgaactttcaaaattatctcaaattatataaaagtaaaattggtctcgtgtgtgatttcttaaggaaacaaaggaagctgtaaaagccataaaagcctgcactgaagtgttgcatggaatgtgctcagtagttgtgatttgaatgaattctctgttctccaagtactggtagacttctgatagataaaagcaagataggttgtttttattatgtcttttatcttcttgttatatttaccattctttgaaaatagtttaaatcttttatcaattctaaagccatggaatattttaaccatgattcaagaaaaggtcttttaggtaataggaatagatataggtatagtacacgtctacattttctttcataccatctaatgcactgacaaataggtgttcaatggaacctaagacggttcttggtagcactttgtccattcctacttttttattttttctctccctttttccttattcttcccctcctcactctttttcctgcatttttccttctcatcttattgcttgtgtaggacacctgctaaaattcacaggtattgtttgtttccaccaataacattaaaagctggaaaaaatcgctatcccacccattaaaataatatgctttgtagttactttttaagatataaagttggtagctcaaattaaatgaaccatttatatttttgtttacatactgctggttaattaacattcagccccttatcattatgcaaaagtttccatttaactgctaaaataattgttacatttcataaattgcttgttacagttattttatctcaaacttccattttatgtctaaaacttcctccatatgtgaaaatgctttctattgacttgacctttaaattaaatggtctacatttttggcaacaataacatgtaataacatattcttcttattttttaaaatagatttggactgagcaacaaatttgaatctgaattcccttcttcattaactggaaaagtgagtgtctcatttatgtactatttgtatgcctcaaaatgaaagtttttttctgagaaaattagaaaaaagtatgctcatcagtcatgttttttgacattaatattgcattgttattatttcttaaaatttttctttaggtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagagtaagttgaattatatattttaatttaaatttagaagtggacaagcaagtcttgcatttatctagtttttattttttgtattgaatgaatcacactatcctgaataaaatatgaaaataatctgatccaggagaggagtgagtcagtaaagttactatatatccaagtgctgttattaaatagccatctaaaaattatatttataattttagaagcaaggagtagtgtatggcattgtctgtatctgtacattgacggtggtgtggtatagtgatcaaggatgctggcttcagctctaccacttttctctgtgaccttaggcacgtttcctaacctctttaaaccctacttgacacaactgtaaaatgttcacctactacttgaatataaaggtaaaatgaaaatgtttggaaaactcttagctgaatatctcaaaggaagtggttaataagtattaattaatagtattcttactgactgtaagatggtacccatacaagaaataaaatggttacaatggttgtttcttgttggtaagattatgggacattcttttctgctttttatattttacaagtttcctgtagtgagcacaaagtgattctgtaatcagaaaaaataatttcaaagactcattattttgactgcttataataaaaaattctggccaggcacagtggctcatgcctgcaattttaacactttgggaggccaaggcgggcggatcacttgaggtcagaagttcaagaccagtctggcgtacatggtaaaaccctgtctctactaaaaatacaaaaaattagccaggcgtggtggcgggtgcctgtaatcccagttagtcaggaggctgaggcaggagaatcgcttgaacctggagggcgaaggttgcagtgagctgagatcgtgccattgcactccagcctgggcaacaatagtgaaactctgtctcaacaaacaaataaacaaaattttaagatgttggtagagatatgacaaattattatagattgaatgtattatattcttgttaaaatttttaaaaattgtatttatatgtataaaaatgatactttaaaaaaatttttttaaataaataaattttattttttaaaaatgtatttaaaaaaatagagacagggtttcttttttttaattattatacgttaagttctagggtacatgtgcacaacgtgcaggttagttacatatgtatacatgtgccatgttggtgtgctgcacccattaactcgtcatttaacattaggtatatctcctaatgctatccctcccccctccccccaccccacaacagtccccggtgtgtggtgttccccttcctgtgtccatgtgttctcattgttcaattcccacctatgagtgagaatatgcggtgtttggttttttgtccttgcgatagtttgctgagaatgatggtttccagcttcatccatgtccttacaaaggacatgaactcatccttttttatggctgcatagtattccatggtgtatatgtgccacattttcttaatccagtctaccattgttggacatttgggttggttccaagtctttgctattgtgaatagtgctgcaataaccatacgtgtgcatgtgtctttatagcagcatgatttataatcctttgggtatatacccagtaatgggattgctgggtcaaatggtatttcaagttctagatccctgaggaatcgccacactgacttccacaatggttgaactggtttatagtcccaccaacagtgtaaaagtgttcctatttctccacatcctctccagcacctgttgtttcctgactttttaatgatcgccattctaactggtgtgagatggtatctctttgtggttttgatttgcatttctctgatggccagtgatgatgagcattttttcatgtgttttttggctgcataaatgtcttcttttgagaagtgtctgttcatatcctttgcccactttttgatggggttgtttgctttttcttgtaaatgtgtttgagttcattgtagattctggatattagccctttgtcagatgagcaggttgcaaaaattttctcccattctgtaggttgcctgttcactctgatggtagtttcttttgctgtgcagaagctctttagtttaattagatcccatttgtcagttttgacttttgttgccattgcttttggtgttttagacatgaagtccttgcccatgcctatgtcctgaatggtaatgcctaggttttcttctagggtttttatggttttaggtctaacatgtaagtctttaatccatcttgaatcaatttttgtataaggtgtaaggaagggatccagtttcagctttgtacatatggctagccagttttcccagcaccctttattaaatagggaatcctttccccatttcttgtttttgtcaggtttgtcaaagatcagatagttgtagatatgtggcattttttctgagggctctgttctgttccattggtctatatctgttttggtaccagtaccatgctgttttggttactgtatccttgtagtatagtttgaagtcaggtagcgtgatgcctccagctttgttcttttggcttaggattgacttggcgatgcgggctcttttttggttccatatgagctttaaagtagttttttccaattctgtgaagaaagtcattggtagcttgatggggatggcattgaatctataaattaccgtgggcagtgtgtccattttcacaatattgattcttgctatccatgagcatggaatgttcttccatttgtttgtatccttttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcaccttgattttgtatcctgagactttgctgaagttgcttatcagcttaaggagattttgggctgagacgatggggttttctagatatacaatcatgtcatctgcaaacagggacaatttgacttcctcttttcctaattgaatgccctttatttccttctcctgcctgattgccctggccagaacttccaacactatgttgaatatgagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacgtttattgattttcgtatgttgaaccagccttgcatcccagggatgaagcccacttgatcatggtggataagctttttgatgtgttgctggatttggtttgccagtattttattgagaatttttgcatcactgttcatcaaggatattggtctaaaattctctttttttgttgtgtctctgcccggctttggtatcaggatgatgctggcctcataaaatgagttagggaggattccttgtttttctattgattggaataatttcagaaggaatggtaccagttcctccttgtacctctggtagaattcagctgtgaatccatctggtcctggactttttttgattggtaagctactaattattgcctcaatttcagagcctgttattggtctattcagacattcaacttcttcctggtttagtcttgggagagtgtatgtgtcgaggaatttatccatttcttctggattttgtagtttatttgcgtagaggtgtttacagtattctctgatggtagtttgtatttctgtgggatcggtggtgatatcccctttatcattttttattgcatctatttgattcttctctcttttcttctttattagtcttgctagcggtctatcaattttgttgatcttttcaaaaaaccagctcctggattcattgatttttttgaagggttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggtatttagtgctataaatttccctctacacactgctttgaatgtgtcccagagattctggtatgttgtgtctttgttctcattggtttcaaaggacatctttatttctgccttcatttcattatgtacccagtagtcattcaggagcaggttgttcagtttccatgtagttgagcagttttgagtgagtttcttaatcctgagttctagtttgattgcactgtggtctgagagactgttataatttctgttcttttacatttgctgaggagtgctttactgccaactatgtggtcagttttggaataggtgtggtgtggtgccgaaaggaatgtatattctgttgatttggggtggagagttctgtagatgtctattaggtctgcttggtgcagagctgagttcaattcctggatatccttgttaactttctgtcttgttgatctgtctaatgttgacagtggggtgttaaagtctcccattattgtgtgggagtgtaagtctctttgtaggtcactaaggacttgctttatgagtctgggtgctcctgtattgggtgcatgtatatttaggatagttagttcttcttgttgaattgatccctttaccattatgtaatggccttctttgtctcttttgatctttgttggtttaaagtctgttttatccgagactaggattgcaacccctgcctttttttgttttccatttgcttagtagatcttcctccatccctttattttgagcctatatgtgtctctgcacgtgagatgtgtttcctgaatacagcacactgatgggtcttgactcttcatccagtttgccagtctgtgccttttaattggagcatttagcccatttacatttaaggttattattgttatgtgtgaatttgatcctgtcattatgatgttagctggttattttgctcgttagttgatgcagtttcttcctagctttgatggtctttacaatttggcatgtttttgcagtggctggtaccagttgttcctttccatgtttagtgcttccttcgggagctcttttagggcaggcctggtgctgacagaatctctcagcatttgcttgtctgtaaagtattttatttctccttcacttatgaagcttagtttggctggatatgaaattgtgggttgaaaattcttttctttaagaatgttgaatattggcccccactctcttctggcttgtagagtttctgccaagtgatcaagtgtttctttttttttttttttttttgaaatggagtctcactctgttgcccaggctggagtgcagtggcatgatctctgctcactgcaagctccacctcccgtgttcacgccattctcctgtgtcagcctcctgagtagctgggactgcaggtgcccaccaccacacctggctaagtttttgtatttttagtagagacaggttttcactgtgttaggcaggatggtctcaatctcctgacctcgtgatccatccgcctcggcctcccaaagtgctgggattacaggcgtgagccaccgcgcctggccgagacagggtttctatgcccagggtggtctcaaacttctggactcaagcagtctgccctccttggcctctctaagtgctgggattacaggtgtgagccactgcacccagccaaaaatgaaattttgttaagttgaaaatgaatgaacagttttatgtggctacattttgacaaccaataagagtaggaagtatggatgatcaaattctctttgtcccttgatttctgttataaaataaaagatatattcctactaaaaatttttaaactggtacattctattgataggaaggagttaatgcctttgtaatagaatgacttatgatatttacttcaatatttctaatattccttttttctaaaaatggttctttttttttcatcattctcaccagattacctttgcactacagaacattttttcgtctctggatccacagttgattttgtcgctcttgtagtttggatcccctcactcccttctgctatgtgggcatttccattgtttcaatgcctgctatgtctctcttggttgggaattgccatcatgtaacccagaaaatcctaagagttttaatactgtagatacctttgagatctggcttgtttgtttgtgttggttttgttttgataccctttttttaaacctttaaatgagtaataagatgttgcagtgtgtacggtgtatttagaaaacaaaggtaaatgagttaaactttgcattcatatcaacttgagatcctttttgaaatgccttcattaaattccttcttatgtgagatgtaagattgactttttaagctagtttaatctgtagtttctgaaagtacatttcatttagcattgtagtgttcagtcttaagttctctctttgtattttatatgactagatggaatatttatttgatgcatttaattttatatggagtactatctagggagcataaacaaacatgacttgctttttaaaaaagccatacatatctgtccttgggtgtaaactattacataaccatggtaagagtgacacttcatgcatgtgtgaaggatattaccggccctggagaaagaggtgctttgtaagatggaggcaaaataatttggatttttttttccttttttttttttttaaattatactttaagttctgggatacatgtgcagaatgtgcaggtttgttacataggtatacacgtgccatggtggtttgctgcacacatcagcccatcatctacattaggcatttctcctaatgctatccctcccctagcccccaacccctgacaggtcccagtgtgtgatgttcccctctagagcagggatttttaacgttttatttgccataaatccttttgatggtttagggaagcctatgaatgctttcttagatgctttacatatatttaaaaatatttaatgtattctaaatgcataaggtaaaaatacatggattacagaggaaaccaattatataaaatatagttatcaaaatactagaaaactttaatgtggtttataaatatgtttattaatgcatacaaaatgagatagcaacaaatccatgataataatgatatgataggaagaatctgtgatttctttaagtgatgaaggtgcaggtcctgttcagtctattgcagttagttgcatacattcataacctaaggaaatgtaatacatttcagttagtggttaaaaagatgtattttcatttcactcactttcacagattcccagaattctgtctaggtactgtatgttaagaaccctcgatcgagaggcatgagtataaaaaattgccagcctgtgaacttctgttttctttcttgtgatgtgaaatcctcttatgtggttagaatggtctcagactctaagacaaatcaggaccaaaggcatacttgatatgcagctcagtgcttttactttcttcacattattcactgatttggaaaactgcagttctgtcttgccttcaaaatccatcacaacacgaggtcaggagatcgagaccatcctggccaacatggtgaaaccccatctctactaaaaatataaaaattagctggcatggtggcacgtgccagtaatcccagctactcgggaggctgaggcagaagaatcgcttgaacccaggaggtggaggttgccattgattgtgccattgcactccagcatggggtgcaagagcgaaactctgtttcaaaaaaaaaataaataatgtgtctgtaaacagaaacacacacaaaacaaggttacgtattgatccattgatgaaaatgttgtgaccagaggcttgaagaacctaaccctgtatttccccagaagtaatagttccctactttctaattcagcattcgcagagactctacagaacctaactacctgaataacaagaacagactgtgctcggtctccaccgagcgacttgctcannnnnnnnnnnnnnnnnnnnttccgtctcaaaaaaaaaaaaaaatctatccccaacttagtgccctctttttatgacctgatattattcccaagaccttgtttttattctgttctattattattattcttattatgattgagacggtgttttactcttgtcatccaggctggagtgcaatggcatgatctctactcacagcaacctcctcctcccagtttcaagcaattctcctgcctcagcctcctgagtagctgggattacaggcacctgcagccacacccagctaatttttttttttttttttttttttgagacagagtttcacttttatcacccaggctggagtgcagtggtgtggtctctcagctcatcacaacctacacctccccggttcaagtgattctcttgcctcagcctccggagtagctggaattacaggctcctgacactatgcccagctaatttttgtatttttagtagagacggggtttcaccatgtttgccaggctggtcttgaactcctgacctcaggtgatctgcccgcttcggcctcccaaagtgctgagattcaggtgtgagccaccgtgctcggctaatttttatatttttggtagagacggggtttcaccattttggccaggctgatcttgagctcctgacctctggtgatctgcctgcctcggcctcccaaagtgctgggattacaggcgtgagccactgcgcccagcatgttctgttattttgattattttttagaccttccaaattgccttttttcttaactacctttgcctatttttgaaaattgttttttaatatacagtaaaatttttataaacagttctgtgatttttgataaacgcatagagttttgtaaccaccaccagaatcaagatacataacagttttccataaaaaacttacttgtgctgtagtaagttttttacttactacctctgtagttgaaccctcgtcaactcttaaaccctggcaaccagtgatctgttgtctatccctacaatactgtcttttctagaatattatataaatggagtaaaatagtgtatataactttttgagtctggcttctttcatgtagcttagtgcatttgagattcatctattttcttttatgtattaatagtttattcttttttattgttgagtagtattccattgtatggatgtatcacagtttgtttatccatttatcagttgaagacactgagtttccagtttttgaataaagcttgccataaacattcacatgcatgtttttgtgtgaacacaagttttcatttttaggaaggggattgccgggttatatggtaagtgaatgtttaatttataaaaaatctccaaactgttttccaaagtgggtgaaccattttgcattccagccagcaatgcatgagagatccagttgcttagcatccttgcaggacttgatatggttagttatagaaattatagtcattctaaaagatacatagtagcatctcattgtggttttaatttgcattaccctcatgagtaatgatattgagcaccttttcatgtgcttatttgccatttgtacctctttgttaaagtgttcattgaaatattttgcctatttaaaaattgttatttcttgttgagttttgagagttcttcatataattctgaaaataagtcccctggcagattcgtgctaatatatatttgcagtctgtagctgtcttttcattctccaacaatgtcttcggcggaacaaaagcttttgcttttgatgaattcatcgctttaaaaaaaaatagattgtacttttgtgctgtatctaagaatttgcctaaaccaaggtcatgaaaattttctcctgtgatctctttacttttaggtgtgtgacccattttgactcaggtttttatatgagtgtgaggtatgggtgaaattttttttttttgcatatcactttctaggttttccagtaccatttgttgagaagactatcctttttcccttgaattgccattgtacattgtcaaaaatcagtcaacaatacctgtgtaggtctctttccatactctattctgttctattgatttgtatgtctatcttgattaaatatcataatgtctagtttactgtagcttttttttcttttttaattaaaaaggagacagggtcttgctgtgttgcccaggttggtctcgaactcctgggctcaagcgattctctcatctcggcctcccaaagtgctggaattacagatgtgagccactgtgtccagcctactgtagctttatagtaagttttgaaatcaggtatattgagcctttcaatttttttcttatttttcaagattgttttggctgttctaatttctttacctttctttataaattttagaattagcttgtcaaatatctataagaaacactggtatttgattggaattacattcaatttacagatgaattggagagaattgacatcttaacaatattaagtcctctaaaccaagaacatgacatagtctccatgtatttaggtctttgacgttttttttgttagagctttgtagttttttgcgtagcatatagattatgctcatgttttattagctttatacataagtatttctttgggtttggcgctattgtaaatggtattgttttttaaattttgatttccagttgttcactgctagtacataaaatacagttgatttttgcatattaacgtcatgtccttcaaccttgccaaattcacttattaaattccaggaacttttttgtagattccttgggattttctacagagataactatgttgtcagaaaataatgacagttttattcccaatctgtgtactttttcttttccttctctttttcacagtgtaggagttctaataaaatgctgaataggagtgatgagagcaaactccttgctttattcttgattttctgtgttgtttttctgttttcacttccattgattttttgtttttattatttcttctccttgctttggatataatttactcttgttttttagtttcttaaggtagaagtcattgatttgtcttttctttttttcttgtataagcatttaatgctctttccctctaaagcactgttttgactatatcctacacatttttatatagtatttttgttttcttttggttcaaagtatttgtgattttctctctgagtcatggattatcaagaagtttgtttaacctccaaatatttggagatttaccagaaactcttctgttactgatttctagtttaattttattactgttaaagcatatacttggtgtgatatcagttcttttaaatgtgttttattttacagccttgaatacagtgtattttggtaatggcatgttcaaaacttttatttatattttactagctttattgaagtgtcagtgacatacaataaactacacatacttaaagtatattatttgatgagttttgatacacttgtgtgcatcaagatagtgaacatactcatcatttccagaaacttccctgtgcaagtgctgatctgctttctggcactatagattaatttgctttttctagagttttatctaaatgaaatcatacaatgtgcattcttttttgtcttcttgttttattttttatttatttatttttgagatagggtctcattctgtcactgaggctggagttcagtggcatgatcatggctcactacagccttcccagacttcccaggctccactcatcctcctacctcggcctcccaagtagcttgggccacaggtgcgcatcaccacgcctggctaatttttgtatttttggtagagacagggtttcatctctcaaactcctgagctcaagcagtccacccgcctcagcctcccaaagtgctgggattacaggtgtgagcctccgtgcttggccagcccctttttcttttacttactatgattttgagattcaacaatgttgttgcatcagtagttcattcccttttattgctgaataatgtttattatatggatatgccacatttgtttatctatttacctgctgatggacattttggtctgtataaataaagctgctgtgaatattcttgttcaggtctttttggggacatacactttttttttttttgagtaaaaattcctgagtggaatgccttggtcatatgtcatgtgtatgtttagcttcctttcctttcttttttttttgtggttgtgggacaatccatggaaatgcatttaaggaactgagaaactgccaaaagtggaggtactattattttatgatctcatggtactgtaggatagattctgttctgctacatacttgtcaacatttagtatagtcttttaaagagttggggtatgtgtcccctctaaatctcatgttgaaatgtaatccccagtgttggaggtagggcctcgtggaaggtgattggatcatgggggcagataacttcacaggttggtgctgagttctctcaagatccggttttttaaaagtgtgtggcacctcccccaaccccgttgctcctgctctgccatatgagatgcctgctgcctttcatcttccaccattattataagctccctgagtcctccccagaagctgagcagatgccagtgccatgcttcttgtacagcttgtccaataaaacctcttcattataaattatctagtctcaggaatttctttatagcaatgcaagaacagcctaacgagattttagtaccactgtcttgataactgatagaactagtagacagaaaatccctacagatgtcagccaacttaacctaattgacatttataaaacactctaaccaacaataggcaaatacacattcttttcaagtacatacagatcactgagatagttcttattcaaagtaattaaacaagtcttaataaatttaaagggattcaaaacatacaaagtgggttatctgaccacaataaaattaaattaaaaatcagtaaatgaaaaatcgctagaaaattcccaaatatttgaaagctaaataaaatgcttctaaataactcattggtcaaagaaatcaaaagggaaatttaaaagcagaatgaattaaatgaagattaaaacacaaaatgtcaaaatttgtgtcatactactaaagcagtgttcaaggaaggaaatttataccactgaaagtctacactagaaagcctcaaatccatgacctttgttttcatcttaagaaattagaaaaacaagagcaaattaaatccaaagtaaggagggggaaaaaaataatggtcagactgaaacctatgaaatataaagcataaaatcaatagaaataatcaaacctttgagaagatcaataaaattaataaatctctaaccagagtggggaaaagagaaagaaagagataaattaagtttcaggaatgaaacaggtgatgagactaagaggttttaaagatagtaaaagaatgattaatgaatactataaactgtatgcctgtaattcaacaccttaaagtggacaaattccttgaaaaacaaaaactgtaaagcttaaccaagataaaatagatgacttgaaaagtcccatatcaattaagtaaattgaatttgtaatttaaaaacttccaacaaagaaaattccaggcccagatgcctttactggtgtattcttacaaaatttaaggaagaagtaatgcctgttctacacaaactcttctagaaaatcaagagaaaagaacccttcccagctcactttatgaggccatcgttaccctgaggccaaaaccagacagagatattctaaaagaaaagtctacagaaaaatgttcctcatgaacatagatataaaacttctaaacagacgtttagcctatcaagtccaacaaaaacatgaaaagaaagacacacatggccaagtacattgtccttcccaggaaggtaagtaaggttggtttaacatccaaaaatgcaatgaatgtaactcaacatatttctaaactaaaaagaaaaaccacacaacaatctctaaagtggcagaaaaagcatttgacaaaatccagcatgtatacttgattaacactctcacagcctaatagaataaaacttcctcaagctgataaaggacatctacaaaaaccctacaattaacatgacacttaataatgaaggtctgaatgcatttcttctaagatcaagaacaagccaagagtatgttctcactactactaatcaatgttattctggagattctagccagggcagtaaggcaagaaaaagcaacaagtatagtaataatactgtcttgatgggcagatgacatgtttgtctatgaagaaaattcaatagaatctttaaagaaactcttgaaactaacaggtgagtttagcaaagctataccctatcaacaaaaaataaaaaattaaaatgaaaaacaatttttaagtagcataaaaatgctaggtacttacagagaaagctgaaaaaaacatatataagacacactaaaatctacaaaataccactcagaaaaaaacttaaaagacttaagtaagtgggggaaaatattggttcatgtgtcagaagaggaaatactttttttttttgagacagagttttgctcttgttgcccaggctgaactggattggtgtgatctcagctcaccacaacctctgcctcccaggttcaagcaattctcctgccttagcctcccgagtagctggaattacaggtatgcaccaccatgcctggctaattttgcatttttagtagagatagggtttcttgatattggtcaggctggtctcgaacccccgacctgaggtgatctgtccacctcagcctcccaaagtgttgggattacaggcatgagccaccgcgtctggcgaggaaatacttttaagtggccaatttctccaaactgatccatagatttagtgcaatccaaactaaattcccagcaggactttttttttttagaaattgacagactgattctaaaattcatatggaatacagacaacctacaaaagcaaaacaactctgaaaagggaatacaaagttggagaaccaacgctacccaatttcaagacataattataaagctacaatactcaaagtagtgtggtactcgcatcaagatagacaaacagataaacagaagagacagagccaaaaaatagacccctttatgaactgatttccaccaaaggtggaaaggcaattcagtaaagaaagaacagtcttttaaagagatgtaattggtaaaattaaatgcctatatatatttttaaaatccttcaatctgtacattaaaccgtatattaatagaaagtttaactcaaaatgtaaaacctaaacctataaaactctagaagaaaacataggagaaaaatccttgtgacctgggcttaggaagaattactaggtataacattagcagcacaatccctaaaagaacaccagacaaattggactccataaaagttaaaaatttccgtttttgaaaactattggaggatttaaagacaaactactgactgggagaaatctttgcaaagcagatacttttgtccagaatatataaagaattctcaaaactcaacaataagaaaacaattcaagaaacattgagcaaaaatttagaacagacacctcaccaaaaaagatatgtaaatgaaaaattagcattttttcagatgctcaacatcactaaccattaggaaaaatgcagattaaaaccataatgataacattacatacttattagaaggactgaaattaaaaagactatgttagtctgttcttgcattgctataaggaaatacctgagactggataatttataatgaagaggtttaattggctcatggttctacaggctgtacaagaagcatggcactggcatctgctcagcttctggggaggactcagcttataatcatggtggacgatgaaaaggagcaggcatctcatatggcagagcaggagcaagggggttgggagaggtgccacacacttttaaaaaaccggatcttgagagaactcagcaccaacctgtgaagttatctgcccccatgatccaatcaccttccacgaggccccacctccaacactggggattacatttcaacatgagatttagaggggacacataccccagctctttaaaagactatactaaatgttgacaagtatgtagcagaacagaatctatcctacagtagtgtgagatcataaaataatagtacttccacttttggcagtttctcagttccttaaatgcatttctatggattgactataattttgggtttgtgtatttattcatgcagcttatgctgtatgtattttggcactctgtaattaggtatataaattttcaggatttttgtgattgacctctttatcattataaaattgacctgtatttttctctgaaatttactttgaacaagactccgtctgcaatcccggcacctcgggaggccgaggctggcggatcactcgcggttaggagctggagaccggcccggccaacacagcgaaaccccgtctccaccaaaaaaatacgaaaaccagtcaggcgtggcggcgcgcacctgcaatcgcaggcactcggcaggctgaggcaggagaatcaggcagggaggttgcagtgagccgagatggcagcagtacagtccagcttcggctcggcatcagagggagaccgtagagggagagggagggggagggggagggggaggagaggatacaccaacttcttaaccttgttagttgtcttatctcctttataaaaatgctttactcttttagatatgctaaccagaattatgccactttctaaaagtggtccctatatggatttattaaaaatattgcatattttcatttcctttgtgcttttatttatatttaaaattgtatcaggaaatcattcatttaggaatagggaagtggcctgtaacatgtggtggctagaacttgcattttggtgctagaactagctggattggactgtgacacttatcaaaccactcactctaaacccttctttgtagtgttgttttaagaattagagcaagtgggccgggcactgtggctcactcctgtaatcccagcactttgagaggccgaggcaagtggattgcttgagaccaggcgttcaagaccagcctggccaacatggtgaaaccccgtctctactaaaaatacaaaaattagctgggcgtggtgacacgtgcctgtaatcccagctactcagaaggctgagacagcagaatcgcttgaacccaggaggtggaggttgcagtgagccgagatggcaccactgtactccagcctaaggctacatagtgagactctgtctcccaaaaaaaaaaaaaaaaaaaaaaagcaagtacatctaggctacttaatatagtattttgcccatagtaggtgcttagttcaatgtagttactgttattatcattttagtattattattctcagtgtttgtcttcttaactactgtatcctcagtgctgtcacagtgcctagcatctacttggtgttcaataaatatttgttgaataaatgtattcatctggcctttaaaatcctggcattagtaagatcataatgttgcataagatatggtgcttactaataagaagaagattccctgataaatagaagcatcttgccttttagaataagtaataggagctcctactgctgtaggagcagtgtgatacagtataaaggatagtaaaccaatgtttgaagctgggtgaccttgagagagttgcttaaaacctctctcagcgttaggtttttttttttttcctttccttttaatctgagcaaaggacaggccagctgatttttcacatattttccagttccaaaaatgtgtaatcgtctgaaaattgagctttgtaggtctataaactatttctatttccatgctttaaaaagaatccaggagtggtggcatgcacctgtaatcccagctacacaagaggctgaggcaggagaattgctttaacctgggaggcggaggcaaaggttgcagtgagccaagattgcgccactgcactccagcctagacgacagtgagactccgtctcaaaaaaaaaaaaaaattctcaatgttaatttttattttaaagcctaagaattagcattttaggccaggtgcggtggctcattcctgtaatcccagcactttgggaggctgaggcaggagaatcacttgaacctggtaggcagaggttacagtgagccgagatcgtgccattgcactccagcctgggcaacaagagcaaaacctcatctcaaaaaaaaaaaaaaaaaattagcatttttgtaaatataaacatatatatatgtgtgtatatatatttatatattttataaatatagatttatacatttatatattgtatatgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggcctcccaagtgctgggattacaggcatgagccaccgcacctggccatcattgtaataaatattttaatataggtttcttaggttttttcttttctgaatttttttaaagataattgctatttagtttttgaaacctttgctaagatgcctgtatttctctcatgtaaagtattttgtatgcatacaaataaatggtaatccagttcactgtatttttttttagttgagattctagtttacttatgtttcttctgaatatctttgctctcaagttcaagtttagttatccaataattgtgacttactctggttaggggtatagtagtgttgagaatctaaatgggagaagtgaatagtaaagttttgtttttaagttagaatgcaactttgtaagacttaaagaaattcaaaggaaagtgaacctgggggaatcataagcagaaagctaagaatattggtatatgggaggaatataaaatatccttattcagttataccgatgtattaaaaattatccaaaactttcagaactgatttactctgtgtttgggattgaccatttatagtcagtaactctgagtcataaaatgagaaagaaacatttagatgaagaatcagataaagaaaaatacctctaacaacataatacagatattgcaacaaggcagaacaaatttgaaattatattgaaattctagtgaagtgagaatccaaagtaatttctagtgaacaaggaatgatgaatgaaatgtagtcttataactgctgttgttattgattgaagatgtggaaaatcaatgctatttttttagaatgctattcaatttgccttattttggtaaatataacaaatattcatgtggtcaataatggtcttaatcttcattaccctatatttcttgtctttcatatgattttattccagaggtttttcaggaacctgatctttcttgtgcagaggatgtttatactgttctaatgtacagtgatagacttagcaatataaaatagaacatagagaaatttctgtccagtaaatttagagaaacaaacttgagttatggtttgtatttaaatcagaaacatctttcttttacacttaataaaacctttcacatcatatttgatatttgacttttgtttttttttttttttctttgagatggagtctcgctctgtcagcaggctggagtgcggtggcgcgatgttggctcactgcaatctccacctccccagttcgagtgattgtcctgcctcagcctccagagtagctggggctataggtgcacaccaccacgcctggctaattttttgtattttagtagagacggggtttcaccatgttggccaggatggtcttaatcttctgacctcatgatctgcccacctcggccccccaaagtgctgggattacaggcgtgagccgctgcgcccagtcgatgtttgacttttgcacctacttaaatgtaatttaagatagaaacacttagtttataataccagttattccaaatggctaaattcctgatgtttaacttgaaagattttgctataaaatggaaaatatgtgttgatatgcaatgaaataatagactacaaggaacaaatgaagagaaagataattattgtataccggctattagcaaggcacattacatacattctcttttaatttaatcttcataacaccctatgtggaaaatatcatggtaacatcagaaagttgagtccttactcactctttaccagtgatggagttaatcaatttacatgtactgtattcttacaaaattacaaatcagatattcagattattttaaggatgagaaaactgaggctcagaagtcaagtaacctatttgagatctcccagtttataaagttaagccaaactagaattccaatcttacagctcaaaatttcatgcttttcctgctattttaaagagctacaaaaatcaagctattttttattattaaaatttgactttatacctaccagcagagagagaggttttagagctttggaaggaatttaaaagatttcatgagttaggaaattcaggcctatgggttataatttacctaatttgtccagttgattgataaatggtaacaatatccaagcattattatattaacttttgcagtactttagttgtttagcagatttttctttgtaagtattttttcttaatatttaaataagtttgtatttcttgaagacacaaacagtaaaggaaagaaactgtaaagcaggtaaagtgggtataggagaaaaatatacattttaagcagattttatacaaagttatagttggacaaccaagagttgatatattgcctttgcttctgttttgcttttataaaaacaaatgaaaatcaacatcctgtctttgaaaagttatttattaggttcctactccctagcaaataagtttacatgacttctggtaaagttatttttcttctagtattagatcctttcttgaaacttgtgtatttacttttagagagattgagaatgacatgtaatgagtgcatgtcccatgcagtaaagatgggacaggaactctgaatgaaagaactgggttttctttatctagccctaggcatttaatttgtggtttcttgccccttcttcactatcttccccattataagatacagaataatgaaataggtttgacctttttgaaatcttatttcagtccctttacaaaaggggtcctgcataaaagatttctcataactagatgaatacatttactgcagttccattttaaagaatgctttggccttgaaacttaaacagattcttatgtaaattactgccattattatgaacactagtgacaatttgtttttaattaaaattaaaccgcattactaagttttcatcataaaagaggatactcataaaaatgtaaactttgagccttaaaaatgcagaggtagcactgtaaagatatgctagaatgcttagaaaatgtgttttgtcaacagctggctgacattcatttctctgtaaatatttagaacatagtattggtgtggtggtttatagaaggatttgcacctatcttctgtgacctgagtttttaatatgagatactgtatttttcaattctagggtgtccatttgctgttttttaaaatagattccagttttcttttgaaattcttcgttttttcatccagctttctactttcttttcttgaacacattaatcatagttttagagtaagttgattattcaaggccgatagccttgttagtggctaagaaaacttgcatgtcatacatatgttatttgtctcaggataatatctgtaaaaaagttcgatttacaaaaatttttcattataaaatcatgaatggccttgaaattaacaacaaatgtatgtaaaatataattgaaatgaaaccattaagattttaaagtgaaaggaagaagggtggatttagtgaagtgactgcattagtcaagaagagaaaggcataaaagtagacaagaaagagaagtaaacagattaaaatgaaacttaaaagacaaaaactgtcagagtttggcatactaggaaataaaaaaggtgaagggcagaggaggaggtgtataaagatttattatctctgttttccagctttgtttagtagatggatactagggccattcctttattcatctcagaataatatctgtaaaatatccataacatatctgtaaaaaagaaaagttcttgacaaaaattctttttttttgagacagagtctcattctgtcacccaggctggagtgcagtggcacactcttggctcactgcaacctccacctcccgggttcaagcagttttcctacctcagtctcccaagtagctggggctacaggtgcacaccaccatgcctggctaatttttgtatttttagtagagttggggtttcaccatgttggccaggctggtctcaaattcctgacctcaagtgatccatccacctccacctcccagtgttgtgattacaggtgtgagccaaacaaaaaaaaacaaaaaaattgtttttttgtgatagtattataatagttctatagcatgatgaaaagaacaggaaattgaaggccatttaatcctggtttcagatccgagctccatcatttcctagtatagatttacatttcttcacctctgtaagctttagttttcatatgtaaaaagaaagtagtccaagccgccatataggcttgttgtgcagattaagtaaggtaataaaagcaagacacaacatgggatcagacccaaagtgaggatccacaaatgctggttccttatctcttcttgtttctccagttgtgttatcatccatcagcaggtgattttcttttacccctttcttcttgttttttaaaacaattcctattttttttttttttttttgagacagggtcttactctgttgcccagggtggagtgcagtgacacgttcactgcagccttgacctcccaggctcgagtgatcctcccacctcagcttcccaagtagctgggaccacatgtgtgcagcaccatcacacctggctgatttttgtaatttttgtagacatgggttttcaccatgttgctcaggctggtctcgaacttctaggctcaagtgatccgcccttctcggtatcccaaagtgctgggatcacaggcgtgagctattgcgcccggcctttaccccttttctacctgttggtcctaagtgtctcatgcatccgtgcgaagagaccaccaaacaggctttgtgtgagcgacaaggctgtttatttcacctgggtgcaggcgggctgagtctgaaaagagagtcagcaaagggtggtgagattatcattagttcttacagattttgggataggcagtggagttaggagcaatgttttgtgggcgggggtggatctcacaaagtacattctcaagggtggggagaattacaaagaaccttcttaagggtgggggagattacaaagtacattgatcagttaaggtggggcagaaacatcacagtggtggaatgtcatcagttaaggctattttcacttcttttgtggatcttcagttgcttcaggccatcctggatgtatatgtgcaggtcacaggggatatgatgtcttagcttgggctcagaggcctgacattcctgtcttcttatattaataagaaaaataccataaaatagtgttgaagtgttggggcagcaaaaattttgggggggcgggtggtatggagacataatggacgatgtttctcagggctgctttgaacgggattaggggcggcgtgggaacctagagtgggagaggttaagttgaaggaagattttgtggtaaggggtgatattgtggggttgttagaagaaacatttgtcatatagaatgattggtgatggcctggatacagttttgtatgaattgagaaactaaacagaagttagaaggtctgaataaaagaaggagaaaaacaggtattaaaggactgagagttgggaggacccaggacatccaattagagagtgcctaagggggttcagcataattacttgcttggttggcgaatttttgggctctatccttgagttttattatgttgtcatataccaggccagattgatttacagaaaaacaacactctttatttaaaaatatacggagtcccctttttttagcagtgagtaagtcagggcctcggtgattttggagaaaaaagaaatgcaaagccagcaattgtttgttaaagaaggattagaaatggctaggagagagtgagtgcgattgatagtgtgatagagatagctggggagaggtagtgggtggcataagaacgggaacaagaataagaatgagtataaaagtaaagaataagacttcatcagggtgaaagtattggagtgtgttctgtcagcaaagatcatctatccactccaagagggaggcaagagtggtggattggggatagattttcacgatggaaaggaaatgagaggttttaagagatgggctagcggcttgtaacctacatggaagaggttatgaaatgacgacagaatagaatgggcctgtgaggctggaaggagatattttccttggtccaagaaccatttgccttgtgtaggaagacattgataggtggaagttttagtggcagagtaggtgggagtgactgacgagaaggagaaaaactggccatgaggggcagaagttggaacgctagctgcttgtttagctaccttatcagcataagcgttgccctgaacgatgagatctgacaccttttgatggcccttgcttgcagtgaatgactccagcttcctttggaagtaaagcggccttgagaagagtttttattaaagaggaattaatgatggaggacccttgcacagtgaggaaacctctttcagcccatataacagcacggtggtgcaggatatggaaggcatatttcgagtcagtatagatattgatgcgtagtccttttgcaagagtgagggctcaggttaaggcatgagttcgccttgctgagaggtagtggagaggggcagagcggtagcctcaatgatagatgtggaagatactatagcatagcctgcctttgttggtgagtggcgattaggcctggtggaactgccatcaataaactgagtgtgatcaggatggggaagaggaaagaaggaaatatggggaaatggagtgaatgtcaagtggatcagagagatacagtcatgggggtcaggtgtggtatccagaataatgtgggaggccagattgaagtccaggccagaaacagtggtaattgtgggagacccaaagagtgagtatagctgaaggagccggggagcagaaagtatatgcatcaggtgggaggaagaaaatagattttggaagttatgagaactgtagagagtgagttgagcatagtttgtgatttttagggcctctaaaagtattagagcggcggcagcctctgcacggagacatgatggccagcctaaaatagtaaggtcaagttgtttggacagaaaggctacagggcacggttccggctcttgtgtaagaattttgaccgcagagcccagtactttggctgtgtgtaatgaaaagggttgggatgagttagggagagctagcgtggtggcagcttctagggctgtttttaaggaatggaaagaggagtggcgaaaggaattaggatctatggggtcagctaggtttgctaggacagaataatgggttgtggagggaggtattgaggatagagtatatgggtttggcaccacagggtggctaggcaagacaatttggttgctaaggcacagatcctgaactaacctataagacttgtcaggtttttgacaaggtaaaatgggggaattgtaaggagagtttataggctttaaaaggccatgctgtaacaggcaagtgataacaggctttaatccttttaaatcgtgctgtgggatgggatattggcattgagcggggtaagggtgattaggttttaatgggatggtaaggggcatgtgatcggttgctagggagggagtagaggtgtcccgtacctgtgcgttaaggtggagggatacaagaggaagatgtgaaggaggctttgggttgggaagaagggtggcaatgaggtgtggctgtagcttaggaatagtcagggaagcagataatttagttaaaatgtcttgatctaataagggagctgggcaggtggggataactaaaaaggagtgcataaaagaatgttgtccaagctggcatcagagttggggagttttaagaggtttagaagcctggccatcaatacccacaacagttatgggggcaagggaaacaggtcgttgaaaataaggtaatgtggagtgggtagcctccatattaatttagaaggagacggacttaccctccactgtaagagttacccagagcgtctgtgatggtccaggaagcttctgaggcgatcgggcagcgtcggtcttcagccactaagctgagaagatctgggaagaagtcagtcagagagccttgggccagagttccaggggctctgggagtggctgccgggcgagttggacagtctgatatccagtagggtcctgtacaaatgggacacggctaaggaggaatcccgggctgcaggtcattccttggctcagtggccagatttctggcacttgaagcaagctcctggggaagaggttctggaggaacccctggcagctgcacttcaggtgtttggagttcttgtgtgctggcaatgtagctggggtttgtctcacagtggaggcaaggaactggaacttagaaatacattgctacttggctgcctctactctattattgtacaccttgaaggcgaggttaattaagtcctcttgtggggtttgagggccagaatctaatttctggagctttttttaatgttgggagtgggctggttaataaaatgtatattgagaataagacagccttctggcccctgtgggtctagggcagtaaaacgtcaaagggttgttgccaaacgggccatggactgggctgcgtttttatatttgatgaaaaagagcctaaacgctaactgatttgggagaggtcggataaagaaaaaggaacattaaccttgactatgccttcagctccagtcacctttttaagaggaaattgttgggcaggtgggggagggctagtcgcggaatgaaactgtaagccagaatgggtgtgaggggagttgataaaaagattatagggtcggggagcagaggctgaggaagaattgggacctggctcagcctgttgaggagcagcctggggaggagaggtcatatgggtctgtagaaaaggaggattcaaaggactcagagcttggtgtggagactgaaggaacagacaggagagaaagaagaaagatttgggatgagtcgcattgggagcagagactagggagggaccaatgtgtaaaagaatgcctggatgtcaggcacctcagaccatttgcccatttttcgacaaaaattatctagatcttgtaaaatggattttctggctatttagaaccattatcgagtttgtattggggtcaagcggtattgcagaagaaaataaggcatttaggttttaggtcaggtgtgagttgaaggggttttaagttcttgagaacacaggctaagggagaagaagggggaatggagggtggaaggttgcccatagtgaagaaggtaagtttaaagagaaaggtagagacacggagaagcggggtggtggggagcagccctgggctgcagtgtgggtgaggagccaaagcaggcatccccgcaattgacttgccaccatgggaatgtgggtgaatgaccaaggcaggcgtccctgcagtgatcagacaccagtgaattgtgggtgaataatcaggcaggcgtctctgcaatgattaaacaccaagggaaggctgtcttcccgagtctgtgactggcgccagagttttgggtccatggataaaatgtgtctcctttgtctctactagagaggaaaaagaactggaattggaagggcagggagattgaagggtagcgagagaggctggagaagagagtgaaaagaccgcttacccgatttgaaattggtgagatgttccttgggctggttggtctgaggaccgaggttgtatgttgatctcctcatggagtgaggcgaggacaggggactggtcttccgaaggagtccctctgacccgggtcttcagcaccaaatgtctcacgcgtcagtgtgaagagaccaccaaacaaactttgtgtgagcaagaaggctgtttatttcacctgggtgcaggcgggctgagtccaaaaagagagtcagcaaaaggtggtgggattatcattagttcttacaggttttgggataggcggtggagttaggagtggtgttttgtggcagggggtggatctaacaaagtacattctcaagggtggggagaaatacaaagaaccttcttaagggtgggggcgattacaaagcacgttgatcagttaaggtggggcagaaacaaatcacagtggtggagtatcatcagttaaggttattttcacttcttttgtggatcttcagttgcttcaggccatctggatgtatacgtgcaggtcacaggggatatgatggcttagcttgggctcagaggcctgacagtaagcactgattctttcttttgtaattacatatatttttaaaaattcctgatagccgtactttttattttatttgcatagtgaaattcctttgtcttatgaacagtttttctaatattctgtggtcagttgaaactatatttattaatttttatctcttaattttttggataatttttttttaacaataatagtgacatatttgctgcccaaattcaaggagacccttcctgcaccctgccccaacccaagcgcatttttatttgactagattattgaaaccaaaagaaccctttgagaccgagtgggatgattgcttagtggaaataggtcaggcagaagatgggtcagatggggacctcaaaacttaattttagttttttaaaatgttagtattttctgaaatggtactcagagttagtagataaccccctttaaattgtgcatgtttgtgtacatgtttctttttttctgcagagagagaatccctatctttcataattcataaccagtataacctaaacaagttaatattctctcactagcctagatcgtaaacttgatgaaattctgtttaagattagcacctattaagacactgctcagtactagaggatatttttgattcacaaaattttagcaattttttttagcgtatttctatctaaaaatattacttttaacaaatagcacatgatacttcagtgggtgttttaatatatctagattatttaaaagttaatgttcatattaaaattttaaaaggtgctttaatgtacaggaaaggaatttgtttaaaaatccttttgagaaatcatattctagttttttttttgttttttggtgaatctaggcttttcacgtagcataatactgtgatataattatttaattttctgcacatcactggaatataaaatttcatattaatccagaatgagcagaagtgaataatataatttcctcttaagttctcttatgttaaaataattcattttaaattatatatggtttctccctaataacttacagctaaagacattgttttacttaacaaattcaatttacacagatgtctaaagatgaatagcattcttatttgaaaaatataagttaaaaacaagattatgaatatattcaaaacattttagttaaaggttaattaatgcattatagatttaagagtttaaaatttaagtagggaattgaacatttgaaattttgctttcccattttgtgatggtatgaataaatccaattcaaatacattttaattataggtttaaataggtgaacttttataaatagttattagtgagtattctgtacattttattagcatatcatagcatatttttgttctaaagactgataatactattttattgggaaatattaagataaactttgttacagtttctacacttaacattttttttctttagctctcaatactctaaaatttatgagatttccattggttttattagtaatgtctagaaaaccacttctttgtaaaaccatgttttcaaacaattgattgtgattaaatgagtcattgggaattaggaaactcttaagtaaccagtggtggcaaagtaggagattaataccttaaagattttctaaatggctctttgctgtcctggaagactaatttatatctaatggcatttaatttgtttatagggaataatattaataatttattcctaagaaagttacagtatttaggaaaaattacaaaaatacataataattcaaatttgaattttcaggaaatcttagttttctattgcagtaattgagtttgtctaggtgtatgtgtgctttgctgttataagcttactttagatgcttctttggaaggtatgtcttatttgggtatgtcttatctaatattgctgattaatcattaccatattagccattttatgaattactgaggcccttttagttctctttccgttttcatgtttttcctattttcacaattctaccaaaaatctaaaagggaccaaaggcaatataaatagaagccaaaatttctattcttatgttactactacttgttgctcaacttaagtctgtttaatacctattcagtaattgaaatgatattttttaaatctcctgttaatttttactttcacaaagctgaatggctgtattaaaactagttcaccaatgagaaaaatataaccactaaggtgtggaaatgaagaaatgtgtgttttgtttttgtttttgtttttgtttttttaaagaaaaagggttatttaaagtgagctgagggagatgggtgggatccagatgcttggagctgtctacttccagaccaggttagtaacatgacgccattcacacaaaaaagttgtttttcctgcatattgtgagttggtggtcttggtccttttaattaaagataagaatacttgataaaattacatttcttgttgatcatcttttgcagaaagacggagaattacattggtaaagaaccgctaacctgtcccctcacccccagggtgtgagcagtgaaaaggattaaggcccactgtagggaagcttacactaaagcctgcactgccccttcccctgttctttcagctaaatagatttttagttcccatgactatcaatctggtgcttttcacaagcactaaattctcttaaagaaaattaaagatgacttatttttttagaaactggcctggaatactgaaagatggtgttttttggtactttgtttcatgttgacagatcccatacatatttttttctgatgcatgttaatttgcttcagcttgttttgaatttggagttgaaataaacatttaaaaaccaaggacaggttgttatatgattagatttgcttgtccacagttagcaagtgtagagttcgacactgttgaatcttacatttcattagaaatagctacctgacagccttgtggacataaactctttaacttttatctagatgactacaattataaagtgctttcttttaaaagcttttaagtagcttttataaatgctgaagtgtcattttttttagtatctgccaaattggtattgtatttaatcttgaaaatatattttgattttcttaactaacaataattgcatagtattaaacattctcagtagctcaaccttttttttttctatttaatttgagcttttgttgttactaacaaataatttgtggcacagtttctttccttttttttttaaatgactgctagaatctatatacttgtcaccttagtgtgctagaaatgttccactcaaatcaagggttcctttctggttttgtatgttctcacctgctcctcactgtaaatcattgagatgtcaagtgcaatgattaattaagctgcacgtgcaagtgctttttttttcacctgtcaagcaggaaagaagtcttatagcaaaattagatggtgctaattcacagcttttacttcagactgtgaagtgtgtagaaatattttatatttatatgcttattcagaatgtggcatatcagggcttgtttgttttctaattcttaaatattgtaagatacaattattataccaagccctatcattaaactcctaattataaacagagaagaaattcagaattcctacttaaatattttggaattcaagatttatactttgtaattatcttttattcaaatactagtagttgatttaagttaaagtaaatatttttaagttttaaaattgtgtgtatgtatgtgtctatatatcataatgagatctattcttattatagcatgggtttaaacttctgatgaaatgatggtggtaactacatttttttctttaagtaataagtatttgcagaatgtagtattaagcttttgggtactattttatacattaatataaaacagtgggcttggaaaacttgttctgctctagttctttcatcatccacccacccccaaaatcatcagtaaaagtaaaacctcaaattgtatagtaatcttaatctattattaaaaggccctagaaagaaagattacaaggtagattcaggttttgaatcggttttgccattggtttagcagcgggtgggcaggcagatgcctgctcagagtagaacctattgccatttttcaccattgatagagtagcctttcagagtcaatgagctctgtcaatgtgagcttgtcaaggctacaacttcatagacctgagaggcggtttgagaggtcagcccttttcaggttcgctgtgatgcaaatgaactttaatgcttaaacaactattggaatttttatgtctgctccttgttcttttttcttcacaaagtcattgacgagacattcagtgctttttaaattggaagttgcattgtgctaaagacctagtacagatttacggagggctgaaagcagttagatcatgttcttttcatggtgcgattagaatcaaatcgatttccctacagccttcagcattcagatggcaattttaacaaagcttgggggctagacaagggacaaaacgaccgaactgaatgttaattacactctgcagccttattttcttttgatttggggctgactggcaactaaattaacaaaaagtgtgaccataactgctgccctattttcatttaaaaggagagctgcctctaaaaggctatctttacaaagaaacaagtgaggtctgctgatcattgttaacaagggcacttttttttctttaaaattcttgccaaaaagactcttcagaaaaagtaatgtaataaattagtcattggcatattattacccagggaagtagttgattttccgatttttatgacataagcttggaaaatgtaaggcagtagtcgtaattcattggtagttatgaattataattggcatctatgtgactttggtgtgtctttagcatgtttaatatgctaaaaggtaatgtaactatttaaagtagatactttaaatacatattaaaattttattatgtaacattaaactgttcaaacccagcttgatcctaacagtttttcacctagctaatccttgcttgacacgcaaattttcatatttgattactagtacttctttataccacattaatagtggtaagatgtttttttctttctcttgcaagaaaagtgcagctgaaccaagttgcaagttgatcctggtggcaacactgtcatttttgcacctgcagctgtgtcagtctcatcctaacacctggcaccatgaattaccctcttttattcatattctcaagcaagaaacatttcatgcagcatagcatatcttgcaaaaatcaactgaagtaaattctcagttgattcctgaaacagtagtattgaattaagagtttgattttactatcagatgacacttttatgttggtttaaataaaattttggctctgttcaaaaaatctattggtagaataatcagtaagctggcttttaaatatgggcattattttaagcatgatgtgaaaattaatttgattttataactcattgatttttttaatattccaattttttgttttggaacttactgaaaggccatttgcattttgttaactaatatttacttttgttttaaaatatgtattaaggaacttccgttactatttaagtattggaaacatttttgaaagaagtgggaatttaattttatttggcagatgacattagctttttaaaccttgatagttttaaatcagaggctagtaaaaaaagattcgtatgataaaaataaaggcatatcttttttaagaaagagtactcttttgtgttcaggttaccatttagtgcttagaacatcgatagtgatgcacaccacactatactcagtcactgtcttatacctctccccttttcacagaaaaagcagctgcaaaacaaagttttctaaaaccagtcaagagtaaacttttttctcatttgtcttccagacacgaagatcgattgagaagttattagaatgggaaaacaataggttataccacaaggtgagtaccacagggagcagcttcgtactgttggggtctgaattgcacagtatggaaacagatgcttttgttgaactaaaaatatgaaaggtggacaaatgggttagtctgtgtgctgcaataaaatagagctcatttttcttcttttactttcctacttgtctagctgtgcttgcattggagactgagcaaaaggaaatgtgaaacgaataacatgatggaatatgtaagttaaagggctgttttgtgagtttctctattaaatgatcatttattttgcttctgatcttattctttccatgattattaatcagcaaaggtgtcaggagcttaatctcctgagtgcaaggattttctacggttcacagatgcatggtttcatgtgcaagactgatttataaagttatgaatgacttgaaaacaaggcttcactgtgttctgaaaaataataaattaattgccaagataaaatagcctgaacatgtgttgatggagtgtgaaattttagatgctgtataaagaataaccacaactttggttacgcagcaagtcagatatggcttttttatataatgctaatcaagtttccaagtatggaagaaaacctttcagccaagccattggagcttaagaaacctttaccctttatagattttaactgcccgtacctcagtgccctttaaagaatctcttttaaagtgttattagaatactgctttgtaaaaattaaaagtaagcaggagatgagatgttgatcatcttgtgtttacttgttaaaaaatatctaatttggcatatatatacaatgaattttagaacttactcagcatgggatttaatttactgactccatgatttacttgaacagtttttctccttttgaaaatttcagaatactctagaaaattaagaattttaattctcttttgagcttggatattttattttaaatatggccaggttattactttaaaagaaaagatctaaggaaaagttaatagttgaaaataaaactcagagcctttgtgaagtacctgttacaacatttctgaggaattttgtctattctttaaaacaatatagccatcatagatgtgtgcgtgtgtatgtgtaaaatattgattaaaacagtgtttagttgtaaattatcataaaatcatttttgtctgttagcattttcctgttctttcattatcccacagtcaaatcctatttctagccttgaacataaaaaatatttttaaaatgtcttagactagctttattcaatgaaccaaataatgtagattttatctttactacatcaaacatgttaatgtatgatgatgagaaagacacttgatacttctttataatcataacacatttgagtaactcattttgaggtgaggagactagtcttgtattttcatcttagatagagggtttatgtatatattttggggagagggatggataggagatgtaaagaatttagtgaaaaaaatatttactacatttataacacaaacactaagcttaaaactgaggtattaattttttcatgcatttctaaatttactttggaaaggaaaacataaaagttatcccaatgctatgaattccagatagaactatatgactataatttattcataaaataatttataaccttccaaaacattctgaactatatgctttgtttgtcaaataagtttccttgaatttttagataattaagcacttctgctaaagccattatattattttcactccatcatagaagatacccagaagagtagtaaagataaaataaatatttcaattgccaggaaaaagctgggtgtagtgggcatgccagtagtctagctggggaggctgaggcagcaggatcacttgcgtctaggagtacaaagacagtttgggtaacatagcaatacccacctctctttaaaaaaaaaaataataagctggggagaaaaaatgtgttctgctggattttcttagagtatatatatatatttgtgatagttgaaagtgagaataatgtagcttaaaaaatttataaaaatgaattttaaaagttaaactagcaaataaaattcattttatctaatgaatttgggcctttttaaccatgtgtccctcttttcttcaacttttctttaacttacaggaatttaattttgttaaaagaaaataattatccttgattataatttgaacattggagatactaaaaaatatatatatatatattccaccttggcactaacttttctttgttcagatatggtagagatggatgatttagaataaatgagacaagtggccagtctctatgtgtggcttctgaaggaaaaatttgtagaatatattatttaaaaactaatagttcaaatgtaggcaaagatagcctttattttatgttatgtattaaaagtgtatattataaagtgtggggatgcccatacctggggactaaaattataaagactgattgaggacatacttgaaatacaaaattatttatttaatgttgactcctaagtagtttaaacatttaattgtcaaattttaaagctgcaaagaatcttgttatctagttcaatgcttttattttatagataagaaacctgagaaacaggaaaatctagctcaaatgaagaagctagttgggagaaagtattttaacagggagctagtgaatattttgtaggcaaatcacaggtcaggagagtggcaaatgtgacagctaagccttagtgcaggatacctagagtaggacaggaatatttttgagccaggtatagaagtgtatcttctttattgaggcagatcaaaagccaggagaactgaagagtgaaaatgaagattcctggcccagacagctaatttgtagaagtattgaaatctggaggtcatatcaagcaagacacagtttctgaaaaagaatgatgagttcactagacttagaaacttttaaaatcaaataatttttaaatcaccatctatttaatacaaatttggagcaaaagaaagagttgactgtaatttaagaaaattcaaatttggaaaaattagctctggtcactttgtgtaattctgtgttaccatattttgtttttgttggttttcctttagtttcctattaaaaggccttttggaacaaattttagcctttaattttgctaacctaagaagaaatggactttttaaaaaattaagagataaaggaccttttatctaaagattacatattctggtagagtaaaatgagagcaactctagaacttagagaagactcatgtagttgggttgattaaaaaggagaaagtctaaagaaaaatgttgggtgagctgcagtcacgtagggtggtataaagggcaaggctttggagttaagacagtcttttattcaaacagtgactccacattcaattgtgatacaacttctctggatcatcagtttcctcatctgtgaaataaggattataatacttgcctcatagaaaagttgttgggtttaaagagacccaatgtagtatggaacacctggtatacagttagttctaagtaaatactagcctcttttctcatgagtgcaggggagcgtgcatgtatgcatgtttgctcctccagtgtatcaggggcactatctatatcacccttctcagactttggtgattttacttgcttatttgtcttccttttcatagagccaaggtatttcgtgtatttggtaaaggtccagaaataaaaagaaaaattctcagtgatggaactctgcattatcagataaagatctgttttagtaatgcaaagttgcgttttaaaatgtgaatggattttcaaaaaaattgtgaaagcatataattgaagttttaagaaaaaattttgtttaaatcttttaaaacctttttcttctccttttacaggtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgtttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaagtggccagccttttttattttgtcaccaaggtacacacagtcctttatttataaattccttaacagagaaaaacacctttgtaaggctcaacttacctattccagcaagcacactttttctgtcattttttctttcttttcaaatttgatattgtcattattttaaaatagtaagttttctttaatagtcttttgggacctaacataccctttctcatacaattcctaatgctctgtttatggcagataatctgtaatgttatgaagacctatcaaaaagttttaaaagtatttctgtcttcaaaggtagtaagacaggattaaatttttattagaatagacaaatcagtgaatggtatgcatgtatctagtggttactagaactcaggatcacacaatatagtagcatcacgatctgtgtatatttttgatcaagatgataataatggccttacttgggtttttatcgtttatcaaatcttacatacaaaagagtggaagtattcctttacaaaatttctaaggaaaatatttcttccaatctatcacaattatagaatggatatatgtttctgaaaagtttttgaaagaaagcaaaagttctagaactaaaagtaagctggtatttaatatcccgttgatatttagaaaagattgttaataagaaatggaggatgcatttagtactatttttatccactagttcactttcagtacagttatgtatacttgttttgattgagagtgtgacatacatgttaaatcagattagcttgtttcttttaaatatacatatacacaaatacatataattttttctcctttttgttgtgcatatctctatgcatttttaaacttttagatttgtgaatgacctatgtgtaaatttttgtttttataaaccagaaattatacaagttttaatgtgtgtcaacaacttgttccatacaactgtggtatcgagcaataatgttaataacttttggaattatataaactatgcttaataatttgtattgagaattggtaccactatacaatacttttttcctgtattaaatcttttaaataccagtttcattaatttatatacctgtatttttaaaagtatttctttgtacttgccaaagtactgtaatcctatataaatttgaatagtcaaatgccagtatctcatgtcctatatcctgtcttggatattaggagctatcttaaaaactaggatttaagatttttttttgcttgagaattatatgttttccttgccccccaagtaacaacttgaatttgtagaacacttttcctgtgaagagttcaaagtacaaagaactcaaatacttattttatttaacttgtatctagggtgtgtcctaccaccttaaagtagtgcaattaaaaataatgccatctagaaacttcagtattcctctgtggtttcagtgtgaaaaataattgtatcttcatacaacgctaaatctgcctcaggattcagaaagatcagaaaaatataatgactgtgtaaactatgcaacacagtgttccctgtataaaattgtataaatccatagagcaccatattgataagctttatgagaagaacttatctatttacataatttattctcctgttattagtctactgtggataataattttaaaattactatattcccttagggatattttaactgtaagataattttcatggttgattatattaagtatagaatctttaaaagcttttctgattttattcagccatgtgccatttgcttaaagattccctagaaacatacacttcaatgtatatatagaaaataactgtgaatacttaatatgtggtattataagccagttatgccttgggcatttagattttcatgcttggattttcattagtaacctgtagtataactgtatcctttcttgaaccatgaatttaagtgcccacattactggatagtagagatgcccatattaa

SEQ ID NO: 13147 - DNA, 20026 bp, Human
ttaacaatgcattctatgctctccacctaccattaaaacttggtttgataagacataggcaattaggatgcaaagccgactaatcacaaatttaaacctctttgcatcctgagtatgacacttcctttgaaaactagatgcctctcaaattttattaacaagacaaatataactaattacacaagccttgagcagcaaaaacttcatttcatattatagtcacctaatatgaggtatatcatgaaatagaaaagaaggcagatatttttactgttatgtcaatacaggatacgttgcaaattactacaggaatttctgggttttataaagtaacaactacggtttggttttgtccatatttttattttaacataatctagttatgtgtcttttttttaagttttcaatataaccatagatgtctagcaatcaggcatgttaatgtatgagttacgtaattccacacacaatgcaaattctgtttctttgcagaagtctttgaaagccttggagataaccagaaaatgaaggaagccctccaccactgagtttcagggcaaagggaagaaacaagataaagtagaaccgtcagtacaagtggaattattaatgacgtccaaatgcagtcattaaatactatcagacttatttattgactcctgatattaagagtgaacaaacccctggccaagtgggaacttgctcggtagcctttatctttctatcactcattcagtcaattcattaaagcctgtttgtctctcccaggtgactcttactgagtttcattgttttgtttattgtgtttgttggctcatagatctctttcacaattttcttcggcttctgaatgctctttaagtaccagttttgatcagcccatttgctttaataaacaggagagcaagatgggacagggcgatacagggagaaaagggggcaaagggaatcgcaccgggtgcttgtgctccctagaaaaaccagcaggtggtagcaacacttcgtggcaaggccccagcccagctctgtaggacccaaacaatagaccccaaatccccgtcctcggctagagaaggggttagaggtgggcggaaacacttttcctcgcggcgccccctcggttcctcaaccctgcctccaggcgccagctgagagcaccttgcaccgcccctcctcactgcagggaggttctctccggagcgcgggcgagggaggaggcacccagaggtgcagcgacttgcccaagccatgtcagagccaggcgtacagcagcgcttccccttttcaacccgactgccctgccccttggggagggtagatggagggaggttcgactcagaagccccaacgttgaccaagatccagacacgaaaagagaaaagagttcccggctagcacggcgacgctttcataccgagacgcccccctctcccgctgcctcggctccccctaccaccgcccgtactctcccagatttctcagtttgtctttccctccaccccctgcttttccttccttctctcttgctcagctcacgcccaccttagttcaaagctgagtaggagccccactgttttagttcctagagttaaagccgaagaggagggaggcgcgagggggtgtgtgcagggctctgccctgccctgaactgccacggtccgccagttgcgcttcgctccgcgggtgtccgacccaagccgagcccgagcccgagcccaggcaggagctttacagacagcctcttcccttcccacttcctgcaggcgccccacgcgtgcgatcctcccggccaagacccgcgggaggaggccgcccccttcccggcgcacaggcggggccccgggcgcgccccgcgtctcccccgcgcgccggggcggaggagcgggcgccgcgcactcaccgcctaggccgggagggcgggctcggctccccggaagaagggagtgggaaggcggccaaaggggctgaaggggcgggccgggccggcttgggaggggacgcggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaaggtgagcccgcggggttagcaggcggcgttgtgggggtcggggacagtatgcttggggacagaggaattaaggtttgcaagagtagtggggctccccagcccctaggtggcttcctgagggagtactgaggatccttcctcaaggccagagtggggttcatgaagggtgaggaaacggtcaacctggctactcccctctcactccactctgacctggcatcattgacaccgcattacccttgctgttaggatcccccagttgcgttcccagacattctcctctggctctggcttgggagtcctaatctgggagggtcctcgcagagacggagctccacgcttggaacaggattgccacccctctgactccagtggcatcactccaatccccttggagctgggaggagtcaggaggctgaccacacacctgtcccctgctccccacaaggcactgtcccccccagctccatgaccacagttaagccttggaggtggaaggaacgcttggttcctgctgcccagccatcacccccaacgtgcaaccaaattctattgcgtgctcctgccccagctccaccctcgctctgctccctccatctgggtgcttggccctgcttgccccacacccccacccaccgatcttggccgtctggcaccctctctcctcccatccctgggggagctggcatggacccagcatagcaatgttgtaatgtccctggcagcgcccatggagcggagctgctgggtctgttcccagttaacccaggccctccgcccgccaggggaacttgactgaggctctaggaggggagatgctggtcctgagctgagagaccagtgggagggagctgtgtggggctgttagtagaccacagaagctgcccaagtaaggggcattggagcattgaggcttctgagtgctgctcagtggggccacttggcttttcagagcagtgggccttttttctcaaaggaagattagcgtgggggtgtctatgtacttacctggtggcctcagaaggaggacttgtttggagtctattactccattcagggtgcaaaaagatggttggcaatgacactgagttaccagaatgctggggagcaacaggctggggtgggctgagcgtgggaaaggcaggatcctccttctgggacggctgttctgctatcactctgtcctgagcctgggccctagaccctgagttcccactctaggtagaaggaggatggcaggttctggagggtttgggaagcctcaggtttccctttctttacccactcctccccgccccccacttggctccctctcccagcccaggtgtttctgcagaagtacctcctggggccaagagcaactcacagccagactgggggtagagcaggggccgaaggtgaggaagaagggcccatggaaccactccggaaccagcactgatgtgcatcttctgccacaggaaagcaacagcccccatctacacagacagcatctgctcccgcccacctcatctcatacacattcccttacacactccaccaggtagacacacatcctcaggcactgctgacgcaggtgctactcctggcactcaggggctttcttccacaaccttccacttactcatctctcaggcacatttgcctcctgccttaacaccctcccttatgctcttttccagagccacgcatgtcccccgtcagtgcacagagtggctcattctaagtggctgtctggctagacctagacactgcctgcatcttaaaagcctcccccagctccacagcctgggagtgggaggcacatttgtctgagtcacagtgctctgggggacattctcaggggctggaggcctccagggacacaggactgtcctctgctaggtaatctacaaattggcttctccagccaaggaagcagggactagaagagccggaggacagccacctcctcactgtctgtcctggatgcctccatgaagcctgatgatgggatccttctcaaggcaggaggccagagcacgaagagatctccaaggtggagattaaaggatagaggctttggcattaaactgagcaaggattatactggaatttcctgggcatttaacagctgtggaacaggataggggacagggcctgtggtactgacccctcccacactgacctgtgtggctcacaggtgtaaggaccagcccagcaaccacaccagacataaaacctcgaaccgctttgcccttgggactgttctgtccctgctggactctgcagcctgctttgtctcactaaattgttcctgtctgggctcggtttggggccatgccctttactatgtgttcccagtggacagtcccctgggttcccctctgtcccttcatagcctcatccctttgcttgacatcgtcgaagagaagcatgcatgatgtcagcagcgggacagttggaacttcttgggagacaagcttaaagactagccagagataacaattattttggttttcttgttggcattacttcactcattcattctcagctcctactgtatttccacctctaccttcttcttatagatgaacatttcttgatattttgaaacatagaaggaaaatggcatggggagtgaataaaatgtaaacgtatgcttatttgtctaggttttacaaatatttttcttttttgtttagattttaattatgagattttacgttaattataaaaataaggtatgcttactgtaacaagaaaaataattgaattatgtgtaagacaaaattaatgcccccacctacaatccttcatttctacctcccacagtaacccattttaatggcctaatatgtcttctgcctaccttcctccaagcttatttggcttacattatttaatctttaaaaattcactttgtggattgaggtgcataaactatattaagtaagcttgatttgctcatgaaaatatcatatttagcatttaattggagcacgattaattttttaaattcttaccaatttaccaatttaatttacttttaagtcattcttttttttttttttttttttttttttttgagacagcatcttgctctgtcgccgaggctggagtgcagtggcacgatctcggctcactgcaagctctgcctcccgggttcacgccattctcctgcctcagcctccccagcagctgggactacaggcacacgccaccacgcccagctaattttttttttttttttttttgtatttttagtagaaacggggtttcaccgtgttagccaggacggtctcgatctcctgatcttgtgatccgcccaccttggcctcccaaagtgaaatatttcatttttatagcaacataactcgtaagctatgctttgtaacctatgattctacaaatctttactttttgccagtttctgaaaacaaaacacaaccttgatacctaagaaacagtcttatttttgtaaaccaaagagatgtagcaggcttgtggatctattgtctctactgtatcaaaaagatattaagtgatatatctataaaagaagctgagaacatattataaagtcatagactgcaatttttgttacctaaaactttgtctaatccgtctcgttttctccaccattgttttatgttcacatttctgctgcttctggttttatatttttaaaaccttatacacatctgaaatgtgaatatttttctaaaggagataagttcttttgcacattcttgtgttagagaatttctaaatactgaccagtttgtaagtcagaggagagaggactctcaagcaggctgtgagagaggagcaaggggcctggctttgcagaggctgcttcccatctctgtggcaggagaaatgtactggcctgtccctgggatgctctcctggaccaaatgcagaagatgctccatgcccacaaccattgaagacacctttgaaaaatcaagttctgagtcctgcttacttagcattccaggcatgtggagcagccgtgttcttgtcacttatgtttctgcctttgaaattggcttcaaaagaatctgcagtggtatgaatttgctgacagcaatttattccatatcttaataaagcttcctttttctttatttggattcctgcaacaggggtacacccatattctttttatatattaaaattaaaagtcttgaatttatctggtttgtttgataagtaagaactcacctaacttcctagtctgactcagcaacaattttttttttctgaaaaaatgtatttataaccttcagtcatctggatctgaatctaaaagaggtcctcatcaaacattagaagtatccttctgggtactttaagatcctcaaccatttctttttaatgaatatctttgttcttagtaaaatttcaaaaaattgctgaagtggtcatccacaggcagtgtctccattttcttcttttctttatgctgtttcttgatggcagaagctgagtggccttaacatccatgtttcataattgcttttgctcttttctggatcttctggagggaggccagcttcgtgttgtcattacgaggcatgctaaggctatgcaagcacgccctattgcaaccacaagtgactgtgttccttgtagttcgggtcatcaaagcaaatatcttgctattcatcttccagagtgttccatattggacagctgatactatctgcagcgcatcttttctatcttgcttggctgtctttcaaaataattcattgaaatatttccaaaatatttattgttccttcttcatgattatttgcctagttgtaagcttgagaagacacagggcttactgtttcttctttgtacagattacagaatccatccatgttctgagtgaaagaaagagactattttaaagaataacttctaggcaaatggtaaaatagccttcattgtttaaaaacctgctgctggcattttctttccctgataacagtatttctaaggactccgtgactctggtttgcttcagtgtgtcaagcacgtctccaaattaagccattgagagtttggaggggatgcacttacaacatgaattactttaggatatttattaaacagccactggtgacggtgccaaggttacagaatttaatagctatgcctgctttttacttcatgatctccccgttcctctccaaagcatttatttcatctgtgaaggatcctagtaacatttcagacatttttgcaaagaacattacttaagagcaatttgccatatggaaatgctccttacttgtctccataggctgtaaattgaactctctatttcacaaatagggttaaagatgtataaaaggtgagtttcaggggctagttggcaggtgcccactctacatcagcccacgcgtatgtagaaatggtgtatttccatgataacttcatggacagcacagcccgcagtgccagaaaaaaattagtaggaatcaaattatgattttcatatttgttgcaattaaagtttcatagtttgatttttgttttatgatagctttcaacaatcccaaggccatatatatccaggaaaaacaaatcacaacttctcttctaattggctttttttttgttttcctctcagttctatgtcttttgagcaatctgggcaacatgtctcttttttttcttcacagaaataaagggattatagtccacccaattcacagacttctgagactcagacacgaggagagatagagaaccgccaatctctagatcaacaagcaaaggaggtgccaagcctgtttgtcttcattgtgacactggaggtagctattccttctgttcatttgctcgtgagcttagtggtgtaccttctgaaggcacaggaaggttttatataagaggtagcttactacatagttctgagaagccattatgaggatatgaacactgttttgattaactttactaaacagttattatcctatagttttaaagaaaattttaatcaatgatttagttgaaagaatacacatgcaagagtttaagaatgcaaaaatttaaatggatacaattaatgagaatacaatgaaagttaagtctcccttgcactgggtctcagtccacttcctttgcctttttcacaggttttggatgctcttccatagatatccttccatacatatgtatgtgtatatatccttcttaacaaaggggagcttactttacactgttctccattgtcccactttcacttggaaatgctttttatatcagtgcatcaacagttgcccgtatttctttctaaggatgtactataattttactgtcttccaattgatggacagttagtttacagccttttctcttataaacaatttgcaattaatgtctttgttcaaacatctgtgcaaacccatacaagtatacagtacctgaaggacacattcttacaatgtagttgctggaaagatattacccaattgtcctcccaagagaatattccaatttggattcaagcagagtatgtacaagagaacctatttcccatatcttgtccaacatggtaaaaatggtgtcttaggcaactgtggctgccataacaaagtgcaatagacctagtagcttatacacaatagaaatatctttctcacagtctagatgctgggaagtccaagatcagggtgccggcatggtcagttcctggcgaagcctctcttctaggtttcagactgccctcttctttgttgtgtcctcgaatggcagaaaaagggtgagaaagccctttggggtctctttcatctgggcactaatctcatgattagtgagggctccaccctcatgacctaaaatttcctcccaaaggccccatcttctaataccatcatcttgggagttaggatttcaacatatgaatggagggggggcacaaatattccttctataacaaatggcctgttgctgtagttttaacctggtttcctttcaatgtgagcaaacaagaagcatcttttcatatgttaaagccatagggttattcttctgtaagctctaggaaaacatgcaccccttggggcacgaggatctttgttcacaaagtgtatgccagacctccatagctctgccccctccctgcactgtctcatttatcagactgaatcttcatgcctgtgttctttctgtatttattctggtcccttccctcccatcataccccacagccatcttcctgtgtccctcccgcttcactgcttcactgcccctctgaaatttctagagcatccaggtccatcgggggtggggcggtgtggtgaggattcaattcatgtgtctgtaggatgcagcagcttcttaaccagctgcctttaatgaaaatcttctaacttccaatacagggtggctgttggaggaagggaggagagtaaatgaagagaaagaactggaataaccccttgcagaaaaaaaaaaaaagggtaagattgacccagaaacaccctctgccccacttctaggaaggagagctgtgagaaatgaacacagagacagggtcacacagggagtaggcacgaacactccaagatggtcaaatgtgcaccggctcaggagaggcagtatgcaacctggcttctgtcccatggtgggtgctggggcgattggagagctgtaggaggagacacagacacggggtcagcttttggagcttgggctgtatatgaagaaacactttcttcccacctgcctcttctggtcttgtgtgtctcctcaggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaaggtaagagggaggggagacaggagaacccagacctgccatagagacccagtgaaagggggaagtgggaaagatttagaaaaggtagataagagtgaagacatcaataaagggaaaggcatggtgaggataatgaagacccacatcagatttgtcagagaaaggaccctgacggacagctgtgctcctgctggcaaagacatgggcccgggtggggcattcttttgttcccggtgggaatagagtaggggctggcagtgctggctggaggcttggccactgtgtgcccctcttatttctgggcagaggtattgctggacaccaccggagagacatctgagattggctggctcacctacccaccagggggggtgagtgccactctaattctgaacctgaatcccttggccctgcccctccctgttccctggagagtggaattcatgaaggaaaccctgggtgaggattatgggaaaaggatccctccctctagagcaccaagatttcaaggtatcctctatctgctttgcttgtcattaattttaagtctcagtggaagagatatgtccccttccctataacctctacctcgccttgcttaagcccggagcccctaaagcttctcctggcccttcctgcagtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaaggtgagagcccactcgtcttgcacttgcccgacacctcccacccacccccagcctttgggctcctctctgaacaccccaaaattcattttatctgcaaaaggtcaggaataagccatcttaggaaaggaccctgattttccctaattttatttcttaaagcactcaaacttactatcacccactcatctgaaatttctggaatcttctggagcctttcacagcaattgccttttcctaagtcttcaggcctgagaagcgatggagaccaaaaggagtttagctccagctccagggttactatggaatagagtcctttggttcccattcgcccttctgttgggagggtccctgcctcgctgggccaggtgacagggacgcaggtagaggaaggcagtggatggcagctagggagaatgactgcagcagcaggcctccgcagagggagcttatgcaataagctgggaacacccacatctggcactgggcctgtctgtaacccccactgcacctcactttctccatccatggaaatgcaattctgtcccagcaattggcagaagaaatctctgcctgagggaagagagggtggggttcagtcttggaagaaaaggagaaccagctctggggaagagaaggctgcgaggatacctgcctgctgtgtgttgggagctcagggtgggtggacagagcgagtgtgacgcccccactctcctctgcctcctcagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtgagttcctcacccagccctgcaatgggaaagagacttggagaggggccagaagtgggggtagcaggcaacactgggggctctttgcatttggagtgacttgtttttcccctattttcttggcttcctcccctccctgtccccacccccttctctccctgacccatccttccctgggcccacatcctgcctctctgggctacccccaccccacgctcttctgtctccttccctctcggccacccaccctcccctggctccttccttcctcaatcacccccactgctgccctcttggcccttggactgccatatcctccggccccccaggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaaggtgagctcttttccttggccttcaggatcccctgcctccgctcctttgagcccccttccctactcctgatctccagcctggtccacccctgccgccctcccctcaaggctgatcctgctcccagggactcctatccccataataattttccttttgcactctagtgccctctgctgtccctgtggtgcaccaggtgagccgggcatccaacagcatcacggtgtcctggccgcagcccgaccagaccaatgggaacatcctggactatcagctccgctactatgaccaggtgcgcaggaggagtgggggttccgcagtagggctggtaggagctcataggcctcacagtggggcccagaggtgaccaggtgcacaggaggaatgaggggtccgcaacagggctggcaggagctcacagtccccacagtaggggccagaggctgaatgggcaaggagaggtgcccagaagtgtgcagcactgggcatgtgtctgagagccctgtcaaccagggagggtggctgggggccttaggggcagaagcaggggcaagagggggccaggcagggagtgagtggctgttacccccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggtgagcgggggtcaagggccagatgggcaggtgaaggcccaagtgggtagtgaggagaggcccagggactgtccggccttgaaccctggccccgtgcttcccaaccagaagttctgtgggaaaggagagtgccttttgctcagcagctgacctaggggctactcggggaggtggggaattgtaggggtatgtatgcatgttgagtgtggatataggagggctgtggggatgtgtgtgtgtgttgtgtgtccctgggtgtggatgtgggagggctgtgggcgtgtgtgtgtgttgtgtgtccctgtgtgtggatgtggagggctgtggggatgtgtgtgtgtgttgtgtgtccctgtgtgtggatgtgggagggctgtgggcgtgtgtgtgtgttgtgtgtccctgtgcatggatgtgggaggtttggggcatgcgcgtgcatgttgtgtgtgcctgtggtgtgtgtgggtgcctgggcacatgaacaagcacctgtgagagacctggcccacctgtgaccctgtcggctggtcccccaggggagctgtcttcccagcttccggaaagactctccttggtgatcggctccatcctgggggctttggccttcctcctgctggcagccatcaccgtgctggcggtcgtcttccagcggtgagtccccacccctgcccaactctgcccagcaccattaactccacagccaaacctcaagtcctgccaagtctggagccccctgcagaaacctcacactggtgctcctcccgtcagccagcccctgccctgggccccacgtggagatgggcaggagggccaggctgtcgtcccccctccacagaccgactaaagagcagtctggagggtgacaagggggcagcaagggggtggaaatgggagcgtcatccccagtcaccgttttgttcctcaggaagcggcgtgggactggctacacggagcagctgcagcaatacagcagcccaggtggggatgaggagaggaaatgggtggggctggggaacacatgggtggggcacatggcaggcaaggctggatccccccaagattgggggagctccttggcacaaccttctggaggtaagtgggcatgtctggggtgcgcgggcagccctgcctttcacaacacgctcataacatactccacacccctccaggactcggggtgaagtattacatcgacccctccacctacgaggacccctgtcaggccatccgagaacttgcccgggaagtcgatcctgcttatatcaagattgaggaggtcattgggacaggtacagcagggccaaagcagggatcagagcgacggggctcccttgtgccctccgctggccagagtcccatccaaacacagcaggacgctgtgagccttgatccccaccccaacctacacctattttcccaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcagggtcagtccagcctgggtgaaggaggagggtccttgggtccaggaaagcttccaggagacgaggtcctgtatctttgcttcttaccaccccaccttccatggtctccgtccttccttcccagccattttctgattcgacaccctccccctctcatgctgttgtctgctgtgcagtatgttgaggtctccccgtctccgatcactgacctctgccccctgccccttcccctcagcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcaggtgagagcacagccttggggacacagcctggggccttgtggcatgccccagcaggtgctggggtcgggggtgagctggaatctggggtaggtacctcagccggggtgtcatagtccctgaaaggagggaggctctcctgtgtgatggggagatgaaagcctaggcgacggggtttgagggatttcagggaccgagacaaaggggatgagggaggggaggagacctgcaacaatctagaactacctcctgcccttcccccattgtggagattacacagactccagagtcagcacagctgggtacaaattcttaacactctgctctccagctctgtgaccttggacaagttcactttctctaagcttcaccttctgcttctgtgaaatggagataatatcatccaccttggagggttgttatgaggattaaatgagatgcttgatgtaaaacccttaacatatctgagcacatagtagttgctccataaacgtgactattgcttctgcttctgtgaaatggagatgatatcatccaccttagagggttgttatgaggattaaatgagatgcttgatgtaaaacccttggcatatctgagcacatagtagttgctcaataaacgtgactattactatgattattactatttgcttttgactttacccctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtgagcactgacctagacactgctgatttcccaccccgatccctcccaggttggaacattctaggacctccattctctactccgtttgtattctaagatctcatggctgttggattgccatatctttgagttccttctccactccaacctcatgctccaccagattccagcccaccctcttacccaacaaagtactcccctctactaacaaaacttcccatcatcatagtcttcctctgacccccaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggtctggagcttggggctagagcctgggaaagccagggagggtagatgcaaacctaaagaaaactgaggagaggggctaagatgaagaggagaccttgaccctgcttgcccctcccctcttaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagagtaagcagggagtggtggggtgggggcgaatgctccaggcccctggctgggggtcgtattggggatctcggagaagctggcccagatttgatcccttccctccccaccagagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaagtttggtgtggtgaggcctcagtctgcaacaaagggtgagggaggcctcaacgtaggagcagaggggtggggccggcagatggcactgcagagatgcagaagggcagctgggcagggatccgaaaacgactttattgaagatggagttggcaagacctagccccacttcccacccccagagccgttcctgtctccctcactcacacgctttccacaagctctgcacttccctgcacctgcctgggtgccctgggaagggctctctccccacttatgaccctggggtggagaccgagcgcccaagcaggctggcctgtttttaaagtgctctgacatgcagtgctcctgtcggaagggtgatgagcaggccacaggagagttcctcacgccctgccagccccgtgcttgggctgggcttcctctgccccagagctgaaggagtaatgcaggcctggagcagtgattctcaacgtacattccttggcgttcatgctactcctctttctcccctggggcctgggagatgagacctctgggtgtttggtttttgttttgtttgatgcacccaggaaaatgagagcaagttccaggaagcgaagtgagaacacgcagtcagatctgatattcccagctctccccgtcctccagacccctgttgattatcccacgcaggtctctcctcagggtcccttgccgaagcctttcccaattggcactgctgcgggaggtacttcgagacactgagggcataggaagggacaggtgggggctgaagggacagcccagctctagtttttccactgagtctttgtccaaatcctcagagccccgggtgtggaaggcctgtgcgtagcgttggatccgctgccggttgagatcttgcctgtcttccaccctgtggaatgcgggaggacttgagacacagccaggacttgaagaacagatccaagaaggatgcttgtctgttatcccctggtcctcccatccccgccattgctggccttttcccttttctgcagccatggtggatgcctgggtcactggccccttggcagctaggcctcagaaagcagcaggctctgccacagactccctggatgctttgggaagtctgagctccaaacgggaccccttcctcaccagctcaatcaacaagcatagagcctagggagcacacaggcctccacagggaacccaggagccggaagctgtctgagcagggggataccctgccgatgaggcttctcaggggacacctacccccgcatatcactcaccgcaggaaccagcggtctcccaggccatactcccgtccgcagatcccggagcgaggccacaggcagcgaggcagcttccgctccagcatcaccgtggtggccacaatctgcgtatgggaacaaaaggagaagtcagagatgaggctgggcgcagacagaggtaggggtagggcagcctttgttgaccttcttcagtgggagagagttgatagagcttgagaccaacaattctttacccaatgacccaacatccatgacgcagccaggccagaggcaggagaaagacaggaagcagaagccccattcccaggagcacaggcaccagagaaagcaaatagaaagggcttttaagggctcccagatattttgaccctacagacataaaggccacttataaatataaacatcccacttagaatatcaatatatattcctggagaaaatatttttctgagtgaaccttatttcccagcttagtttttccactccgttttctacacagcatagttaaatgccttccagtttgggaaatttccattattttgctgaaatgatttttttagataaattattttctaggtgttttttaaatgaggatttgattcatctcatggtcttctctccctatcttgaagatctggctgaagatagcttctgctactataggaagttttggtggcattacttttttaacacatcctgctttccatatcaaattttgcag

SEQ ID NO: 13148 - DNA, 11662 bp, Human
ctgaataagacttgtcctaggccaggcacagtggctcacacctgtaatcccagcaatttgggaggccgaggcaggtggatcacttgaggtcaggaatgtaagatcagcttggccaacatggtgaaaccccatctctaccaaaaatacaaaaattagccgggtatggtggcacctgcctataatccccactactcgggtggctgaggcatgagaatttcctgaacccgggaggtggaggctgcagtgagctgagatcatgccactgcactccagcctggatgagtgagattctgtctcaaaaaaaaaagattgtcctgtacattgtaggtattgcagtttcctgctagctcacagaagaacagcctcattaccttcaatagatgctcttaacccatcgtcatctgccttcctctggacactgccttttgggagtgctggagttgcatcctcaaggacagggctatgccttcaaagagccaagcaaagaacttttcctgcattttcccacacagacacttcctagattcttctgccttatgcctgccttggtcagtgtagctaggatgtgcttcaaatggaaattatgcaagtgagaaggaccaggtgtaaagacaatttaattgtgggaaaaggcttacaaaggaaggtcattgtgaccctcacaagcagtgttcttgagtggataggacataaacagggaagaaagcatgtgatcatgagaacagctgaagttctgagtgagcaatgacatgaatggtgtccaattcaaagaaaagagaaggtagatccaggagctgaataaacagacagagcaattttgagagatacatccagaaagcagaagcacacacttacactttagctctgaatcctggctaaagcaacatacagaggcggtaactcctagaactctgattttcactctgttgccagagaggctcttcctgggcagctgtgtgccatgcaaatgatagaaacaaatcccatagtattgtaagtcataggttaaggagcagatttaatttcataaggagaaataacacaatgccagtgtcagcaagagcaagtctccccatcatcccaaggagaggaattctacaacctgggtatctactggacataatgtgggctccattctcacagaaggaatcctttccactgtggttcttcctgtgtggcttacgcatgagacaagtgtaagaaagtggccatgtcaataagaaaataagccagctctttggtgccaagaagtctgatttgggggtgccagctatttataggaattgtctagaattaaaatatcaccctgccttggggattgtggggcagctggggatcttggacatctgcagtatattgcaaccacacctgaaattaagaaggactcaatgacaataaacatctttacatcacccagtgtcttgaactcacttccccatcatgtagagcagctcaggtcttctctagctcttccacctcatgatgggtagtgactgctagggaagtcctgatcatcctagccctccaagaaatgttttgaatagcattgcatcttgaactcactataatttgatcaagcaaagatgttctatgtctctggtctgaaacctgccaccacagctgtgttctctgctttcagagaccaggggagcagtgactgaagctaagactacacatagcacttcagacaggcaaattaggagggaaaagaaaactgaatctgtaaactcgggaaaaactggtgtatcttttgaggtcccagccattttgagaaactctgatgctgaaaaaataaggaagaacaatctgactcctctctcaaacgctgacattctagctgagtgttgattttttcttagaaaaacaaactttgggtcaacaaggaaagatcacgagtggggagggtgaatgggtgattcacctcatggatctccctggcagctcttgcacttccttgatcaatctgtatataagaaatgtgctgggcacctgggacaccacttctctgggacacattgccttctgttttctccagcatgcgcttgctccagctcctgttcagggccagccctgccaccctgctcctggttctctgcctgcagttgggggccaacaaagctcaggacaacacgtgagccatgcccttctcctccccacaaaaaaaattgcagggagggctcctctcccagtctggaaattacatatctctttctgagaatttctttcaacttcccagaactctagtcccaggagctcccatggatctcctgccaggttccacttcttgtcctcttaggaagccccaccaactcctctcacatttttgctgggtgtttctgcattgccagtggaaataaagctccaaatgtacctacaggctgtaattagtagttagtcttcatctaacatgctgatccacatcttgttcataatttatacctttgttcagatttctgctcagtaaactttaccttctcacaccttgcctcctagaagagaagcataacaggtctgtgaattccaatggcagcttagggcagctttggcaggactggctaaaggaccagaggccctggccactgccctgtggtctgagattgagctagactggcagcttagacattcttcctaacctgaagtctgaagatgaatatgatgacctcttgctctcacgtatactgggacctgagagcacaggttcagaagtcaacttattgagaacacatgtgtgaaggaagcagaaaaattggagcaagtaaaataaagtagaaaatggagccaagggtctgggagaaagcagcgatacccaatctagggagttttctctatagcagtagggtttataatgctgggtttctgggttgtgatcttggaggtactctctatggcatggtcagatatcctgtcctggaggaaactgttcagggttttgacaagctaatgtaatggaggcaagtgtcccaagaaaccctgcatggggacaggttcagatcccaccccattcccgccagatgacagtccacttagccctgaagggcagcaaggtattcaaataagctatgctaattaggttatcaaccatccatcctgatttgcccagaactttcctggttgtagcactgcaactctgccctcccccgccacctccacaacccattctggaaaagacctcagtcctgggtaaactgagatggttagtcactcgaactaagctggtcatcctatcaatctgaaactcatatacaaatgggagagattttgaagttgcttaggtatttatacccttttcctgtgcactgggcactacagcagttggcaccaaaaaatagaatctctctaagatgctttgccccaagaaaatggggctgtgagacactgtgggctaagaatctcaattcccttctgtcccacacaataacaaaggtccgtagccgggagtttctagggacgagaaaataactctcctggccccgaacccagtcctcattgactgaagaagaacatttgaccattttatttgtctccatttcctttccttttcagattgcagtgtatggtctaaatgtagagtagtatctaaagttcccaaacatggccatatgtccaaatttcctaaggagctaaataaatacaaattcctaaaccctacctggggaccacagaaggaggatcttcaaagatgctcctacaaatacctccagtgcattgagatgtttgctgggtttttaaaattttttattattttattttatttttccataagttactggggtacaagtggtatttggttacatgagtaagttctttagtggtgatgagattttggtgcacccatcacccgagcagtatacactgcaccatatttgtagtcttttagccctcacccctctcccactcttccccgcaagtccccaaagtccattgtatcattcttatgcttttgagtcctcaaagcttagctcccacatatcagtgagaacatacgatgtttggttttccattactgagttacttcacttagaataatagtctccaatctcatacaggtcactgcaaatgctgttaattcattccttattatggctgagtagtagtattccatcatatatatatatatatatatatatatatatatatatatatatatatatataccacagtttctttatccactcgttgattgatgggcatttgggttggttccacagttttataattgtgaattgtgctgctataaacatgtgtgtgcaagtatcttttttgaataatgacttcttttcctctgggtagatacccagtagtgggattgctggatcaaatggtggttctatttttagttctttaaggaatctccacactgttttacatagtggttgtagcagtttacattcccgtcagcagtatagaagtgtcccctgatcactgcatccacgccaacatctactgttttatgattttttgattacggccattcttgcaggagtaaggtggtatcgcattgtggttttgatttgcatttccctgatcaagaggtttgctggtttaatgtgattctgttgctagaaaattttctcctaataatgacttgagccctcctactcagtagacaaccaccagagcctgtaggatgttatcaggaagtggcatgtggtattgtacattttttctttttaaaaacttgtttttggtcaatggaagggaagaagatgctcgttcattgatgggcatttgggttggttccatgattttgcaattgtgaattgtgctactataaacatgcatgtgcaagtatcttttctaaataatgacttcttttcctctgggtagatacccagtagtgggattgctggatcaaatggtagttctacttttagttctttaaggaatcttaaagtgtcctagttgttttattaaacaaaattaaatctgtgtgaagttaccaatccaatcaacacatgaaaattccaggggattccaatgctgaacaattgatccaagccccataatttccctcccttgcccatcctgtgccccttgccctgttcatggctcccccctcactcaaagattggtctctgatcctggtgttctgattctctcttcccacaatcagtcggaagatcataataaagaattttgacattcccaagtcagtacgtccaaatgacgaagtcactgcagtgcttgcagttcaaacagaattgaaagaatgcatggtggtaagtagaggactgggggcgtgacttcaaaagataattcaactccttgattataaacataatttaatctctcactttaataatgtacagtgtacttaatgaaacattctcacttatgttatgctacttgagactcagaacaactgtgggagcttgggacagatgacttctcattttccagatgaagaagttcgaatccagagaagtctaggataaataagaaggaaaggaagaaggaataggaagtgagaaagagggaaaaagaaaaaagtgtaagagctagtagagaagcagttagagtccttccaaggtcctgagcatgtttagtttaggatggagggaggggagttctcagaagagaaagcagcaactccacaccataggttgaggtgggtgggcagaagaggacatgcaggatatgactcctcctctccagtaagcactgagcgactctactgtcctcttgccttcttctgctcctttgctctgggtcaccagaagtggactcttgttccagcctccccaccctgacaaggagctcgtaatcatctcctccttttccccacgttcagaagtccaatctctgaacaaggtcagaggttttcaaatggtaatgtgtctaaaactcactcggggatcttgttaaaattcagagtttcattcagcaggtctggggagagattagaacttctggattttaacagacgcccaaggtacaccaaggctgtgcccaaaggatcacatttttgagcagcttgggattagagcattatccctcctgtctagctgccaagggccagaagtcaaatagacttatgcagttattaatccacagtgactcttccctgggacactggttgtgtgtccttttcctagtcattgatctcagatgtcacaagcatgcaaactgcccccactacctttgttctagggccaagacccatgcatctcccatctcccctactccctccccagacccttcatgaaggacaccttctatcaggcagcacaagtatttccttacaacataagtttcctaattcaaatgagacttaaggacaatgattacatgtaaaacaacattgagaacatgaagattgctattcagtcaactgcattctagaaatatccccacacctgtaaagaaaaattcctggtcaatgagcaaagaatatcacagctgctttgtcaaatttttctattttcagtccaagaatctgagacatgtacactaatttggggtaggagcaaggctgaatcataatttttcaactctgtattttgtttatcacaaacacaggtgagaatgagaataagaacatgtacataatgtgtacataaaatttttgtgaaaatggtggtttctggtggtaatagttaatggtagtggtaggtataataagatatgtttgaatcaataaaattacatgtgacataattttgtgcttttgtgattaataaaagtatgcttttaagaatcatgctagtactctaaaataaagcaatcttttcaaaacccacctaagcacaactaaaagaataagaaatctttagactaactgactttgcaaactagaaataatttacaggaaaggaaattttgttaattctagtcaacaaatttttatttgtggcttcatttttcaaagtataactatttttaaatttttattaaaatatatttatataactataaaattcttaccatctaatcctcattttttatcatttataatgttttctgtaactgaatttttgaaaaagtgaggtttagactcatatttatttattttagaattagaatagaatatacctacaatcgtatatttgaatataaagattgcataatcctttaaagctgaaggaaacttgtggcaaaaacaatgcttaaacatttttgtgctacaggccatttcgttggtttcatgaagtttatgaaacatttatcagaaaattgcttctaaatgtataaagtgcattggattacagagagaaactaccacattgagtaacagtgactaacttgtaaaaaataaatttgtgatgcagtaaggtatgtgtttctttatgcacacattagctgggaaagcaatacatttaaaatatagaagagttgaattttattctatgaacacattatctgtgtgatggatgttgttacttagcttgaagaagtacattaaactgcactggtctttggcaacacgtcccacgtgccatgctaggcatgcaacggattctgatcttttattgtacaagtggtgtaaattctgattcatgacgatatgttgttgctaatgtaacagaaaggtaaacaaggccgggcacagtggcttgtgcctgtaatcccagcactttgggaggccaaagtgggcagatcacctgaggtcaggagttcgagaccagcttggccaacatggtgaaaccctgtctctactaaaaatacaaaaattagccagggctggtagcacgcacctgtaatcccagctactcaggaggctgaggcagaagaatcacttgaacctgggaggcggaggttgcagtgagccacgttcgcaccattgcactccagcctgggcaacagagtgagactctgtctcttagaaaaaaaaaaaaaagggaaacaaggcacaggtagtcttctccaaagaaacgccaggattctccaaggcattctgagtaaaactccaagggtgagaacacctgaatttactgtttaggtctgaacggctacttgatgctgagttgccaggtagctgagcaagctgcaggaggtgggcagaatggcactgggcctcagtcgtgaccatgagccagtctgataactgccatacattcaaggtagtacattcaggctgtatttcggacctctggatccgtgcaatgatatgtacatatctacttttctccttgtgataaaatcacacatactgctaatggcactgtggttccttgatgacattcataacagaaggaatgctgaatttcaattagaggttagtaataaagatgcatatttttcccctgcctgagtccacagactcactgaatgctatccacagatccctctgggtctatggaccccaggataaaactgctgtgttaaacgttaactggacaaaatcctctgactccactgaaatttatatatacaataatctgggatcttgaattgcaaagcactcaagttaaaaagaaatttacattcaagatgttatttgcttatctaacagccaggtttggtagttaattgtttccacctcatacctgaggaaagtgagagtgagaggcctctcatcaccaaaggtcaccaagtcagagaggagcacagatggggcttggtcacagctctgacaacaaggcctgacattggctcctacacgcaagtggccaggctgctgtctcaccaggtctcagagtaaacgtgattgcaggtcgattcctgaaacctctggctggtgactaaggcaagcctgctcctcagctggacagctgccctggatgagctctccttgccctgtggattcacttgcatccctatctcctcctgagcttctccacactgctaaggcaggagtttgagggcattggaagggaaaaccttctgacctagactttggctcctgaaatgatactacaacagtagactcccccttgccctaggcccacctccacccccactcttctcctccggcttttccctctcctatttttccctcccttacccattccccaaaataacaatgaattccccctcccaccttctcctcaccaggttaaaacttacctcattagcagcatccctctacaaggtgcatttaactataagtatactgcctgcctatgtgacgacaatccaaaaaccttctactgggacttttacaccaacagtaagtacagaagttgtccaaggagggaactacccaccagccaccagggaggagaaactataaacagaaacatggctgcgaaccgagcaggaccaggacctcagggcagaaggacagaagggagggagggaagagcatggggagagcagatggggaaagcacccaggttctaagacagaggcattgagtgcaaaaagttgatacaggagacaaatttgcaaaggatttggggaaactgaaccccagggggcagatgcctgatatgagtagaaaagacaggacatggccggggtgtctgagagatgatctccgtccctgtctttttcaggaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttctccatgttctgttgtatctccaaaatctgctcctgaagaaccccagattacctgaaatttctagaacatttgtctttcaaagaacctttactgaggagattgtacgggttctcactgcccattggtatgaagagggagagaagaagaaactgggaagaggagctatgctcacagagaggaaaagcagtggccctaaagttcacggcacaggagtggcagagccagggcaggcaccaagcctccctgttgcttgacctctctccatcccactgccctccagcaacagctcagatcccagaagacaggagtcctgttgcatgcagcagagtcagggatggagtccatggccccctaaatgagcagtagcattctatgctattctgttgcttgttttcaatggattgtgacactcagggatatcagggtcctgtgcagctctgcctgaggagctcaggcataatagaggagtaaaggggcagagggagccctgaggggcttcatcccagagggccagcccatagaagtggaatatgagcaaggatcaggtgcacgaagtgggcagagggcattctagtagataggacgcaggcaccaagagcccaaagcatgaaatagtggcttgctcagggcaggtaaacactttcatattgggcaggattaagtatacatggaagagttagaagcagatctggcaagaggacaggagcaaaatcaggagaggccgagtgaatctgggcaagaaagtgggaccatatcccctaggccagtgatcctaaatgagaatcaaaatccagggcggaaaatacagtcattggaaaagatcattttttatattaattaggattgtaacattgtgaaacaggagagttacctgacctccctcgcagaacatgcaacaggggtgtcactcatctgttcagctgctcaaaccccttagaggaggaggagcacgcagacggacaggtgcaggagggcaagtgggagtgtgttaaaatgcgctcttttagccttgctgtctacggacagtttaagtgttaaccagctcagtggaccctctgcctttttgcaaaggcagagggctactgtgacagctttctgcatcccaagttcttgtccagcatcccggaagaattgggtcacacatgaactggaaggatggtgaatgcagggttttattgggtggtggaggtggctctcagtgggatggatggggagccggccagggaatggagtaggaagatgatcttcccctggagtttggctgtccagtggctgattctccgtccatccccagccgaactcctccttacattcagacactccttcccttctctccttctctgctgcgctattctgccatttgtctcctcatctgctcatctccttctggagcctggggttcagggtttatatggataccagatgggggcatggcgggccaaaaggcaattttttaggcgcaaaaacaggaatgcctgttctcatttagggccgcaggtttccaggtttgagggtggggcctttgccagggaacagccctcttctacccagtatttctctgtctcctgtccatatcaattgattatatgcttaacaggtaccaaaaatgtgaataattttatttacatgctttatcacatgccctatttaaaacaataacagacattaaatatttattcactcaataaatatttatcaagtacctacatgtgccattacctgctttcagcacttggttttacataagtaaatcaggaattttttatcctgttcttaaaatgcttatattgttcccaggcaatagaaaataaacatgtacatgttattcttacctttatttatgggaaaactgagataagagaaggtaattaatttgcacatagccagcaagtgacagagccaagattcgaaccacacaggtagcctggagagacatgctcctaacttctttttatttttgtttttttttttttttttgagacggagtcttgcactgtcac

SEQ ID NO: 13149 - DNA, 20237 bp, Human
  misc_feature (1)...(20237): n = A,T,C or G
agggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccacgcccgtctccgtgaagttatcgccataggccggccagggggcgcgagaggcaccggggtgatttccgcgggaatcgataaccaatcggattcccaggccgaacggagcacacccgcccgccctcgctctttccccgccctttgccccgccccgctccttcccctccttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggtaagtagggaacggtcttagggctccttaggggagcccagggaaggggagcgtggcccccaggcgtgcggccctgcagccccctcccctcggagccccggaaagcagccgtgtccgcgcttcctgccaagggtgggacgcccgcccgagccgctccgagcctgactccgcgcaagggcccgcgggcggacctcttggccttgtctctcgtgggaaaagactgccccagcctccctttgttcaacccacgagggttctaaaggggaggtctttgcagtcctgcccgctcttgggttctcttgaagattcttcatcctttcctctggctcccttatgagggaaactataaaaagaccatactctgtctccttaaaaatcgacgagaccttctgcagacctcggtgctctgcctgatgtgcatttgatttgtatcgattgtatcatgatctgcatggctttgcatagaatgaccagattttcaaagaagtcaatacagggtttggaaattgagtacttttggcagaacaagggggttcctgtggctccgagtgtccatgcctctgccccggtcattccatttcatggcagtcatcacccaggagaacattgtaatgcctcctgctcgagactgaagattaaggtcttcgcaaagggaacctgcagaaggacacagaattaagacgtaggaactccgtggtgcccttcgcccctcctccccttccagttgtgtcctgaaattctaaatgattggaaacttttataatgttcacgtttaagactctcatactacagagtagaggaaggagcgggtgtgcagagggggtgatgcttcagattaaaactaaagagttgattgaaaattcaagtctggaactcgagagagttaagaactataagtcagtaagttgcaagtatgggtgagattgtctagggaaaggctctttgaaggggcgtccctaatggaatatcaatattaagggcaggccaaaggccctctaaagaaaacaggaactgggtaggcagagagaagactcccaaagaatgctgtcatggaaaccagaggaagagaacgatttaaggagcgaatactactggtaaactaatggaagaaatctgctgcaccactggttagtatcccagctgcagtgttatatgtgatcgttattactgctttgacgtattcgaaagtgattcattcttaaataggtttttttatttgtatagctctttttcttgtagccagtttttcctgaaagtcttgggtaatggaaatattacagtaaaaagaagaaaaaatggagtttcagactcatttttccaaacctcagattcattggctgcttccaacccacttcatctgttttaggatcccacctgctatcttagttctcccagttcttccaggacccagctcttccctcttctaactataaatctctcacccaatagcatctgcaagccaagtgcatccattccatagatgtgtggtatttcactgactctaagatacacattttttccctccctttttttttttttttttttttttggacggagtctttgctgtgtcacccaggctggagtgcagtggaatgatctcagctcactgcaacctccatctccaaggttcaagcgattctcctgtctcagcctcccgagtagctaggactacaggcatgcagcaccacactcggctaattttttgtatttttagtagagacagggtttcaccatgttggccaggctggtcttgaactcctgacctcaggtgatctgcccaccttagcctcccaaagtgcagggattacaggcatgagccaccgtgcccggcctcccctcatgttttaacaccttagaaatcagaatgcattttagagtaggtttttaagttataaatggaagttattgtattttcactgctatcaggtgccacccttcctgctgttacatatgtggaaaatgtgacggggcaggctagagaactctggatttatgtaaactaggcatgtagatgacatattggcaataggattattttagtttataagcagaagctgatctctttgcaagcctgtagcaaaattagctggaggtgacagcacatgcctgtagtcccaactacttgggaggctgaggcaggtggatcgcttgagtccaggagttctgggctatagtgtgctatgccagtcacgtgtccacattaagttcagcatcagtgtggtgatgtcctgggagtcagggtccaccaggttgcctaaggaagggtgaacccgcccaggtcaaaaatggagcaagtcaaaactcctgtgctgctctgtaatgggatcatacctgtgaatagccactgcactccagcctgggtggcacagtgagactcttttaaagtaaatagataaatacctatccactgtgactttctgtcatactttctgcttatccacatcttaacaggattcgccattttgtcactggaacttaaaagttttaaaaaacatgtaattatatgtttatatcactagtgaaagagagttagtgtctgcctcatttattttctgttaaagccattggcttgagtttttaccatagtgttttaaccctcatctaagatcattataaacttacatcactttcaccagcttagataatgtgagatgttttctgaaataattctctttattaaaattggtctatcagagaagtattccttctcataaatatgtgtacttgggggtattgttttgcttaagacagatatttccctcctctagtcagaccattcatctcagatgatctcagctgaacataaaccataaggaattagacattattttcttatgatcaatgtgttcctgcttagtacatctttgctttaaccagatttaagaaatatgcataatcttggttattgtaagtcttattctttttgttcttcctattcatgcctcttccactccactcttctgtgtcaaattgtgacttgacagcctttccttctaccgtttatctgtaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggtatctggaggcaaaagagagaagataaattgatcatggggtgggaatagagcatgacaaaatatggaaagggtgtcgtatctttcttcctttttttttttttttttttttgagacagagtctctgtctcccaggctggagtacaatggcgcgatcttggctcactgcagcctctgcctcccaggttcaagtgattctcctgcctcagcctcccaagtagctgggactacaggcaggtgccaccatgcctggctaattttttggatttttagtagagacagggtttcactgtgttagccaggagggtgtcgatctcctgacctcatgatccacctgcctcggcctcccaaagtgctgggattacaggtgtgagccaccacacccagctggatgttgtacctttctaaagaaatggaaatgcccttctaccgtagagcatttgagagaaatgatatataactcaagaataacagaaaggacttcacccatacatacacttttcctgtaaaaagaattcttggatgaggacactactaggaagctcatgtggagaaatagaattatagctagagaagtaaatatgatttcatgttttattcttgtgtcttaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccggtatgaagctttagtaatatggggtgttgggaagggttagtttgactggaaaggaatttgtaagtcagagtgagggagactagattttgttgtatttggaccggaccacttccctaaggtctgtcatcatgagttttgatttcttacagttgagctgtgactacgacttgagtctcccttttccggtgtgtgagtcctgtcccctttacaagaagctccgcctgtcgacaggtgagaattgatggactaaaaggggtcccaggccaggtgccacggcttacgcctataatcccagcactttgcggggccaaggcgggtggatcacctgaggtcaggagttcgagaccagcctggccaacatggtgaaaccccgtctctactaaaaatataaaaactagctgggcatggtggtgggtgcctgtaatcccagctactcgggaagctggggcaggagaattgctagaacccaggagacggaggttgcagtgagccaacacggtgccaccgcactccagccttgccaacagagtgagactcagtctcaaaaaataaaataaaataaaataaaaaggaggggggtgtcccagattgacttcccctttcttgtctggtatctggctttgtcctaacatgagcccttttttttgtttttttttttttttgttgtgttttttttcagaaatagggtcttgttctgtcacccaggctggaatgcagtgacaccaccatagctcactgcagcgttgaactcctgggttgaagggctcctcctgcctcagcctcccaagtacctgggattacaggtgcatgccaccacacctagctcatttttaaattttttgtagagaaggagtctcactttgttacccaggctggtgtcaaacttctggcctcaaatgatccttccgccttggcctcccaaagtgctgggattataggcgtaagccaccatgcccagctgagacatagtttatattgggaacagttgtcagtaaatttgttaagggctagtaggacagtttatgcaggagtttgtggttttttgttttttttttttcttgtgatggagtcttgctctgtcgtccaggctgtagtgcaatggtgcagtctcggctcactgcaaactctgcctcctgggttcaagtgattctcctgcctcagcctcctgagtagctaggattacaggtgcgtgccaccatacccagctaattttttgtgtttttagtaagagatggggtttcaccatctcctgacctcgtgatctgcctgcctcggcctcccaaagtgttgggattacaggcatgagtcactgcgcccggcccaggcaaggtgttattaatagttggtccatttcccttccaccccagataacagtttttgtgataattgggcctttgagtagcatgtatgggcaggaagttcatgctcaattggcctctaaaaagctgaataagaaaagactacatttggggccaccagcctgctgatggagcatcctagtgattggaacgaggcttttatcagctagcccattcggtcattcagccagttgagcatatgcttcatgcaggctatgtgcagagaatcctttagtgagctaaaactaagagtctctgccctcatgaagcttacaggtttgggtagtgagtgagaccaatatttatcacaacccagttgcaagagatgtctgaagttacaatgacatattaagattgatggttaagttatatactagttttttggttttctgtctataccacagatactgtggaacactccctagacaataaagatggtcctgtctgccttcaggtgaagccttgcactcctgaattttatcaaacacacttccagctggtgagtttttgcataatgacaagaggaagagagttgggaaattagacacccttcctgggaacctgaacttagtttgcatgtacatttcctttctgccttattagtcagaaagttgttactggttaaatgccttctgtgagcatttgtctatttttacctgctggaggttaagaagaaaaatacgatgtctttgttttcttgaaatgtctaatctagccgaggaatcatctgttatcaagacgctcatggtctaactggcctctcctccacaggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggtacctgaggtgggaaaaattgacatgtaaattagaggactgaacaacactttgggaccagagacatcgtttgttcctgtgcctgctgggatatgtcttaaaagttggtttattctacttacatttttactcactctgttctgcctctcaccttgcattctagtaagaaagaattagggccggccagccattttagtgttgacatctcaggttgtggtttcataaagtaataatagtccacagttggtgtctcacttttttttttttttttaaagacagagtttagctctgtcacccaggctggagtgcaatggcacgatctcggctcactgcaacctctgcctaccaggttcaagcgattctcctgcctcagcttcctgagtagctggaactgcaggcgcatgcaaccatacctggcttattgttgtatttttagtagagacggggttttgccatgttggccaggctggtctcaaactcctgacctcaggtgatccgtccccctcggcctcccaaagtgctgggattataggcatgagctacggcacctggctgggaaagtattcttaacatttgtgtaatcacaagtcatagggtagattgtttgtggaccagatttctagaaattgtaaacattttcattatgggctgttcgtcattaacctcagttactgtactgcacaactgactttgtgacctttagggtttctattttgcaatcaataatggcctatttgtagattcatattcactctttattttgattccagaatagtagaactttcttcaacttgctttgaggttgtcagtggtgaaattaaaattgctaggagattcactttgatctgttgggatagaggatctttgttttccattcagcattgtctgtagtcttcatttctctttcttagctgccctccttctgtgagagtaattatgtatttactatatttttggcaaggccagtttcatccacaggtacctgggtgttgtcctttacatgctatttttgccagcttcccccttgtagcatatgcaatgtagttaaatccacccttgcttcaaagccatggcagcaacagctgcttcagtcatcaagtattcaggtagtttatatgctttcctgagaagtctgctgggcataaaggggcaaagggcagggtaccagccataattcctacagaaggtcacttaacaaaatgtgcagtgtgtgtgttttcttagaggttttggtctagccatgtcttttactagaaatctattatgtcatggtttttcaagttgtatgcagctgataaaggatcttacatgtctaatagttaaagataaaatactgagtcactaagtcaactatatatactgctgttttctcagagactgtcagatttggtgagtttatgagctcacttcataaatagcatttccatttatggtaagcctgatgcatattcagtgacctattggattctaattctttggttgaattgctctgtaactggaattgcagtagagttgaacttcaagcaccttataatgggggactatgtgagctgccacagattttaaagatcagatgagggagttttgacatcagcataaaaggaagtgtgtcctcttatattcctaacgaccaaacaagattagagaaaaaatcttctgtcatagctaagaagaagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaaaaaaaaaaaaagatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtcacaaactgctttgaaaatgtaaggacaagctatgggttatccctggaaaatgcagctgcccatataatttagcatataatttcagagggttcacaagttactctcttcacatgtcccccaacccctagccaaaaatacacttaggagttaagaaccctgctatttatagaagtactgtaattttatcaaaaacaaatctgcagatcctattttaagctatgctacttgtagaaaaattcctccaaatgtctaatccccatttattgaatggtttagtcttactaagtttggttacaaagtgcgtgtattctttttttggacattgttttctatttactgacctaatctcactaaattcaaaatgctcgtgattcggtgcccaggtatataatttttgttttctttttttttattttgagatggagtttcacttttgttgcccaggctagagtgcaatggcgcgatctgggctcattgcaacctctgcctcccaggttcaagcaattctcctgtctcagcctcctgagtagctgggattacaggcgcatgccaccacgcccggctaatttttgtatttttagtagagacagggtttcatcacattggtcaggctggtctcaaactcctgacctcaggtgatccacccgcctcggcctcccgaagtgctgggattacaggcgtgagccaccgcgcccggcctttgttttcttctttgagcaaaattaacttctttaactattaaatgttaaattctattagcatcagctccagaggaacattcacagttatgtattctcttgaaattatatattcttgaaagaattttttgattatctgtcattaccttaagatttctattattatggtttgcttctacttagaaaatacagatacttttcaacaacaccagtctctttatttctagttatattgcagactttcaaatattttatgtaattgcatctcaattatctacaaacagaagtattccgaacagatcaattagtagctctcaaactttaacatatcacagtgtcctggagggcttgttaaaacacattttgctggagcccaagatttcacgtttcttccaagttcctgggtgatgctgctgttgctgctttaggggccactctgagaactactgcaatatgttatattatagaagtgtgctttttattttggcagtgtgtgtgattaaatatatgtgtgttttaactcttccacccagataacttacttattttcattacattttattcaagtttataataaaatgaacttgttttctttctgcccatctcagaagacccagacatcgtgaattatagagggaggcataggtttaaacatgtgtgcccaattattatgctctttaggtacacagtataaccttctgatggatggaccaaatgcttaaggtagtgctcttcatgtatcgcaacttagtgcaagataaacaagattctccaggcatggtggcacatgcctatggtcccagctactctagaggctgaggcaagaagattccttgagcccaggagttctaggctgtagtgtgctatgctgatcaggtgtccaaactaagttcatcatcaatatggtaacctcctgggagtggcggaccaccaggttgcctaaggaggggtgtaccagcccaggtcagaaatggagcaggtgaaaactcctgtgctgatcagtagtgatcttacacctgtaaatagtcactgcactcaagcctgggcaatatagcaagatcctgtctaaaaaaaaaaaagataaacaggaaaacagttcttaagttggactacaacattgaccagtaatagatttctttgagaaaaatactctttattcgacatgcacattgtaatggcacattttttgcaatgtgtcccagacacagtgatcggtttttggttttttttttgagacagggtctctctctgtcacccaggctacagtgcagtggtgcagtcacagctcactgcagcctcaacttcctaggctccagtgatccctccaccgtagcctttagagtagctgggactataagcatgcaccaccatgcctggctaatttttttttttaaagatggagtcttgctaggttgtccaggccaagtcctttgtcataatatctcatttttatcttcacaaacttagagaaaatatcctcataatttttttttataaagtgaaaagtgaggtctcaagggtctgagtaagctgttccaactcatgaagccaaggttcaaacctagattaatctgaacccaggacctgtgtatgtaattactgccctgtacagaatcctccttcatagcgtgctctttctgaaacaaagcattttatacagtcatcatcattatctcttggacacttagaatcttagaagacaacatacaagtattgctattctctactatcatgatgctgtcacagaacagtttattttcgtgtagctgaatgtgcatgttacttattcatagctacactttgagtcacccttgtgccatttatatacaagggcagttgctctaatgaaggatctggttatgaacagggaattaatcagagttgaccagctcatgattagcttctttagtaacttgctttaatccaggagctgtttgcctatctcagtgagtctgaatctgtattcagaatattgtgtctgaactcatatgcatttttctggtgagtccatagctttctttagtctctcaaaaggtctcttcttttatcattgaccacaggaatatacataaagcgttttatcttctaatagcttagggtttcaaaaagaaaccaaactttgatgcttatgttggtgctgaccttagtgcacaacactaaacattcctttcttttaggaaatgcaagagaaactgcagaattttgcacagttacctgcacaccgagtcacggactcctgcatcgtggcactcctctcgcatggtgtggagggcgccatctatggtgtggatgggaaactgctccaggtgcggataccctggtggaagccaactgttgaaaccaggctgctttacctcctgcctgctgtctgtcaagtgatggctactgttgcatgtgtaggacttaggaggccccgctgaatgcttaacctctcttcttccttctttctttctggcagctccaagaggtttttcagctctttgacaacgccaactgcccaagcctacagaacaaaccaaaaatgttcttcatccaggcctgccgtggaggtgagtgccctagcagaccagcacctgggtggtggctcctgggcagcctcccaccagctctcactttcctgtttgctcctctcaggtgctattggatcccttgggcacctccttctgttcactgctgccaccgcctctcttgctctgtaagtgtctcccaatgcatggggtgtgctgggacttgggcagcccatggctctcaggctggtcagctctccgtgcaccaccatatcctgttttcaggtctcttatcccgtgtctttgccttcctttctgagaactcttactcttttctgtgcttcattaactctggtgccctttttttggttactcattccagttacggatttttgatctgtctttttcctgtccttcttattttatctcctttctttcactctttgttcttttcacttgttccatatacttccctgtttacctacacttccatgcttgcctcctttcttcttacttcttaccattcttgggtcatgcaggatagcagaacagaatccgtgttggcctttgactcttccttttccgtgagctgctgctgcccctctttctctcatgcagtctgttttactcctttaagagccaggactgcaggacgaggattaaaagacacataggtgtgcttctcatcctggaggaaaataatagtaattaagagccctaactttggagtcaaattctgacttcaccatttactagtaacgtgaagttaaagaagttaaatggcatccctccatctcagtttcctcaatataaaatgaaaatagtccttgtacctacttcataaggtgcttgtgatggttaaatgagattatgcatttaagggcttacatagctcagtacctggctcacagcacatccacaaaatatgccagctgtaactcttaaaacacgatcagtgccgtaaagggcttatagtttgctttaaaggtcactttgtccaaacattcaaataattacttttttaatctctcatgtggccaaatgtaaatagctaatattattgtcatcctgatctagtattaccgcagaatatagtctgctgaggccctgcaacatgactcagactacggcagttactaccgcaaaagcagaaggaaatgtggcctctctaaggagcagaccagttactcaggaaaataaagtaaatatacatgaagtagcttaagactagttcacaggcctcatgtaagcaaaggtgaaattagcaaggtacaaactgtacttaggaaggagtatgcagtaagagtagatcattttaagtgagggtagtttaaagagattttttagataagataaggcttaatttgtacctggagtaatttgatttacatagttatagagtagtatctagagtctgtcgtaggaaagaaacaatacaatatgataagtacactgagaggcagagggcatgttgtgtctcccctcctcccaaacagatgctcggatctgattttaaaatagcatctgtgtgagtatgtgagatgtggctggtcacaatgaagtgggttcacctccttacaaacctttagtcataactgaggttttggacatcagcaggtaaaagtaaggaacagttgggagcttaagtaagaaataatgtgatgaattgtttttccagcaaggttgccatggagggggctgcactaaggaaagaggttatgggtcagcaactttacttttcattccctgctctatccccaggcccagggcactgcctgatgcatggtagcacttataaatgttcaatgaatggatgaaaattaatctgcctgaaaaactgtaggtattatgtaaaaaacaaatatgaggatattgtgacaaaagaaccagtgacatttattgattgatggatctgtgatataaaggtgagagaggaattctcctttctctttagcttggcctgtttcctttaggcgtctttactaacaaaacgacgttaaattgtgattttctcatcctatatccagggatttaatacactattggatctggataaggagtaattgctcttttctggagtaatctggatcttttgctctgtctctctaacttttctgaaattaaatccttcaaggaatgaccagtagccaattgttccattgaaaatttgagttcacctgtcttcctgctgtatttggttaatataattaatgtctagaaaaagctccacccccctgccccagtcagcttctaaactggagtgtaagctccatgacggcaggaattttctcttcactctatccctaggccttaaagtaagacagtgcccaacacatggcagttgcttgacacatttttattaaacctgtgctttggtccttttcccccaattcttgaagcttcccttctttcctaggctccctcgacattgcatggatcaggaagtactgtaaaagagcatactcttacttttgatgtgttgacctgagagtcctccccatctgtcttgcctactgacagcacccctgcccacacccaaaataaaacaacatcatcaaaaataagagtctgtcttgggatacataaggcttgtatcaagagcaaggatctgctcagggtatgttgagaaattactgctaaaattgaataaggatgatctttttaaattttctgggagaaaacagtcaagttctccccactttaagtttttcctcttaaaattttcataaggccaggtgcagtgactcatgcctataatcccaacactttgggaggccgaggcagaaggatcacttgaagccaggagttcaagacaagcctggtcaacgtagcaagaccccatctctattaaaaaaagaaaaaaaaagatttaaaaagttattttaaaaaataaattaaaaattttttttcttaaatcttggatgcttgctataatttatcttatgaaattaataaacatagtgcttcgaagatatcaaaaccaccttggaaacaactgatcatacttagttttattattttttgatacatagttcgaggttgtgatttttatatagcatacatatggtaaccgtatttgttatttattaccttgttttttcttgtttatgtaattaaatatatcaatattttattatgtattgcaataaaaagcactgtgactcccaggcatattgttaattgaacaagtgagttgtggacttagatgattttcagttccatttacaaggagtatttgatttggcattttccctgtcttacacagaatgggaactgctccaaccgcatagatgtgcatgtgcttgagcgtggtgcccggtgtgtatgaggcatcccctgagtaacagatgcatgctgagagagtaataattttttttttttttttttagtttatcagccataggttggaggcaacagctggaaatggctcttccccttcaaggttgtagggaacgtgggcttgcctgtgacaggcccaagagagataggaagaagtaacatcattgtccattctgtctgcctttgttacagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaaggtactttgagttccaaaagagttgagtcatacctcattttgttgcactttgctttattgtgctttgcaggtacaggttgagtatcccttatctgaagtgttggaaccagaagtgtttcagattttggatttttttgtttttttggattttggaatatttgcgttatacttactagttgagtatcccgtatccaaatattctaaatttaaaacactcccatgagcaccttctttgagcatcatattggcacttggaaagtttcagattttgaagcatttcagattttttggatttgggatgctcagctgctttttacaaattgaaggtttgtggcaatcctttgagcatctgtcagcaccatttttctattggcatgcctctgttagcatttttcagcaataaagtatgttttaattacagcatatgcatgttttagacataatgttgttgcacacttaatagactgtaggatagtaaccataacttccgtatacactgggagacctgaaaatttgtatgacttgctttattgccatattcactttcttaagctggtctggaaacagacctacggtatctccaaagtatgccaataatccaaaagagtaccctcctagacttagattcttcatgctgggttctctgactagggagggtgcaggtgtcatggccgagtctagtttgggaagtgcagctgtgtgatggcattcacactgtgattaatgcccttttggttgcagggactgccgccatgcggaacaccaaacgaggttcctggtacatcgaggctcttgctcaagtgttttctgagcgggcttgtgatatgcacgtggccgacatgctggttaaggtgagccagcgggctccgtgacccctgtgtgtctccacagtgctctactttcctcctctcttgaatgctctttcatagtccgtctccccttcccgtttgctgctctcctgaagcccgagattctcagacttgggcctattggttctgcccctccaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatgggcttgatctcctgacctcatgatccacccacctcagnnnnnnnnnnnnnnnnnnnngcatcaaatcaaccggcaattcatacccagatttcaagaagaagcttcctaggggaaaagcctgcgaaaaatagaagccttgtaaacataatacaagcctgtggataccgcccacaaagctgtacagaatgcggcattccaggatcaggtaaatgctcaaagaagccaagtagttctcgttgccagcattacttttcagtattaaactcagctggagtatcactctgctaccaaggccggagcacagaggcgaaatcttggcacacagaaaacttcggcccccaggatcaagaaattcccaagccccagtctcctaaggagctgggactacaggcgtttttctccgagacagagtctcgctctgttcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacaggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgta

SEQ ID NO: 13150 - DNA, 38538 bp, Human
  misc_feature (1)...(38538): n = A,T,C or G
cacaagtggcaggattttcttctttgtcagggttgaatagtattccattatatatatttatatacacatgacattattcatctgttagtggacacttaggttgtttccatttctaggctattgtgaataatgctgtaatgaacatgggagtgcagatacctctttgagatactgatttcctttcccttggatgtatgggagttgctgagtcatatggcagttctgtttttaccttttgaggaacttttatactgtttttcataatgactataccagtttacattcccaccaacagtgcacaagggttcccttttctctgcattctcactaacatttatctcatctttttatttaatttttttttgagacataatctcactctgtagaccaggatggattgcagtggtgccttcccagctcactgcagcctccacctcccgggcttcagtgatcctcctgtctcagcctcccaagtagctgggactacaggcgtgcaccaccacacatggctgatttttataatttttatagagacagggtctccccatgttgccaggttggtctcgaactgctgggcttaagcattccacccgccttggtcacccacattgctgggattataagcatgaaccataatatccatagccataataatggctatctcttgcttttttgataatagccatcctaacaggtatgaggcgatattgcattatgattttggtttcctgatgattaatgatgttgaggccctagaaaaagtacttttaatgatattggcttccctcctgctttgggtggttccatttagcctaggtcaaaatcacattgtagaccagatgtttggtgtccctaccctgcagtccctgaacttggactgtcctgggacagaccccacttggtaatgcatcctaaactttactttggctcagttcatatcttttctcctacagtgaagagttcatagggaagacatgtcataggaaaattggttttataacgtgatgccaggaagaaaagtttgtccttggccaaaaaagtatttattgacctgaaaagggaagaatagcagagagcacttccccatcatctttcatgtttgtcgggcttgtcatgagaagccctcacccctttcccacctctcccttccctgtgcctctttctactttcgattctcccctgttatctcccttgttatctatctgatggagccagtgtgggcactccacagtccaaatggaagctcagtccctccgggttggcagtgtggctgacacctaacagtctgggaagtgggagaaattctagaacccaaggctattaccgaccctcgacttcccacttcccataagtgttccacacccagtgagtgataaggatgggatcaggggatgcccccaagctgttattagcagcctctggcagacagaagggcaaagagctagagaagaacgctggacatgggatgggctggcagagctggccagacagaaccctgggtggacacagagttgggaacaagctggccaggagatgtggcagagaggcaccagttactttcccaggtgagttaatgtgccagtgtttccagaacttcgagtcgcttcatctttatccagcacccacccctcaccttccgcatcctgaagaagagagatgggcaactggagggcttccatgcagatccggctctacacataggtttgagagcatactcagcagtttctcatcctggtccaggcgatatttatagagggaccagtgacatggagctggaagcctactactggtgactaagaagggggacaatgccactggctcagcagagggaattccctgtggggctgtccctcaggttctcatcccaacccccacccccacactgcactcacacctgcttcgaccccaagcagatcagatgtggcagtggggggtcatgtgacggagaggggtctataaatagctggaggtgggcatgctgccccagacgccttggggacagcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacaggtaaagtgctctaaggggagaggggagccatggatgaggggagacagtggtgccagagactggtgaaaatgaggaattgggtgaaaagagggagcagtgttacatttttttaacttaaaaaacaagtacgtggtgatgtgttcaaaatatgaaaatctttgaaagtctgggctcacttaagtatgcacttagagagatatgcatgcactttcatacaacctttaccaacagagtacccaaatcatatggggaaacagcagagcctcacatgcatgaatagctcgtgcttacataacctacgtggagtggattgcgtaggagcccacactgcagtgtgctgggagctgtctcccacaccctcacccacaggtagacactgccagatttctgcctctgggaccctctgcagaatacacacaaacatgaatctttctgcagaaggcagaagaaaggaattgggcaagtgtagaaaacagactgaattgcttatcagtgatcaaagatctaccaacgtcaaaatgagcagagatgtacaagcttttaggtcgcaagatgatcaagtaagaacctattaagtgttaggcacctggaaaagggcagagatgtgatcccagcaacagaagcatgcaggctaattaggagtgtctatggatgagcagcctcccgctgtgggattggtgggatatgaacacctaggaaagggggaatggggatgggcacaactaaaggaaaggttgtgaaattgtcatggaaaaagataggtcatggttaataagtaagtgtgcctctccctccaaagaatgcagagaataacagaggatagaatttgtctagagggcagttggccagaacttttttttttttttttttttttgagatggagtctcgctctgtctcccaggctggagtgcagtggtgctatcttggctcactgcgacctccgcctcccgggttcaagcaattctctttcctcagcctcctgagtagctgggattacaagcacctgccaccatacctggcaaatttttgtactttcagtagagacggggttttgccatgttggccaggctgtctcgaactcctgacctcaggtaattcacccgccttggcctcccaaagtgctggaattacaggtgttaaccactgtgcccagtctggtcagaacttaaaaggcttttttttctttcttttttttttttttaacagggagccttcagttcctttaggtttaaggctgggaagctgaggcatgagctatgcaggggatctcagcactgggggtcaaaaggatctgctctcagtccctgaccaacccccaggagtatttgcaaaggcagcgctagggacccagtagggaagagggacatacaggtcagtgtaggctggaatcgagcattgggaaggtttcttggagacagcggggtctgactaggcctttgaacactgtgtgggatcagcaggagggaagacccctccccctggccctgtgttctcactcgtgtacatggttgtatctgggtgggatggcaacttgagtaacagtgccattatggcacttcctgatgacagttctcgtgttgggaagctatggttagtttggggagtagaattggcctgttttctacaggtctcaaaagtaaacaagagtttggattagtttttctttgtttaatttttattatggaagacttacacaaaaatggaatggtatagtgaagccccaagtacccaccagttgtcaatattttgtcactattgttccatctattcttcccttccccaccctcaccactctacacaccatggaatactttttttttgttttttgttttttgttttttgtttttgagatggagtttcgctcttgttgcccaggctggaatgcaatggcgcgatctcagctcaccgcaatctccgcctccctggttcaagcaattctcctgcctccgcctcccaggtagctgagattacaggcatgcgccaccatgcctggctaatttttgtatttttagtagagacgaggtttctccatgttggtcaggctggtcttgatctcctgacctcaggtaacctgcccatctcaggctcctaaagtgctggggttacaggggtgagccactgagccttgcttccaccttggaatactttttaacaaatcccagacattgtatcacttgtagacttgagttttgacttctcccttgccctcccctcaccctgccctgcatgggaccagccagaacagatctggccctttaagtgttttcccagcccaggtatgatgatatgaagcaacccccttccttgtctccactggcctggggccttgaggagctgagacagcctcagctgtctgacttccactgggaagtatgttctctctctgggtcccacgcagggtttggaaggaaacactgcctccctcggtcactgacccagaagacaaacagccatgagcagggcaattcatgtgcgtgcttgttcaggactgcggtgtaaaatgctgctcatattgtgaaatcagatctcttctactcaggctctcccagaatccagcaacatggcctggcctgaccctggccccagaggacagttagtgtagtgggagtggggcaggctaaaagtggttggagctcttgtataccccacacagacacacgtgctctgcctcaggatggaagcggagggccaccagacctgggggagctgctctgtcctcttcacatgtggggcaggtaggggtctaattatctagctgtgggaagaagtagatggacctgccttttcgggctagttcttgtgtgtgcatacaagcactgggagatgaagtggatggtcttgaagcttgatagaggacctgaggtgcctcaggtaaggctagacacaccaaggcaaagtgcaaccaagactgccctgctagttagcccagtctgtcctcaccctgttcatgttaggagaaaagtcaatgcaagtggtctggggaaattgtgggacatacagaaagcgcagtgacacaaaacacctgattgatatggccacctgggttcagcacagttctgtacctctgcttcaaagcaaaaactggcctccttgataaaggctaccctggatcaaggtgagtacaggttggagaatgggtgtagagaaggtaggatgaatgaacaagggaaagggtgggaagtgtgggaatggagggtggagagtagagggcagggatgaccacaaagtcaccctgcatgcagtcaacacccagaattcaaaaagctgttgttcttttcttctgtgagtctgtctgctggcctctgtctattatttttttagtcttccacaaggcagacactgatcattctctctctgtccagatttatggccatcacaaagaacaattctcagacagggagcaggacatagggatgcccaagaagacaggctccagttctaccgtggacagcaaggatgaggatcactattctaaatgtcaaggtgatggggactgaggaataaagaaatctggagtagaaacaggtacagggattaggagaataacttgggcatcccattgcacgtacgtactccctgccctgctacaaaaactctcctctaattgtttttaagagacagggtctcactctgtcattcagactgaagtgcagtggagtgatcatagctcactgcagcctagaactcctgggctcaagtgatcctcctgcctcagcctctccagtagctgagactataggcacatgccaccatgcccagctaattttaaaactttttttgtaaggatgctgaggctggtcttgaactcctggcatcaagcaatcctcccgccttagcctcccaaattcctgggattagaggcgtgagccaccatgcttggcccctctaagtattaaggaaaaggcacctctcttcacctccttcgcactttgcctattccctgttattcctcccacaactccaagaaatgagttttaggaaggaattcaagtattcatggggaactgggctttggtgccttttgcaggggccggagcagcaatcagcagaggggtaatgagaaactcagtgcataagacatacggaccctgggggcccaaggcttcccctcccatcttgggtatagcacccaaagtaaagtagtgactcgttagctgcttttctctctctctctctctctctctctctctctctgtctctacatatatatatttttgtttgtttgtttgtttgttgtttgtttgtttgttttttccctcatctcttcctagattgtatccaccgcctgggacaggtggtgagaagaaaattaggggaagacgggatctttctggtgcttctgggactgctgatggctctggtcagctggagcatggactacgtcagtgccaaaagccttcagggtaggtttaacctggacctttgcccacagccgtttctggagtttctacctagggtaagcagggtgtgttatcggaagcgaatgttaagcagggtgtgttatgggaagcgaatattgcgcagagagggatcaggtgggactccaggcccagaaaagaccagacccaggcctgctccacttctcacgcccctccactcactgccacccaagcagtggatgcccctctaatagggtggccaacttgccccagttccccagggactttcccagtttcagcactgaacatcccgaatcccaggaagccccttggttctgggcacaccgggtggttggtcacacccaggcctccagaccctgtactccagtgggattcgtgacacagccaccaactggaacaggccatgtcgcctccataactcaggcttcccatgtgtcaaatgagagcagcaccatctcagaaggggcacacagaaggagcacggcctgagaacatgccgggtacacgtcctggtgccgtggacacggctgctcagccatgttctgcctaaccccaggcatgtgtctccgcagcctacaagtggtcctacgcgcagatgcagcccagccttcctctgcagttcctggtctgggtcaccttcccactagtcctcatcctcttcagcgccctcttctgccacctcatctctccccaggctgttggtgagaacttgccaccagactcggcctgagctgggtggcctgagaggggccctgtctgtctcccccatcatccagccccacccacagccctgtgctgccttgccccatcctccccaccactgcctcttcagccctctccaattcccattcccatattctggacattcatctcccttttcaccttcaccttgaccctgcacataatctttcaacgcttttaggctctggaatccccgaaatgaagacaatacttcgtggggttgtcctgaaggaatacctcacaatgaaagcctttgtggccaaggttgtcgccctgactgcgggcctgggcagtggcatccccgtggggaaagaggtaggcctggcatgactgaagccagagctgggaggggccctcaggagccagggtggcaccaactctagagggagctctgggagtggaagtggatcaggggacaggaccaaggccagggccaggggacactaggaaggggaaatgctttggaagttcctccaactgaggtccaatgacaaaaaccacacagcttggggagcttggagcaggctcttagcctggacacccctgacatttggggctggaaaactctgtgctgtggggaggctgttctgtgcagtggaggggacttagcagcattgctggcctctgacccttcctagatgcccagctgcatcgcccagttgtgacaccagcatgtcctcagacattgccatatggaccctggaggacaaaatctcccctggttgagaacactgtcttagagatcatccagaccaattctcttgcttgaatctgagaaaactaggactgagaaagaggctgtgctattttcaaggttgctcggtgggttgcagcctccttccgttctctgctggtgttcatctttgccccctactgccatattccacccagcagccagaggcatcttttaaaaatgggatcagtctcatctgacccctggtcaaaaacttcttaaggctttccatgcctcttaaaacaaaattgaaagttttgttgttgttgttgttgagacagtgtctagctcgcttgcccaagctggagtgcagtggtgcgatcttggctcactgcaacctccacctcccaggttcaagcgattctcccacctcagcttcccgagtagctgggactgcaggcacacgccaccacatctggtaatttttgtatttttagtggagatagggtttcaccatattggtcaggctggtctcaaactcctgacctcgggtgatcacctgccttggccttgcaaagtgctgggattacaggcgtgcgccaccgcgcccggccttatcagaacttcttgcgtggccttcgagaccgtggactctggttcctcctctctgcaggcctgtgcccctgctttcctgtgtttggctcacaagtttcctttctgtccctcagtcactctgccctgggcccctcagggcgcctgtgtgctgttttctcagcctggaacattcttcctcctgacatctgcgcggctccctccctcccatcattcaaagctctactttaggcaggctcctcaggccctttcctctaaacacgtgccctcccaccctcctccaccctggctctctggagaggagaaacacactggtttctcctcttcttcctctctgggatgaggcctcgtgagggcaggacctctgtgtaactcccgtatttccagcccctggcacagtgcctggagtaaggaatattattagtccagtgagtgctgcagagcctccatctggcctctgacccccgccccctcgctccccctctcccagggccccttcgtccacattgccagcatctgtgctgctgtcctcagcaaattcatgtctgtgttctgcggggtatatgaggtaaggttgagacagtgaaatgagctggggccaggtggtagaaggagtccggctgtgtgtccagggtgttgggagggctgcctctgctctgggctggctgtggtgctgaagcagcatcgcactaatccacgctcccttcctcgtctccctgtctgcctaccctggccacgtgatgcctctgtttagcctgtgcctgtcctccaaatgtccacccctctttcacctgtggccccacatggaggtctggtctgtcgtctgctcccatgctctccctgctagtccataccaccccctctgtgttagtttccctccacgtttccctcgtgtgctcccccatccctttgtagctcccaatccctcaccctacctcttacatacgtcccgcctgccccacccctccacccccttgtcccgcgtgcttctctgttgcagaccgtgcctgggcagcttgacctcctggtgtcggcctgtgcagtgggcgtgggatgctgctttgcagcccctgtcggaggcaagttgcacttcctccctatcccggttgcctaagcaagacttagaagggggttttgggtggctgccacaagctttggagtgggcatccagggaatgactgtggatcacagcccctgcggtccagatacctatattttttcagcaaagggctgtgtattattttgagactgcttgctgtttggtgcaggatttattagtactgctttctggagttcttgctgtctcttttctgcttatcatttattgatttacgtgcctggcatatatttgcctaacttttatttcattttctaccttctatttcattttgacactgtgctatgaggttaattcctttttgccaaactcactgagtttctcttggcctgggaatcacaggggacatgggaccacaaggactccttttgacttaggcctctcattctgccttattccccatccctgcttgttctgtcctctgcctgcccacctccctctcttccacctgtttctctgtctgtctctcccctagtagcagccatactactactctgatatcctgacggtgggctgtgctgtgggagtcggctgttgttttgggacaccacttggaggcaagtgattgaccccctcccccatcaatcggcttgcctggcctggctcccaaaacagttttaatcagtatccacaagtgctggtattaccaggttacttacgagaatagctgacttttagtaagcctttgctatgtgccaggcaatgtttaaagcacttacttttattcctggccaaagccatatgagacagatattacagaggaggaagaggagagaactgagttacagagagggacagtgacttgagcaagttcattctgttagtaaggtacaagccaggaattaaaaccaaggcagtctccgtggctcccctacttattttcaaacctgtttgtattgttggatgtttttgccctacaccgatgacatctctaacaggggactctatgaacttcctccttcaagggaaaaatccacattttgttgtgctttattaattgcatgggaattcaggtagaccttatttagattaatggtaagcttttagtgtggaatagttaggagagtttcaaaggataaatgtcccttgatagcaatttaaagttaagtttagctctttctccaagtataaggcaaatagcgatctctcagattattttccttatcatggatgattaacaaatggatgtagtcggagaaagcagtcgtatctgtttattgactcatcaaaatcaattatagctagattagcagggcaggattatatagatcattcactggattcattgatgataaaaaggacaccaagttgatatgtgaagaaacaaaattgcaggaagggcatatgcttcttaaatgacccactgttagaggtttcttttcagttatggaaatgttaagcaatcttttcatagaatcttccagggaactaaaatgacttggtgcaggaatgataagtggagaagagtttaaagttaatgcaaatgcatgatctaacttatgcaaacactgtggcaaagcacacagactaaggaacccaagttagcaagcacatcagctagcatcctgtttacatttctgtcctcagctctactcattaaaatcactaatccttgtcagtggaggatagtgtatttggatttttgcacatgttaaacgttcacacttacatttatacccacttttgcctttatttactcgttagcctttcaaatccaggaggtttaaataatatttttagactgggagacttctgttgttttgttttaatcagccagattctcttaacatgaagagaatttgcattttcctcgtaaaattggaatttctgagaagaatcagaaaagttcttcttggtcctgtgtcaagtatgggagaggtaaagatcacagagaagttacaggcaacagttctgaaaccactgtggtagaaaaaggaagaaaaaattcacagataaaacattgctgttgacacaagaaattgttaagtacttaaaaattaaggtgccatgtttacgctgtttgtattatgtggtaaatgacaaaggtatttgcaggtggcattacttgttttttttgtttgtttgtttgtttgtttgtttagatggagtcttgctctgtcacccaggctggagtgcagtggcaccatcttggctcactgcaacctctgtctcctgggttcaagcaattctcatgcctcagtctcccaagtagctgggattacaggcctgcgccatcacgcctggctaattttttgtatttttagtagagacagggtttaaccatgttggccaggctgctctcaacctcctgacctcaagtgatccgcccaccttggcctattacttgatttttaaaaaagaataccgaataattctgaaaggaaaattagtatcaaaatgaggtattcattatggagtcagctcttaatttcttacactaatgaaataaatggaattcagcattctactgaaatgacaagcatcttgctcccattctgtaccaggccctgtgttggatcttgcacactcagggtgctcctagttgagaggctggacaggcaggcaaacctattgtcatagctcactcgaaaaagtggcccaatggcagctggggtaaagtgcagtggggaccttatgctaacctgcctacaagagcccatgaagcttcacaaaagaggtggtgtttgacatgaggcttgaataataagtaggactggcaaggaggatggtgggcaaggtattctggacagaggaaacagcattgcaaagtcaagatgggggcagtagctgagtattaccaggggatacagaggaaggaataatagcaaatgaggctggacaagtaaaggggggctgaattatgaagactctcatggctatgtataagaatatggaatttattctctagactaggatttgcacgaatgtgtttcatggtttactagatctaatgtgtaaaaatggtgctataaaccagttggaaaatgcttggttaaagagagttttttttaaactaaaaaagttatcagtggccaggcacagtggctcatgcccataatcccagcactttgggaggccaaggcaggcggatcatgaggtcaggagttcaagaacagcctggccaatatggtgaaaccccatctctattaagaatacaaaaattagctgggtgtggtggcaggcacttgtagtcccagctacttgggaggctaaggtggaagaatcacttgaacctgggaggtggaggttgtagcaagctgagatcgcgcgccactgcactccagctcgggcaacagagtgagactccatcttaaaaaaaaaaagaaagaaaaagaaaaagaaaagttaccagaacatttgatatgctgacacacattgggaatatccaaaatgtggctctaatgcagcatttcccacagaaccctgtctcgtgggcatgggatttgtagtatctcacagacctgacttcgggaaatactgtcggggtgaattaaagtcatgaaatacttgtgcacaaggaagtgatatggccagctttgagtgtccacccaatccctttgtcagatgtgtgcaggacaaaattggtctggggattaacaggattaatccaagattaacaagaagacgattgtcatagtcctgatgctaggtagtaagagactgcactggacagaggcagaagagaaagagaagaatggtagaaagtaaaattgatacaacctggtgattaattttatttttttctttttgagagagggccttgctctgtggcccaggctggagtgcagtggcgcaatcttggctcactgcaacctctgtctcctgggttcaagcaattctcccacctcagcctcccagcagctgggactacatgcgcacgccactatgcctggctaatttttgtattttttagtagaagtgaggtttttccttgtcggccaggctggtctcaaactcccggcctcaagtgatctacccacctcggcctcccaaagtgctggggttacaggcatgggccacctgcctagcatcccggtgattaattttgtgtggggtaaaagagaggagggatctaggctaacacccagatttcctacaagggcaattgggtcgatagtggtgttagtaaccaagattgggtatatgggaagtgaaacagatctggtggggggagctagctgatacatttcactttgagtgtattgaatttgatgttcctgtgacatatctaggtgagaccatttttgcagcggggttgacgagtctgaagctcaggaacatggctttgctaatcagcagcatataggtgtagttgatggcatgagcatacatgaaattgagagagaaagtgtgtccatgagtaggaggagcaggagaccaaggacaaaggctggggttgggcagagggacaggagcagcagagaaggtagagagggaatccagggtgggagaagagagcaatgttccagaacctgagcagagagcttccgaaagctgtttttgtttttaatgctttgtttccttttagctgcacattttatgtctggctcaggctaatattaaaattagctctcattccggagcatacagtgacagactgctagggaaagtgtcccagaaccacgtcgtaggaaagaaaacctagcccaggatttcaaaaaattgttgtaaaatattcatcagttggatagtttacacccaggcaaatcaaagctgactgcttttgttactggtatagaaaaggagagagactcactctacctggttcctgctgtgtcaaatcctccttttaggccccagaggcagctgcttacctgatgtgatgtgaagagcagggcagaaggggtgattggccaagcaagctctgtctgccccacattgcccattgcctttctctgtttcctgaaattctgttctcttctgttctcttctttcctcatcctgtcctttcctctcctcccctgctcatccagagaatagacattcagccctgattattcaccaggcactgtactaggtgctggttttcaaggaattttctttctttttttttttttttttcaagacagagtcttgctctgtcacccaggctggagtatagaggtgcgatctcggctcactgcaacctgcgtctcccgggttcaagcaattctcctgccttagcctcccaagtagctgggattacaggcgcctgccacagcgcctgactaatttttgtatttttagtagagttagggtttcaccatgttggccaggctggcctcgaactcctgacttcatgatccccctgcctcggcctcccaaagtgctgggattacaagcgtgagccaccacgcctggcctcccaggaattttcaatcctaggggatctctgaaatgtaaagaaatatctggatctgaaagtggtagtgctataataacccaaaattctgagagcgcaggctgaaggacggatggtttcgacctgaagaggaggattggggatggcttcccagggaaggggacttgggactgaccactggaaatcctctgccaaactgtagcagctgctgcatttgggagtaaccattaggccaccctccccctggtgcaaatgacctgatgtaactagtcgactgtcacctgtagaagagaaggtggtggtcctgggggattcaagagatgtggcctttgaatatagcacagggagaagaaaattactaggatgcgaggtgctgcctgaagagggcgttcaccctgttcacatggagagaaaggggacaaacctgcctagttcaaggtttcctgaggccaggcctcatctccattcatccaattatgtgcgtggttgcatttccctggttccttttcctcgtttttgataaagatgaggcttagccaggttttaggtaattttgtcatcaatttttactttgcatcagattaaagtccacccccccttattcttaatatgttgaaatatttttttctttgcctctcttgagtgttgctttttacgccctcactcgcattccttactttgtccctaccaacccttgttctttttctgtagatctaccccctcaatttctgctccagcacctacgctcagaaacagtactacttagaactactacttagctttccttttgcctcacccacctttcttaagcatgattgtttttctcttcttctagcctcttggtttttccccttgcgttggtccttttaagtcgggtttttagtattagtttattattattattatttgtatgactcctctaccttcttttcttgaactatcgaggatggtcagctcctgcaaagccccctcctatttttgttctgtcttccttataaggttgccccagggtacatggtatatgtagaacggtaggaaagtccagaggagggtgttaaggagagtccctgtaaatcctgagctctgcttggcaactctactgaggaactgctctggaactttctctctcttaacttctctgcagatttttttcaactaccttttagtccctgtgggtatctgacagttgtgaaccccattcaaccctacattctaagggatgcagagggcacggacacttggtcctcatgttttggaggttgaaggcccattcgttttcaatcttctctgtgttggacccatcccttgtctgaaataaaaataaaaaactcctagcctgagcagttgtgtggttttgagcatgggaatccaagagatcattactttccactactgcttccacccagattcatgtttcagcaaaagctccttaggtccaagcagtggggagtgtgggggagcactttcactgctggctgcccccaaccacacttctgtgcccctgcaggagtgctatttagcatcgaggtcacctccacctactttgctgttcggaactactggagaggattctttgcagccacgttcagcgcctttgtgtttcgagtgctggcagtgtggaacaaggatgctggtaaccaaggaggccttgggtggaggccatgtgaaatagaaaagctgggaatggggtgcagaggaaaactctgtggggcagttcagaaaaggaataatgggcggcatcatttgtggggtgggaccaaggcccaagggtgtatgacaaagatataggtcatggagtgggagagtatatccatggaggagtgtgcgtagaaaaaaggaaaatacattcaagaggagaaactgggattggaggaaggaaggaattaatcctgaaaactgcccacctctgtttccctgttgggtttctacgaagctcccatcgtaatactggcctttccatcctacagtcaccatcactgctctgttcagaaccaatttccgaatggatttcccctttgacctgaaggaactaccagcttttgctgccatcgggtcagtggggttacctgctctgtgtgtggtgagcagggtgtggagtgaggctgtagattggaagggacccaagctagaaagaaggtgcggttggcacagatagagtacattgctggggggatgtggacagataggaaaggcagaagcctggtatttgtttccctgcagtagttatgtccaagagatgaggatttcatgtctgtaagattccaactctataaattacaccctcaggatttgctgtgggctcctgggagctgtatttgtgtatctgcatcgccaagtcatgctcggtgtccgaaagcacaaggccctcagccagtttcttgctaagcagtgagtcactgcccttcttttgccctacccatttactttctggtttctccaagagttcctccctttttgtctttggggaaggcattaaatgcctctgggtggcttgcattaaaatataaggaagctctgatattgtggttagggggtgaattgtgtggtctcccatttaaagattatttttgtttttgttttttgagacagagtctcactccatcacccaggctggagtgcagtggtgcgatctcagctcactgtaacctctgcctcctgggttcaagcgattctcatgcctcagcctcctgagtagttgggattacagacatgcaccaacacgaccagctaatttttgtatttttagtagagatggagtttcaccatgttgcccaggctggtctcgaacttgtgacctcaggggatctaccctccttggcctcccaaagtgctgggattacaggcatgcaccaccgtgcctggctaatttttgtatttttagtagagatggggtttcaccatgttggccaggctggtcttgaacttgtgacctaaggtgatctgcccaccttggcctcccaaagtgccccatgggattagaggcatgagccaccgcactcggcctcaaatattgtttttttgtgtgaagagaatctttttcatttaaagaaatgagactacggtggactaaaggaaacttcagcttgccatcgttcagtatggtatttactgtgagttggctgaattgtggcggttaactctgtttctttttcagccgcctgctgtatcctggaattgttacctttgtcattgcctcattcaccttcccaccaggaatgggtcaattcatggctggagaggtcagctgttggtggggccacatggtaaagaggaaacagcacagatatacctcaggcttcagagcataagtagttttgtccaaggatagactttctagattctccctgagaaaagggcaaaagagacccttgaataatgaggctggggaataagttctctaaaaaaggaagcacaggagttccctggagaacccaccctttctgcttcttcctctcccagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaaggtactgctcctgacactagcaacaccctaaacctccatctgttttcaatctatgaacccagggtttgcatagggtaggaaggggtagaacttcatttggtcttcatccaacctaaaaataagtcatttgaaaaccatagagttggccaggcatggtggctcacacctgtaatcccaccactttggcaggctgaggcaggtggatcacttgatgccaggagttggagaccaacatagccaacatagcgaaaccccatctctaccaaaaattcaaaaaacttagccaggcatggtggcgcatgcctgtaatcccagctactggggaggctgacgcaggagaatcacttgaacctgggaagtggaggttgtagtgagccaagatcgtgccattgcactccagcctgggtgacagagtgtgattctgtctcaaaaaaaaaaaaaaaattatagagttgtaagttgctatagaagtaaactagtatctgagttaattgctgtattcacgtcaacttagtgttgtctggcatagttatctaacccttctaattgttcttcttgttaaattactaagctgtcacagtagccaagtaaaaaagtacaagatagagttaagcattataaataactgtaaaagccttggattaattaaccaaattcccccacttagtagataattaagtatttcattctccatgtatctgatgatccattttttaggtgatttgagcatcttttttcccccggttttgtagataatctcttttttagatcttcaaaagggataaaatatttaaattaattgtattagtgactacacataatttttatacatgttattattctctatttaggtgatgaagctgtgaggattttgccattcccaaaccatattcttctagcttcaactaggcaataaaagatgatctctttcacatcacttctttttcatatctgcccatcaaggattatgtatttatagacttctcaattactgccttgtaataagatatttttatttctacccctggttgtgacatctattacaattgctgattgctggccaggtgcagtggctgatgcctatattcccagcactttgggaagccgagagaggtgggtcatctgaggtcaggagttggagactagcctgaccaacatggtgaaaccctgtctctactaaaaacacaaaattaaccaggtgtggtggcacatgcctgtaatcccagttacttgggaggctgaggcaggagaattgcttgaacctaggaggcggaggttgcagtgagccaagattgtgccattgcactccagcctgggcgacaagggcaacactcctcaagaaaaaaaaaaaaattattgattgcccttttttttcttttgtgatgattatcttttttactaatagtatgtcttgcctaaataacacaacactttcctctgtatattagagttctcatttataagtctgtccatactgaactttcaagcttttgaataccttgctattaacttatttatgataccttttataaatctatgttttcccaggatatgagtcactaagttatatttatattgcaatagctacagtgggttcatgagttcatttgttcaataaatgttattaagcatttactatgtgccaagtacataatatttcatcattaacctttagctatatcttatgcttgcaacagaaaaaaaatttttaaatattttaaaacgttctattttttgctgtttatttaatttaattttttagtgatgttaagactagagacagcagatacgtgaaacaccagatttcaactctgtaacatattcccagggtgtctagaaactgtatttgcaaatgatcttccccattccactttaggtggtttagttgaatctacagcattcatattttgcacattcactttattaatttaatccctttaaaatgtctttcttcaaaagattttacatttttatcatgaaagaagttttcagtgtcttgttagggatttgatttttagactttcattatagagttcatcttctctaatttataaatcccaacctcctataattagttgttgagtacacaaacccatctacagtaaccaagtacaaattttggtggatctcagaattggacggtagtccaatgatgataactgtatttttctgagattcctctagactgagctatacggcaacattggcatcgtatgtacctttaaaatatcaagattttgaaaagtcctgtagaaacgaaatactgtatatttttcaacatttctgccaaacctcatcccagctctccagattcccaagtatatgtctggattccacttcgcaaattcaagcttattttgagaaacctacttagatgatatagaggactcacctgtatgccacaattattaatttctcactagattatatccttgataatgttacatcatactgtatcaggaaaagaaacatatacttcctgggctatatttcaagcctaacagtttgcagcaggcctataatatcctataatatttacgaacataaaaccattcactgctacaaatctatgatattccctggttatcaccacttcccagcattttcactgtctaatcattggacacaataaccatactcttattttttagctaggtaggatacatagctaaactaaaatataaacatgactgaaacaatttttccagtgcctaatttgaaatgtagtctatgtggtcttctagcagcatctgtacaggcaggtaagattctcaattcagctgttttgtttttttttttttttttgattcggaatctcactctgtagcccaggctggagtgcagtggcacaatctcggctcactgcaagctccggctcccaggttcacgccattctcctgcctcagccttacctgtagctgggactacaggtgcccgccaccacgcccagctaatttttttgtatttttagtagagacggtgtttcaccttgttagccaggatggtctcgatctccttgcctcatgatctgcccgcctcagcctcccaaagtgctgggattacaggcgtgagccaccgcacctggccaattcagctgttttataatattaatgaagagaacttccatcttccttaatctcatgacgtggaaagtgtcattacattatacatcaagagaagagcttttacaatgagtatgaataccattccaaattctcagtttgcttttaataagtctaacattgttacctagtatcactaagttctctgcacagcctgaggctctgttgaattttttttcactcctttcacttcattctcccgaagtgaattcttcattttactccttctaatgaagggtctaaatatggtggaaacccataatgggtttccagttttccagttccctgaaattgagtgtttaaaatcgtggtagttctgtaggtctagatctgaagaaaaaaaaaaaaaagctgggtgtaatcccagcactttgggaggccaaagcaggcggatcacctgaggtcaagagtttgagaccagcctggccaacatggcaaaaccctgtctcaactaaaaatacaaaaattacctgggcgtggtggcaggcgcctgtaatcccagctcctcgggaggctgaggcaggagaattgcttgaacgcgggagccagaggtggcagtgagctgacacaccattgcactccagcctgggtgacagaacaagactctgtcaaaaaaaaaaaaaaaaaaaaagaagaagaagaaaaaaaaaggaaggaaggaagggaaagaaagaaagaaagaaaaagaaagaagaaagtcttgggagttatttgtgtttcacattacttctggatcttttctttcacgtgccaatagctaaaaaagtttgttaatctcatgtgtcaacctttgtgctataggagttgataacttcaatgtcttctgattgtaatactgttcttacacatatcttggaggataatctaaaatacatcttctgaaatcagacctattggttacctgttatatgaattgctagagctttcagattaacctgagcctacaaaatctcttatggcttttatgtacttatttcaaagagatggtacaggatagttcagtccaactgttaaatgtcagaatcacttaagaagcttaaattacaagtgcctatagccctatctgcagacaatctgatgtggtagcttccagtggggtctggtcatctgcattttaaagcaagttcccctggatgagcattactctttagtgttttagcaaatattagctctgagaagcttttcctcctttgcatgaatactatttgttcagcccatcttcgttctttccttccttcctttctacctactcacctagctacacccttcctacatttactgagcactgtgccagtgcagagagaaggcagaaaggacaagatgcactctctgtcctcaggggattctcagtctctattctcttcattttgcccattcatttttatagttctcaactgtttttgaatagtcatattctgacatgaaggagtgtgtgttttgcctcatctcagatcttctgggatgagactttcttagagtctttgtcactgtctcctgaggtcagccctggatgaggggagttctttctttctacggttctgaaaattaagaaatatatttctcgttagcttacagtgcaattgcgcacagctctaaaattgtgaatactttcatcttggcagtttgtcctgagctttagctgctaccttcttacacctaataagtttgagatccatttctgaaattggtttacttattttggaagggatatataaacctgttgctttgcttacatatgacatctcatacttctatttcttttacagatatttaaaaagttccacaactagccttttttccattctatttctcaattctttttttttttttttttttttttttttttttgcgacagagtctcgctctgtcgcccaggctggagggcagtggcatgatctcagctcactgcaagctccaactcccgggttcacgccattctcctgcctcagcctcccaagtagctgggactacaggtgcccaccaccatgcctggctaatttattttttattttttatttttttattttttagtggagacagggtttcaccatgttagccagaatggtcttgatctcctgacctcgtgatctgcccacctctgccttccaaagtgctgggattacaggcgtgagcctctgcacccggacaattcttttgtactctttgcctcaaaatgcacatattgctttttgtaaaatggtctcaatttctattggagttctagcttacaaaattggccttagagattttttttctatcacattggctgacttatcaggctttctcaatttacccttccagtagctagccaggacagatctaaattttgatccttgtttaaggtgatctgatcattaaagcaagtggctcaggcaggtaagtcttctctccaggttctactgtgagtttcaccatatagatggttctatgaccccattgaagctcaattaatcacacaataagtcactcagactttaaatgtctgacacttagaactggagctccttggccgggcgcatcggctcacacctgtaatcccggcactttgggaggtagaggcaggcagattgcctgaggtcaggagttcaagaccagccggggcaacatggcaaaaccccgtctctactaaaaatacaaaaaattagctgggcatggtggcgtgcgcctatagtcccagctactcaggaggctgagacaggaaaatagcttggacttcagaggcggaggttgcagtgagccaagatcatggtactgcactccagcttgggtgctgggtggcagagagagaccctgtctcaaaaaaaaaaaaaaagaaaaaaaaaaaaccggagcgccttttcagaaatataacctgagtaggaaaagtcttcaagagtttcaggctactttgctgaggcaaactttctggactaaatgggtacaatgggctggggctcttttggggcagagaaagataagtactccggggctccattccttgttctagattgctgaaaggcaaatacaggcactcaaagtagaagggatttggtctagccatctagaggaaccttctgatagtattgtctttggtgatctcttagcctgagagctctatggcttttgtttctggaagaagggtgacagacaaagtgactttcagaaggatcagctatcccaggatttctgcagaaaggaggatagtgggaagggaattgtgtgtgcatgtctattgggcagagttgaaagggtattccaacgcttctttctactccagttctggatgtccatcgtggccaccactatgcccataccctgcggaggcttcatgcctgtgtttgtgctaggtaagttctgatgggaagcctggggtctgactgagagttgcaatctaggatacaggaaacataaggaaaggcccgggatgctgggagtttatatttgttcttaatgcccaaggagagattggttctgaaaactgagagcaaggaacttggatctcgtaacaccttccttccttttatcttccctctaggagctgcatttggaaggctggtaggagaaatcatggccatgctctttcctgatggtattttgtttgatgacatcatctacaagatcctacctgggggctatgcagtaattggtgagaaacattcccacttccctgtaatcaaacattgagtacttcagatccccacacttaaactctcccattggatcttcattctaggctacacaatacggttttaatttagtgctacttaactcaacttttactcagataacatacccatggctctgactctcattatttcttactgaacttccgtgagccttagtttcctcatgtagaaaaggatcatagggatcaaatgagatcataagattctaggattgtgtctggatgtttgataagggttctgtctttccttcccaagaatcatggaaccaacaatgcaggtgattggctcaggttgcaggtgattgactcaacctgagacgtgttgatattgatgggtagttaagagcacaggactaagagctaagaaacatggctctagacttctcctgccacttgttaccagtcaccatgaagcaagatagctgcttctgagccctagtttctttattctaaaatgacttctgagatagagctatgcctaacaccaatagaatcctgggattattatgcttcctcccttcctcagcaaaatcccatagcatctaaggccatgccttccctacatagagaagtgctgaccagctttctagctcacttggtacgctgctcccctgacatagtttctttctaaaagcctctttcatcaatgagggtcatagactcttgttctccatcttcatgactccctggtacacatgcctcccttgtgaacatttccttgtatgcacgtcctgtgattgtttatgttctgaagtatgttatatgcaatatccaatagtgtcattcctccctatatttcccttctgtgatgctttcttggttgctctctccctttctttctcccttccttccttcttttctctcttctccttctccttctcttctcttcttttatttccagagtcttgctctgttgcccaggagtgcagtggcgcaatctgggttcactgcaacctctgcctcctgggctcaagtgattctcctgcctcagcctcccaagtagctgggattacaggcacatgccatcatgtctggctaatttttgtaattttagtagagatggggtttcaccatattggccaggctggtctcaaactcctggcctcaagtcatccacctgtctcggcctcccagagtgctaggattacaggcataagccaccatgcccggctgactttttcttgttacattttcatatgtgccttcctctacattttccccataggatacctcttccatatttaaataagaaatataattaaagcacaaaggactattttggttagtggagaaacaaccaaaaattaacaagatagattctatcttcagggagcttatagaattataaagtttcagatctacaagcgccttagaaatcatctaaatgacccctttcgctttataattgagagcatgggattccagaggaattaagctctactcattccattgagaaatagtaagagcaggatctgacacaggtctcattgctgcatgtccacagtatgattctcgggttttcattctatttactcactaattgttggcattaatacctaaagcccaaggtaaaaaaaaaaaatgttataactgagttgtaaaatgctcagtgaagaggcctgatacagtggctcatgcctgtgatctcagcactttgggaggccgaggcaggcagatcacttgaggccaggaattcgagaccagcctggccaacatgacaaaaccctgtttctactaaaaatacaaaaattagacatgtgtgttggtgcatgcctgtagtcctggctactcggaagactgaggcaggagaatcacttgaacctgggaggtggaggttcccatgaaccgagattgtaccactgcactccagcctaggtgacagagtgagactctgcctcaaataataataattaataataataataataataatttaaaaaaataataaaataaaatgctcagtgaataatcatccaaacttttaaaagcaaggaatggataggacatcactatcttcatattataaatgaaaattttggcacacacaaagattttgtaacttggtgaagtttatagaatgagatcaaaatgatgatttttctaagagttcagtattctattccctactcttgacaagtcattatgagtattggcactgaccagggtcatgtctctcattccgtgttattcccatcccatccccatatgtccttcatgctaagaacggtagccctaacctacaggcgtattcctgtgtcattctaggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcaggtcaggggcactagacggaattagttcagatctgatggggagagtgggaggttctgaggctgagactgagcttagagttaaagtttggaaacactgttttaaattattattatattctcatgcacctagtagatattgtgagtgactgaaagtatggcaaatcttatgggaggaatggaagggataggtatacggtggggctaacccaccatgctttctccctccatagcaaatataccatctttgttgaggacatcatggtacgtgatgtgaagtttgtttcagcttcttacacatatggggagttgcgaaccctgctccagaccaccacagtcaagactttaccactggttgactcaaaaggtcagtggggaggaagaagtcgactccagagctagtgacctgaataagggtcacatagaggtagaggaggccccatggtgggggctttgtctttaggggccatccaatgtgctatgtacaaggaaggaaaaattaagccataacacaagcacacaaagacagttaaaaatgcaattaaaaggtcctggcatggtggctcatgcctgtaatcccagcactttgggaggccgaggtgggcagatcacctgaggtcaggagttcgagaccagcctgaccaacatggagaaaccctgtctctactaaaaatacaaaattagctaggtgtggtggtgcatgcctgtaattagaacccgggagacggaggttgcgatgagccgagaacgtgtcattgcactgcagcctgggcaacaagaatgaaactctgttaaaaaaaaaaaaatttcccactaaatacagtcaattctcataattcatggtagttatgttcaattaagtatgaagttcaaatactatactgaataattgctcctaggaaaaatacagggctgtgttcctgtgagtctctggtcacatttccatcaaccaatcaatatatgaccttgttgtatgtgtgtttctggtaaagacaccttatttcacagatattgtggattaattaatattgaacttgtgccaacagcactataacccttgcctgaattaagcttacttaacacacatattttctcaataaggctcatcacagccttcttgcactaggaaaagtaaacagcactttgacattatatttggtggtcatttttagcagcaaaatcaccaacacaaagcacaaaaatgcaaaaaggatggcactaaatagactacaaaatgaacacctgtttacaatgtgaaagctgaaacaagaaggtacagcactgctttgttcaacttcagctgggaacagggacatgggacaactaaaaatctttgttgctctttgcatgtttgtgaattacagtgaaagcacctctagtattggttttgtgttacaaatatattttagtgactagctgaattcacaaatagggaatccatgaataatgacaattaatgtaaatcccatagcttcttacgttgttccattttgatgcttacataagtcatgcttgttctttaatgcccaacttatggaagagttggaactgttttctttcttccttcctttctttctctttctttctttccttctttttctttctttctctttctctctctctccctccctctttccctctctctctctttctctctccctccctctttccctctctctttctctctctctcttttcttttcttttctcttctttcttttcgacagagcctcactctgttgcccaggcaggagtgcaatggcgccatcttggctcactgcaacctctgtctcctgggttctaagtgattctcctgccttaggctcctgagtagctgggattacaggaatgcaccaccatgcccagctaattttgtatttttagtagagacggggtttcaccatgttggccaggctggtctcgaactcctgacctcaggcgatccaccagccttggcctcccaaagtgctgggattacaggcatgagccactgtgcccggctggaactgtttcacatggaggagtgaatggttgttagtaaacgataatttcacatttctctgccttcaccatcatttgacacttcatcctgctttgtatgatttcttattgtggtttatatatctatatcttgtcttcctaactaggtgggcattccttgagaatagaggctatgaattctatatacccagagtgccttgttataggtatctactagatattaaatgaataatttcctagtgtttgaattagtgtaataaagaaaaatcatgtagggccatttggagtcattaagattgttagttctgatttccaataatcagaatatccaaatttctcaaattaaattaattcaaatattttcccaaatctcatatacattccacgttctacagcagaggctctttattagaggaggggtacagccaacaaatgaggggcaaggttttcataataatgactgagacctaacagtaaaattcatctccagagcactgctgcaatgtcttggccttaaaacttaataaaaatgttaactatagtagcaaaatttctataatcatataaaagaccttctcaggaaaagtaggcattttgatttatcctagcagggtttttttttttttttttttaatgaaatctcgctcttgtcgcccaggttggagtgcagtggtgcgatctcagctcactgcaacctctgcctcccgggttcaagcgattctcctgcctcagcctcccaagtagctgggattacaggcgcctgccaccacgcccagctaatttttttatttttggtagagacggggtttcaccatgttggccaaggctggtctcgaactcctgacctcaggcgacccgcctgcctcggccttccaaagtagtgggattacaggcgtgagccaccgcctggcccaggttttttaaatgatgaaatgtcagatacaaaagaaagagttcccttgtttccctttttccagggagagatataatgtttgtattgcttatagacttctttcaaagcgtgttcacgtctcagcttatttgaatggcttctcatgtttctttttatttggacagcattgattagcctccttaattatcagctcacctatctgaagtctatataaggcctcatcaaaataagtacaaattagcccaattagtgctctaccaattggccccgtacctgctaaatggatgaaataaaagggattgagtgaggttaatcttggaggattcttaaaatgagtttccaggaagctgagaaagatgtggggacgccgggcagggtggcgcctctcctgttccttctcaggagtgcggagcgcggtggtgcgagagggcttggagggggcgctcaggcagggcgtgggtttccctcagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgaggtgaccgcgccgggaagggctagggagtgggatagatcaggagcaaagggaaaagcgtcgtctgggctgggctgggctgggctgggacaggcgtagtttccctgaaagtagtgggaagagggaggggagagtctggtaactgagaaagccagaaattctggatcaggtaccatagagaccagtgcctctgggtccagggactaaagaagataaggttgcagatgatggtatcctcgacaattcaaagggatataggaatttctgaactggggggaagaatagagttcgctttcccagaacatccaccaactggtaaaggcagtgaaggcccaggcagtctctgctcccaggctgagacttcttactcttccttacagcttcctccttcccttgctctccacccctctactactgcccctctgtccccagaagagcccaatgggcctctgcctggccacaaacagcagccggaagcaccagagcctgcaggtgacgctcttccctcatgcaccccaactcaccccttgtgggttctctctggtcactaggacctgaccttgacctgcatgcaattcctatgcggggtggggtggggggtgaggctgggggattgagggaggacagggttcttattcatcaattctccttgttactgtcccagggagtgggagcagagggtgatttaggagggtagaagagagggtgaggtacctgggaagtgcagctctttggaggcaaatgttaggcactgggtggggcccctggccgtttcctgttgctttgtgtccatttccatccactcacctgtcctctcaggtcaaagaccctccatcttccagtccctgcttcactgcttgctgggcagagctcgccccacaaagaagaaaacaacccaggtgagaggagatgtgtttggggatacaggggaaagggagcctgcccttgaagagtgagaaacccacggttcttaaatcaggaaggcagagaccccaccaaggaggaggagtttaatcatatggaagggatgatgaatgaaaaggaggcatcggtggtcctggccagggagggatggctattgtttcattgggagccatagctaccatgggaagaaaagggaaagaacttggacctatgtctttcttctctaggattccacagatttagtggataacatgtcacctgaagaggtgagtaagggaaatggaaacctggggtggattgttctatcaaatgaagatattgctaatttgtttctaccttctttattgtgttgtcatgaaatagaatgtggtctggatgggaagtgttttgagaggatggaaataaggatgattatggagagagtaatgagtgtgtgatgggacatggaggtgttctcagaaggacacgtcatttcagaagagaaaaactttgagcctccatgagtaaatggggccatggtgctaagatgagccccagatcttttagagattatgggctttctggatcaggcaaagctttaatggaggtaaaatggcaccaggaggctggcactaaaacagcaacatagaagaagaacatcaaaactaaaatgggaggccgggcatggtggctcatgcctgtaattccagcactttgggaggccaaggcaggcagatcacctgaggtcaggagtttgagaccagcctggccaacgtggtgaaactccatttctactaaaaatacaaaaataagccgggcatggtggcacgcacctgtaatcccagatatttgggaggctgaggcacgaaaatcacttgaacccgggaggtgggggttgcagtgagcagagactgcaccactgcactccagcctgggtaacagatccagactttgcctcaaaaaaaaaaaaaaaaaaaaaaactaaaatggagaaatctgctcctggtggagattactgtgctggattgatcagggccctgagacagtgaacaactggaaaatgctaggcattgctactgggaagaactgaaaaaggaagaaaataatgaccacggtgcctcctggggacaaacaaatgcctattttcctaaacgaggtggttatcaaatcttcaagagagaaaaatcaagcattctgaatgtgcttggttgtcaggagggaacagaatgtggactagtgattggaagcaggcggtatcagaacataccgaggggttgtggaggaacatcaacagaaaaatccattggcaactattccatatggtaaaagaatgcagagtttgctgcaaacgctgaaaacgtaaagcttgtaaagtatgaagctgacaaaaaaaacacggcagatattatttttaaatgaacatcttattggatatccagaataaatatgtgctgacaatgaaaagcattacaggattggaggaggatgttgtgagtgacaagacagaagagaaaccttccccaccccctcaaaacacacacacttctgataaatgacttgtgaaaaagtcaaatcgatgatcacagagggaaaggaagaactattccttctgcccacaagcaggaatcagaaaggccataattgcagttaaggagtactttgttaggttgctaaaaccaataacaataagttttgctttttttcttttttttaatttaatgcaccaaagagagaaaaccagctagttgatcagtgtggctattgaatgaccactggaaataaagtgaagccagggattaaaaataagatagactatcatttctagcttatgtctttcccagggaagactttaaggagctaccaactcccatgtgacccactgagacattttagagggataagatctaacaggagttgaaattcaggatgttttgaacacaattttcagaccagatgatacccttgacaatatcaagatgttgatattgaccaaaaaaacagtatgggggcagtatgggaatattgaaagattcaattatatgttgccagaagtccctactaggatttgtttaattctgcatactctggagtacacacagagctctgtttctaaccggtaccgagcttattcaagtagtggaacacaccagcctcaacagcaacgtcctgcatcccttgcgcaaaagctggagatgtacctggaatacaaacagcagtcaaggttagaagcccagctccaccaattactgactgtgtaatcctgggcaaatgacttcaacatgctgtgcctctgtttcctcatctataaagtgaagataatgatagagttattagagaagattaaatgagctaagacgggtaagtcaattagaataatgcttggcaaagaggatgtacttgataatcattcactgaaaatgttgccgcgttattgttaaggaaaggcaaaaacggaacataaggccacagatgatcatagaaaagaccaagaggacgggatggaccaaaccatggttggcaaggtctagcccccgtcctatacctaaatcttctctacaacacacctgctaagtggtcatccatcctatgctatgtaacctctgtaatccattagtccggaagatgagagtatagaggagtcatgattgtaatccagaaatatcaggacaggacaggtggagtgagcatcactacgggctacacaccagatcctaaacctatataatgccctttggtgatattctctgaagtttgagaggtgtagatttggacaaataggaaaatagagttctagatcattcagaggatactgactgaaaagagattttagaaattttagaaaaatgtaagagagccagagatgtaatggattatttggactcttgggaattttggtgtgcgtatctaaagtcaagaggatggttggcctttgtgccttaatgcttctgtcatagacaaaaacaaacaaacaaaaactggctttgctcaagtcagctaagtgccatgaggtccagtatagctcttcaatttcaacaagtacccactacagttccctgcatgagaggtgatgtgctagtttcttcacaatatacagcagccgataccacataacactcaagacaaatgcagaggtaagacagatgccaatacagcaggaagtatggccaatgtcatttctgaaaaggtgagaccagctaatactatgggaataaaaaaggggagaagcacatctgattgggagagtcaggaaatacgtacactgcagggagagggtagggcaggtaaaggaactccagatggtcagaatagcaaagacaaaggggaaggcatgtttgaagagcagaaagcagtctggtttgattggagccccacgtcttatagtagtagtggaaaatagatgggaaagataggttgggaataacaaatgtttgggacgccaggggataggagagttggagcctagaagagggaggggtgttctgggtacctgggggttgcagggtaggttgggggcctgatgaggaagggcagagaggctctgtcccctgggaagaaggaggaggtcctctgatctgggggatctatgatcagttcttgcatgttcccagattctgggcagcggctaggagggccgtttggggtcaaaatcaggtatctggggtgaaaggaggctctgtgattttcgtgactttcctcctctggctgacagattgaggcctgggagcaggagcagctgagccagcctgtctgttttgattcctgctgtattgaccagtctcccttccagctggtggagcagacaaccctgcacaaggtgagtcttttgctgactgctcagggctgtggggaaggcaggagagctgtggggcaaggaacatgcactgacctgtgctcttcatcctcagactcataccctgttttcactccttggcctccacctcgcttacgtgaccagcatggggaagctcaggggcgtcctggccctggaggaggtaatcacgatgtgtcccatttgagcagcaggagggaggctgggcataggataaggggatgcagtggggacagaaggaatattagcatctcagaagtcccctcagattcccttctctatttctttcttttttttttttttgagacagagtttcactcttgtcgcccaggctggagtgcagtggcgtgatctcagctcactgcaacctccgcctcccgggttcaagtgattctcctgcctcagcctcccaagtagctgggattacaggcgcccgctaccacacccgctaattttttgtatttttagtagagacggggttttgccatgttgggcaggctagtctcaaactcctgacctcaggtgatccgcccgcctcggcttcccaaaatgctgcgattctaggcatgagccaccatgcctggcacccctctgtatttcttatgcagagattggagggggtagagcaagcagccagctgaggtagaggagactacgaagcctgttatggccacagccctgaagggaatggaattctccaccccagatggggcccacgtgatcttctgtagatagtgtgggtttgagatgggggttccaggcatgagtcacagtttctcggggatgcgctttgaggaaagctgcggaaaaaaggcagtggggggatgggctgcaggggtcactaggaaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13151 - DNA, 25202 bp, Human
tgaggaagggaatatgtgtgaaggaagctaaaagcccatggggagagtattggactttctgtggaagggaagtttgaagaggaggcaccatcagggtgtacccacacagaccaaacacctctagaatcctgagtcagctttttcccctcactctgattcctactccccccttaatcaaaattccattgttcgctggcatcactattcccctagtcatgcagaaatgcaacttggagctcctctgtggctctatcataaacccctcctccattcaatccattgccatgactttattccatacaatttttctttctacgcacttccctcccctctgccatccccttgggccgggccctcccttcatcactcctgcaacaccaaactaaccactctgtttcttgtcttttatccaatcagtccagatccccaataccacaccggcgtttcttagatattattgtatcttgccacacctttcctcaaaagccttatttttcccaatgctttcttttctaatgtatgaagttctgacttttctttatgactttcatgatacccgaccagctggccccagggggcacaatggctttactccacttctccacacccaccctcatcctggcaagtgcaccatggccctagcacagtgctgatggaatctggaaatatcgccaggggatcatttgcaagactaacctaataaattacattatttttttcctgggatgaggaaacaaggacagagttgaaacaccttcccccagaaatgtgcttgcctctctcagaccacaggtaagggcttaatatgatgtgagaaagaggatttctggcttggaatgcaattcatttctattaacatttagaaagcatcttgggtgggcaggaatgaaaaccagacactgtacatgctatgacatagttttcaatcactaaggagatgaagaggcaagctatcagtgtaacagaaagcagaatgaaagaaagaggggctcagtaaagccttattcttttgtagaaggcatgagatcctatgaggtaggcataggcaagtattaccctcattttccagatgacaaaacttgcttacctgcctcagagtttaagtggcttgtttattgtcacagagctaataattagcagattagggtctcctagctgggtgatcttttgaatgcatgactttgccagcagccagcagagctatgaaacaccgagagaaacaattaagcatgcttgggaacagtgtgaatgggcatggagctgggaggcctcctgggaaaggtggcatttgacctgggaattgatgaatcccagaaaagccaatcagagaggtgtgaaaacaaaattaaaatggagactgggcctgaaaaattcccaggcaaacaaagccaaagaccttaaaaatagccatattcttgctaaaactacaaacataaattaaacttaacttgggtcaatttctgataaatgcttacaacaaataaaacttaaccccagccaatgataagcagccaactaacatatgattatgtgactagggactttccaaaaagttacctaaaaaatgcaattatgtaactgcaaactaagcaaataatgtttcattttgcttctataacttcccaataaatgcttgcctctgacattttgtcatcgcaacactaaacctttgtcggtctggtgctccccaattcatgaattgcttcttacttaaataaactctttaaaattttactgtgcctcatattttttttaatacagaagaaatgagagaaggaagaatattttagaaataaaggaacttcatgggcagagtcacagtgcaagacaaaaggagcagaccaagggcaagattgcttggggagtgaagactccctccctcttctcccctgagaagctgagataaagggggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggtaagtccccttttggagtcagaggcttagcggggaggggtgagggtggctgtgtgcaaaagtcctgcccccactggaggggagggaatgtaaggcttacagagtagaaaggtggggagagagggaggtaatgggagatggatcgagaaatggcacattcagggggacaggttcgttctgaagcccatctgggatcactgctccgagataaaaatatgtgtgtgggggcagggcaggcagcgaggtatcaaaatggcctgataaaactctcttcaatgcaccatttcctgaaccagcttctctctcctccttctccctccactcacttcaggaaggtggggaccaaagtgaggaagagccgagggaacgcagccaggcaggtggaatgggaactctctggagccaagaggtaagtggcctcctctcctgggtctggaatacactgatgttgtcactctcggctctaaaatcccacaaacactcatctactaactgtctgcttcatcctcacccaaaacagttgacattccttgttttctcatctcccaggagttaaagtagggctgggtttaggaagaattgggataattatttctgtataaagggactgtagcaccaacagattcattctctctcctcttcttcccatccctgtctctcaacccccatcttgtatctttcacctcttggttcctcccacagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgtaagcaagatcccagaccccctaacctagtcagccctcccccagccctggggcccaggcccagtccctgctcctggggcttctgcccaccctgacccttggggtccccatggttcttcttcctccctgcatcctaaccatttctttttcatcagctccccacttagttactcacctgatgttctttgcctagccccttgggggagcccttgtctttttgcctcttctttcccagctctgagcttttccccacaggcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactgggtgaggaaagcagggtggaagatgctctgtgcaagtgggtgactctgtgcctaaaatgaccatgactgctccaaaccctgtgtagttgtggaacaactgatttgcaccatcccaggtgggattatacgggtggatgattggagatgatgggggagtaaaagaggcaggatggcgggagctgcctgggtttgctcatctctcactgtttcctgttgccttgccttgggtacccttcttccgtttctcttggtccctttctgcatttttttctttatctaatttccatcttctttgcttctccatgtatccataattactccattctctccaacttgtcccttttagcaagctccatctttgttgcttcctccaaatgttcagtttctatcctatgcatggtgttttcctccacaagcatctcttcagcatctcctgcatttcaattcttttgtccatcactctcattctctaacctccaaaacctcagtctcccaatgactccttgtcaacattaccctctccctctcaccatgccggagctcccctctctcacaatgatctcttgcttcttgcttctccattgaaaccttgaaccatggcaagcaagttgacctggaacaagtgggatgttagagatggatgattggagatgatggatgatggtggaatgaaaggggtaggatggtggggtgagaagtgagagagggcttcatcactgtgcataagagaaaaagtgggtaagtacaaaggatatgctggaagaagaggagagctgagttaattggcagtggaagtaaagttcctgcagatggaggctggagaggaaaactgccaggactgagaggaaaaccagaaggatgagctgaaactgagtaggaggttggaagtgcgtcccaggaagttggtggatggtggtgaggatttgggaataagaacatataagatagacatgcatttccagtgcaagggaacctaaagaatgtgttgacactatcaattagaatctgggaaaagtaaatgcacccctctgccctctttttttgatggggaaagagtgggagggggcctctctttgggtaaatggatactttcagggaaggcacagagataaaaagaaaaaatatgctcaggataaattatattgcctacaatgggatgaatagatatcagggggactgagggtgaaaagagtgttagatattagagggtggatgattcagagagacttgcatttgattattgtagtgtgtttgtttcctgggatcaatggatgaggagtctggactagaagagtcttcccctgtttcttctctttgctaaacctttccttatgagttttcttctctccaaatccttaaagttctctagttccctgaatttgtctaatttcttcaatcatttcttttgtctttcatttctctcttttctcctttgcccatatcccacttattgctacctttctcctttcttccctgtcttttccttcttggtttcttccccacatttcttttattttccatattgtcttcttctcctcattctctttccctgctttcatcatttcatcaagttgatccattccaaattgggcagtcctctcatctttcttattttcctcatctctattcctccccctccttccatattctgtgggagtctttctttcctgtaagctccctgtctcccaccctccctctttgcctctataccagttgccactcctttaattctcctgccgacaaaaagagtcaaactctgtaaaatatttgaaaagatttattttgagccaaatatgagtgaccatggcccatgatacagtcctcaggagatcctgagaacatgtgcccaaggtggctggggcacagcttggttttatacattttagagagtcatgagacatcaatcaaatacatttaagaaatacattggtttggtccagaaaggtggaacaactcaaaggggtgggggtggcttccagggtacaggtgaatttaaacatttccggattgacagttgcttgagtttgtctaaagatctgggatagatagaaagggaatgttcagggtaagataaagattgcggagaccgaagttcttttgaagtcttatagtggctgcccttagagacaataggtgacaaatgtttcctattcagatcttagttaatcaaaagatctagctatgttaatgagatatgttaatagctaatagagatgctttacagatgcaaattttcctccacaaagaacagctttgcagggccatttcaaaatgtggcaaagaaacatgttttggggtaaaatatttttgttttcttctttgtctcgtaatgttatgccagaatcaggttagaaagtaaatcatgttacatgggttaaataaaacccatctgatgagaacttatgatatagggcatgactccccagacccctttgataggaatttggggcaagataaaaaaaatcagagtttagtcctcactcccatgcttcctttctagaggtccagaattcctggcacccaggctctggggaggagaaagccttccagttctacaactcctgcatggatacacttgccattgaagctgcagggactggtcccctcagacaagttattgaggaggtgagaaaagttgggatattaacttttctggatacataacatatgggaccaatgcatgcttagggctgccatttttttttctagagggtgggtcttcttcctagggccccccaatttctaggagggagatggagatggaaatggttatgccctatgaaagtatcaggaccttgggagaaggcagataaaaaaggatagatgtggcttcctagaggaatcgaagggcgcagggcagaggtcaggcagtagcagctgtgtaagagccgatccagacaatgggggatgggctccacggatccttatgctcagccccctctctctcctttaaagcttggaggctggcgcatctctggtaaatggacttccttaaactttaaccgaacgctgagacttctgatgagtcagtatggccatttccctttcttcagagcctacctaggacctcatcctgcctctccacacacaccagtcatccaggtgagggatgcactggcgaagacacagttggacctggcctgcctccaactctagccaatcatcccttagaggaaggttgcaggttgggaagagaggacacctgtgtgatataggaaacaaccctaccttaagggaaaattattgatgtgaaagtcagggacattagctgggggtgggaaatggagcagcagagccagtgctgggaagacagaagtaggcctggtctttcttactgttaatctggattagtctcagagccccttaaccagtcctcctatctctaggattgccctcattttatttactctttatttttactagagggaacttttctaaaccaagggctaactaactatgctactgtctgtatttaaatgcttgtcagtgacccagtggcttgccaggtcatcagaatctagtccctaatctttagtaaagctttgcaagcaccttgtgatctgacccctacacacttctccagccttatctcccgtacattccttctctcccttacccccaagccatgctgactcactgctgcttccaggaatattcctcagttctttgcctatgctgctccctgtgcctgcaaccatcccccacactgaacctggaaaacttacatgtttttcaaatgttggctttattatctcttccaggaagtcttcaccgacaccctagttatgagttaggtgaagccctgctctccctactttcgtttcctcatgctctcagcatttatcactctgtgttgaagattgtgagcctctttagaacaggaccatgctttattcacctttgtttctcaggacctatcacagggccaggcagctagaagttttgccaggtatttgtagtgagtgagtaactaaataaaaacactggagctatcactcttgtggttaaacaatgtaatgctatctgcatatttgggccctactgtcaaaagagccacaaaattaccaaaggataagtacaaaagaagaattgattatcattatgaggtgttctaaaatttagttttaaacagtctgctcaggagtttaactgatgtggcctttaggggccggttaagatctggttaaggagaggctcagagaggagagaatgagagaaggtgagctaagccagccttgaaacatggttaattcacacaagtggaggtgaagctatggggcgttggaaatgctgagccagggggaggacctggaatggtgtgattccttcgtggagtcagtgaggaggctgatctatttaattgaggatttgggaggcaaggtggggtgcagtgggaggtaaaagtgagactgaagacataaggttgagcctgattatttctaagaagccaggcgaaggtgaaacatttgacataatagaaaaaaaaaaaagagctactgaggccatccaactcttatgacaattgtgcatagagcaagtattttgatggttgtgcgtagagtcagcagttttgaaggtcagtctgggggtgttgaggaaactaaatgagcatttttgaggccctgagatagaggtagaaatggaaaggaagagccaggcacaaggatttaggcaacttcaccctagtgatgatagttcatgctgtttctagaggatttggtgactgattggatataaagaaagaaagtgggggattacacagtgatcccattgttttgatttagtgtgagtgggaggagggtgattatcatcagtgtgagcctggatagtctcttgggttaaaagcaggtaggaagaatggactacagaaagagaagtccaaagactgagggcagaagggagccagggaagagagagtactattggagagatgggagctagaccagtatggtgggccacaaaggaaagaaaaggagcttcaggaaggaggggtcagctcagagaagaaggaatgagaagacacccttggatacctagagatactttccaaacagttatggcagtggacacagactgcacagagcttaggaggaagataagaaagtggaaacaatgggcatagatgcttttttgttctttgaactgtggacatacaatgtagcaaaagggtcaagtgaaagtttttttcgagacagaaggaaaagtatatggctcaagataagagtgggatattgaaattggagaagaaaagggaaagagtagaagcaaagatcttcagaatagaaacaagggttcatcagggccagactaaggtgaaatatacatggtgcttacctggggtgctaatttaagaaggtccccaaaactcagtatcatgataaatagtattttattaaatattcctaaaaaatcaaaatcaatgcaacaatacatgatggaacaaaatatcaaacttttcttcattatgaatttttttgaaaaaagattatgctttttttcccaaaaaatgggacaaaattctgtgtgaatctttttgaaaatactaatttttttattcaaaatgaatcaaaaatacattgaggacttttcttgaacacatcatgattcttttcaaaattgactaaaagtatgtttttttggggaaaaaaagtccatgataagcaaagttttgagattttatttatcatacatttttggtagtaattttgattttttaaaatgttaattatttatcttgattactgagtttttttaaaaaagagtttatttgagcaaagactgatttatgaattgggcagcatcctgaagcagtagaggttcagagagctccacccaacaatgcaggcaggcagtatttacagaaagaggaagtgacacccagaaacagcttgattggttacagcttagcaattgtctttaatgggcatggtctgatcacttgacagcctgtggttgcctgaagatcagctggtatggctggctgagatggagctacctgttgcaagaatatactcctaagttaggttgcagtttgattactgagtttttggtacctcttagattttgtacctgggacaggttcctcacctcactcaccctggccctgttcctgagacaaggaatagctccttttaagatgctgattatcatgcttctgccttgctgggcacacccacactggttgtaatactcaccatctcttcccattttcacatctggactcttcttctcatgcccctcaacccttaatccctccctttctttgtactcttgcttctcttctgtccaatctttgtgtccatctcccaaggccatctcccatggtatattccccacctccccacacctgccctctccatccgccatgctccctgcttctctccagtctctcttgtgcccagatagaccagccagagtttgatgttcccctcaagcaagatcaagaacagaagatctatgcccaggtaagatggcacatggacaaaggccctgccctctgaggccaggagaaaagcagggacctctggcacctgtgactgacatttccttcctccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggtgcctggaactgggggccagaagactgtgggcatggggatcttcctctcaaacattacctcctttccttcttcctcctagtgcccttaataccttttcattctgtctctgactccatcccctcccccagttagcctgttctcttctttttctcacacccaaggggaagccctttccccttccttctcttttccttttccccctcagctttgtgtccctcctctaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagcaggttcgccgcaggtgggattggggagatcatggaaatggaggagagcctgagcaccgtagatcttgggggcaaaggaaaccttggggaaggcaggctggtaagggcctcccaggaggataagaggaacctgccacctgtgcgggcagagaagcgtggggtgggtggcacagagaggatggagggatcaagaaggatgtgtcttgggagcacgagtaagggaggatacacacgacatgaggaacgcagggtcagccaagacacggggtttcctgagagtagaacaccagccagtcaagagcctctgagctgtagaagatgctggaagacccagacacagaagacagttaagtgtatgtatgtctttttagcagctgaggactgtgggcaggaggaggaggcacatgagatgaggagatgaagatggtgaaggctggggatgcttaggggaagaaaggaagaggaggggccattcctcaggtgtggtgtgaagatgctggagctcttatgggaaacaatgtctaagagcatttctgctggtgtcaggaaatcaagggggtgttggggttggggacatgaaagagtggctctttgttgggctctctgcctcccctgatacctgggtggctaccacctgaaagcagtggctttcttccaggggcttggacctaagggccttcttcatggtggcagcagcatctggaaatcctttttgagggaggtagctgcccattcacatggcagtgagcaggcttacataagggtgcaatgcagccctggcaggagcattgctggtggaggagagagcagtcacagagaccagcttacttatgcttatgagatacatctgaggataaccagagatatcttgactgtggaagcagaatctgtttcatgacatgagtccagactccatctagcccagaactttctttccctgtgactttgaaggctgcctcttcatctagtttcttttactaaggagctagatcccaccccaacctacatcatgaaaagctctttttgacttgggtgcatgttaaaacacttattaatacagaggagaaggagctgccttcacgagtatcaaggtgacttacacaaggagaggctcttcttgaagcatccccagattcctggggtatatgtgtgggtctcttttgtctccatagggactttctgcagagccacatgatcttagggctggtggtgaccctttctccagccctggacagtcaattccaggaggcacgcagaaagctcagccagaaactgcgggaactgacagagcaaccacccatggtgaggagaggagcgggtgtatttgcccagatactcgaaaggagtatctactcttttgaggggtaaatgtcggcatctctctctcagggagggggccgtgatggtagatgcccctccatgtcttggctttccatagaagcaggcaagttggacagacaaagtttaacttgaaaaccaagatgccacgtgccagaccttcaggcacacatctcccagcctgactacctctctggcttcttgctgggtgtttgagctcaaatataaaactctgatattatcaaaactgccctttctttgtcatgatgcttacactatttgctcaggataacttggacttagagcttacaatttattgggatgacagagagatatgttacgcagtggccttccttatgtctagttgattccatgttcaaacgtgcttcacaaagagtttatctctgacatccagtgggatccactgggccacatgtagactttgtggcacagatgtggatatatctgaggaggggcctgggtagaaaatgcacttcactaaccagagtctacttattacataagatgcagagatgctcctttgctgagaatcttgaaatcccaagttggatatatccaaatgcaagcagaagagtctagtacattggatacatcccaacctcagtgaaggcctcagtttagtcttaaaaatcactggattttttttcttagtaatttgtggtccatttccctgccttggagaaactctctgctttggcaacctaaaattgctgtggaattcagagaagataaatgtattcacagggactggaatgtagttattgcttatcaagagctaatggtgtgctagacactctgaaatcctttagatctaaatctagatttagatttaatctttacaattccatgaggtaccatggatgccatttggttcctattttaaagaggaggagacagaggcacgaaagataaggaagttgctcaggtatgacagtaagttagtggggtgaggatttgaaccctggcagtctggctccagggtctgtgttgtttactcattgtgctaaaaaagcagtcttcctgaggaacatcacttgggttggagagtggccaagaagcttctgcccagcttttctcttgattcagatgaagcagaccagagccccaagttatcttaattggggttgctacaaaatcctggcaacaaacagctacctataaatgccagcaccatggcctcatggcacttcttggaggctgtaagagtgctaatgttgaggcttaggcttaaagaatgcagaaggcttagatgtcctgaagccattatcttttccactagggcacataattgtccttgggcttaaaagctgaactaatctctgccaacaaatagttgtgtgaccttggggacgccacttcacctttctggaacaatagtataaaagatggcacttaataataatgataatagctgctatacatggagtagtcactgtctgtcagcacttgggacaggttattcatttaaatcttccagaaacacttggaggtttttaatccccattttgcagaagcaaaaataggctcagaaaggtcaagaaactttctcaagaccacacagctcacaagtaagtgaacagactccaaaacagatgttttggctcataaagtcatgtttttaaccacacactatacaggattgagaaacaagtaggtgctacaaacaaaggttagaaaacttttttataaagggcaacatagtaaatatcgacttcgtgatccataaatggttggtgttacaaactactcaactctgtccctgtagtgcaaaaacaactgtacactaagtaaatgctgtgttcccaggggatcctggttgagacagcagatattcttggagttcccaagagggagagatcagggagcatttgaaggatcagtggcatctctgtgcaggaggcagaactgacaaaatgtctagagagaggaaggagttttctggtgaagaaaggggtatcatctcatggggacagggcaggaggcaggctggctaaaacttggtgcagggtgagggatcctcctggtggctctggttgagaggagaagactaggcttgctgtgtccactgatgcccctggagcatgctccaggtgtttgagaatcagcaagggagccagggcacctggatcagagtgactaggacaatagtggggagggaatcagagcaggaaggagagaaccatacaaggtctggtaggttgctgaaggacttttgcttctctctgtatgaaataaagacatgcagagggatttatctcatttatgttttaaaagaacatattttaaggttagtaatgggatgtcctgatgatgagtgatgtgagaaggagaatggaatcaaagacatcacctagagtttggccttgatatgatcaaaatgtttggttttattcagtggccattaattaccgacttctgatcatattcttttgaatgaattataatttatagtgcccttatacagaaagatttctaaatctcattattggcccatctttggatgattagttttgaatagagttatagtcaatgaaaatggctgttaagtcaggttttcttttatgaaacttgggaaggtgggttttgagaagtaaaagcagaacttcacatttgtgatgattaaatgtgaatgatttatattcagcccaacatctcaatttattcaggtcttccagctttggatcatttgcaattttattcagtgtatcttcgtccagactactgttaagatcctgaagggagaagggcatcgggtcaggttattgaagacctagatatggatttatgcattcatttatgtaacaaacatttattgagaacctagtgtacttcaggtacttctccaggcacttggaatgcagcaatgaacaaaaaagacaaataaataatcctgccttcagccacatatcctggtgaaagaagaaagacaataaacaaactaataaaataataaaatatgttaggaggtgttatgaagaaaagcaaaacaggaaatgaggaaaggaaatgctaagtgagtggtagttaggattcttagtaggaatgtcactggaggtcaagttaacttgaaatcattcaccattgatgtttacttttgattcagccagatgagactccactcaaattgcactatcattcaacatcagtttctctatctaattcacgaggactcaatctgtgtttttcaagcctggctaaatcaagataatgccaacagagtggggtagtgccttagagtacttgaaaggtattatttcacctgatccccaaacctgtgaggaaggtagactagatattgttttcatttcgacaactggtgtcactgaaccacaggggtttaagttaataactcaaacttagtaagtgctaatactctattcagtggtaggatggtagtggtgcttgaggatgtatttcgtctatagatgtgttttgttagcctgtagaatcttttgcaaactttgaattaatcaccaacattcaaaaactaggatatggcatgccagcattcaggtttctagtgtgtgtgtgtgtgtgtgtgtgtgtgtgtgtctgtgaagcttgggaaacactgggctacccttctcctgtggcaacaactgactgtcgctacatgatgcagctcagggctgggtgcgctctctgaagccccaccacagcctgtagctctgatgttgcactgctgttctctgttatgcctctgcatggcccctattggagtttgcggcttccggtctttcatatgcctcagttacataagccttttagccagaagaatttttatcattttggcattatttttcttcagtgatcctatcatagcccttagtagttacacattattttccaagtgttaaaaaactgtttaatgattcgttccacaattttgtttagaaattaacattaaggattcctggttggctcgtaatccctaaaatttcctttcatcctatagaagattggtcaaatttttgcttccctccggactcttagaatctgtcctgatttctatcatttctcaaatactatctgtggttctgaggttgtatatggaactttttttttctggtgccctaaaattagtccactgagtttcattatcttgggtttgaagtatttcttctattgtttatattttggagacttttttttctcgaattctatttctctccctctctttctctctctgactctccctttgcagtcaatgtggtatacactaccattccacatcttgagagagagctgtagtagtggtctgaggtggcgattgtattatccagtagtcaggtcccacggcaaagcatgttggagaaatgatcaggctccagcaaagggcatcaggaaacaaatcaagaatgagaaggggtgagaagaataggcagatctacacttccaagctcaagtggtctccctgctgatgctggttgctgctccacatgtagcaactgtctggtaagaggtattcctggagccaagcttgtccagcagaatgtggctggcagattctcaacttggcctataattgctttcagacccggacttctttttagttcctgttgtttcagagctccaactcatgcagcatgagaagaatctgagcctcttctctttatcagagacaaggttggccaggtgcggtggctcttgcctgcaatcccagcactttgggaggccaaggcagatggaccacttgagcccaggagtttgagaccagcctggccaacatggcaaaacttcatctctggtggtagccacctgtaatcccagctacttgggagactgaagcagaagactcacttgaacccgggaggtgaaagttgcagtgagccgagattgcaccactgcactccagcctgggtcacagagtgagactctgttacaaaataaaaataaaaataagactcaaggttagcagacctcaaggttcaatagaacacagatgtggacagccaggcctgcagcaacctccaaaatgataacctctttaactggtgggttcgggagttttttcttcggtgactaccagactggcctctttggtctgtttcctgtagtgggatgcacataaaccccctccattcccaggaccagcctagctcctgcggggagagtattagtggcagccttcctaccttccccgtgggcaggtctttgggaagtaaaaaaatcacaggaataaagttttgaggcttcatcctgcctaacccaaattagcatattagctggtatttatcagttccagctcagctttccctcaggccagctacctcctcctgtccctgggttccttgagtgtgtgtctccatttaccgtgtcatctctgggtttatgccttggtcaagtttttaaagccatgcaagcccaccgccaagaccttctcagcatctgtctcttctgtttctcattcttgaggtcctcagctggcactgccctcttggatgtttgtccatggcctcctgcctctgcagtgaaagccctccaccttcctgttctattctctcctctctgacttggctggaagtcttccagctctatgaatttatacactgagtcttgtcttgtgtcctcttttcctagcaaacaatatggcatctaaaacccagttctactctgataattttttctttacaagatgctacagtatgatacaccatgcccacctggagagaggataaaggtgatggtggtaggacagaatttccatccgcaatctccgttttgagcaaagaagcatggaggatggaagtcattgctgggaccccggagtagagtggtggtgggggaacagggggaacatcagactgccgaggtatgagtttgggttctcatcttcttcccaggaggcttttgaaaccccaggatgatgcctcctagaggccttgctgtcaaattcaataggcaataacatgaaggatttactcagccaggctcatgagaccagctctgaggaagctgtgcttttcttgtactgatcggtgatgtgcatcaccctaagggatagtaaacagatgaaacccagaaagtccagtcaaaagagcaccctctgggaatgaagatctagtgaagactggggagacagatgaggaaagagtcctgaacaggagccactcattccagctttgtctccatagcctgcccgcccacgatggatgaagtgcgtggaggagacaggcacgttcttcgagcccacgctggcggctttgtttgttcgtgaggcctttggcccgagcacccgaagtgctgtatgtgagagctcttcccagcccacatccctccaccccttcctacccaaagcagccttccctcttctattaactttgactttctcagtggtgtgtgtgattggggaattgggcagtcagagaagggccactgagagagggaacccaaaggcctgctccatccctggtgtggaaacagttcagcttcaggccacaaattctccatgacatgctctcacttggacaagtcacccaactttcctggtcttgtgtttcttcaaccatcaaatgagaaaatcgagccaggctcggtggctcacacctgtaatcccagcactttgggaggctgaggtgggcggatcacctgaggtcaggagttcaagaccagcctgaccaacatggagaaaccccatctctactaaaaatacaaaattagctgggcgtggtggtgcatgcctgtaatcccagctactcgggaggccgaggcaggcgaatcgcttgaacctgggcggcagaggttgcagtgagccgagatcacgccattgtactctagcctgggtgacaagagtgaaactccatctccaaaaaaaaaaaaggaaaattgaacactatcatctctaagtctcctccctgttgtagctaagatttttttaacaacacatgacgtgacatcagaacagatgacataatcttgaagagggcaaataaatcaaataaatcaccactgaatactttctgagtacctaccacatgcctgggactccttcaagaactttgcatgaactacgtcatttagttcctattatgatcctgattttatacaagagggaactgaagcaaagagaggttaagtgacttgcccaaagtcacacagttaccaaaaagcagagacagggtttgaactcaggcattctgatgccagagcccaggctctcgatattgcctttcattttcctccaggaaaggatttacatgagatggcaggtggctggggaagcagtgagtacacactcacgttgtgaaggcagggagacttgtgggggacttgctgggaagctgaagagctcaggaggatgaggagagggagtggacggtttaaaaaagacagtgtgagaacaagagccctgagccagaggagaaaatgacagccctctcctccctctgatttctgagaggtgttcctgcccccaggagtgaggacactgtctttctcctgtgtcaggctatttccccatggaaaggaactatatctccctgatggccctcacggatggccaggccccaccttccctttgtgggcttggcactgccttcctttctccacagatcctttagttgctttagttgagctgctcctctagcagcagctccagcccaggcagctccttggggccaagcccttttccaagggtcagaagctgtgggcagggccaggctgaggcctctcctgatcctgtccccctgtccctggacctcactcccacaggccatgaaattattcactgcgatccgggatgccctcatcactcgcctcagaaaccttccctggatgaatgaggagacccagaacatggcccaggacaaggtcaggccaggcgtcctggctggtgtgggagcctgtgcagggaatggagtattggaacaagcgagatggggattggaagcaaatgccaaaggcccccccaggcacatgctaagtagggaagccactgggctgtatactcacactggcaacaatgtgagaggctgggacagggcaacgagtgggagaaatttcctctggtagactcggagagtattcctagcctcttctgtgtctctctccaggttgctcaactgcaggtggagatgggggcttcagaatgggccctgaagccagagctggcccgacaagaatacaacgatgtgggtccctgtgttttccagctccttttcagtccttgacttctcgtcacttctctgaccctcctaagtctttgttggacaatcagttttccctgggtgacttagctctgtccttactctggtgctggctggggttgatggggaaatatccacactgtacgtcttgctggcagaagaacagaatcttttcaggtcccaacgcatgtgccaacacacatgcatgcatcctgtgacttgtctgggcgtgttcatctgtgtgctgatatgtgtaaagcctgggtgtgctgtgtagtgatgccattgggctgctctctcctaatccctggatgcctgcctgtcagggcttgcctgtttggggtcaaatggtcccattggtgtttgtcagcgtgcatctatagaagtctctgtgtgcccaagtcacctcctgcctcttccccagatacagcttggatcgagcttcctgcagtctgtcctgagctgtgtccggtccctccgagctagaattgtccagagcttcttgcagcctcacccccaacacaggtatgacagcaggggagacacaggcactccatcccagagagacccatccatgattcacaggaaaggaagccagggctcagggcaggcagcatgaacagtaatggtagttgggagggactgtgtaggtctcagggtggcagggcaatacgtggtgggggctggagttcacatgtcctcttcccacaggtggaaggtgtccccttgggacgtcaatgcttactattcggtatctgaccatgtggtagtctttccagctggactcctccaacccccattcttccaccctggctatcccaggtatgggtcactctgtaagggtaggtagggagtttcccaagaggggccgacaggtgttatgatggatgggacttacggttggagaattggggtcacaaatgctgagagattctgggggtcaaataagcccttgtctccctagagccgtgaactttggcgctgctggcagcatcatggcccacgagctgttgcacatcttctaccagctctgtgggtaacaggggccactgggaggtgggataatagggaacctaagggaagaccacaagggaggcctggaggggaaagggaggttatttgagggtttgaggtggggcagtcctgggaactttgccatgctcctgggagctgattcagtctgtggtaccacccacatcctcacctaggcagcaccaaccctatgttctcttgctgtatgttctcttgtcccattttcaacagtactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggtatgcaagtgtcaagggccacagtttatgtgtactggcagactagaaaacatgtcctcaagttttccttccaccattcctgacacaagtacagttgcatggctttctgcccttcgcatccccactgaatagacggcaacttggggatccccctcctaccccagagatcctccattttaggacatctataggtcttctgggaagtactctttcttctggctcagatcaactagtcagtgcagaaccagtgagcaagggccatgggttttgggtactgtgtggagggactttcaaatggccacaggtctagagcctgatggcccttctctacccacccctacccaggcatacagcaagaggctgttacggcaccatggggagactgtcctgcccagcctggacctcagcccccagcagatcttctttcgaagctatgcccaggtaggcagcggccacctcccgccacagcttgctttatgtcagttgaacgccttattactgaagctcatggaagtcccctcttcagacactccgtcaaataccccaaaccctcttctgcagatgtcctcactgttatcttttctcttccctccctaccccttggaatcacccctcagatgactacaggttcttctacctaattcagcacccccacaactcaaaaggtagaaaaaactctattcccaagttcctccaggagaggaggagaccaacttttttttcctctcatacccccaaaatacagatgccttaaaaatgagcctgtggttgggcacagtggctcacacctgtaatcctggcactctaggaggccgaggtgggcggatcacttgagatcaggagtttaagaccagcctggccaatatggtgaaaccccgtctctactaaaaatacaaaacttagctgggcttggtggcgggcgcctgtaatcccagctacttgagaggctgaggcacgagaatcgcttgaacctgggaggcggaggttgcagtgagccaagatcatgccactgcactccaggctgggtggtagagcaagactcagtctcacaaaaaaaaaaaaaaagcctgcgacaggctgactgtgtgccacattcctcttcagacacctgaccttaggtgtggcgcccacttgacatcacctccttaagcaccctgtactccctcaacagactcaggtgccaggtcttcaacacgcttagattagacttcaccccagagctcctgcgctagaccctgcctctctgtcattgataaatggtatcattacacagcccaggccctcctcctggactcctattgccagattaaatgaactatacatttcaaatgctccatgtggcccttggggcacttgatcccctggttcccctctttgtctgctgtccctgatcaccccttgtcaccgggtcagctttgtcctgtggaccctcccccttcaatgacctctcttcctgctcaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaatgacttgttcctgctatgttctatgcctggaagtcattaactgtacgggagaaaaataccctgaagttagaaaagataagagggagaaatgccaaaaatgtttcatggacacaagaaaaggaaagaatcaacaattggtgacctggtgggtttgaaggccacccagtggaccaaagattggacaataaagcagtctagttggagacgagaagggcttggattaagtatcggaaagctgctcccaattgttctcaggattttatcgttattttattgtcattgcctcctgcctctaatctgctgtcctgaacaaaaccaggagaggtgtgggagagaaggatgtgggtctgctgtctctggccctgggagatgaaactccgaacctggagaggcagtcagttagcactgatggcaactggtatctctgctgctgaaccttgagatacagtgatggtgatcagaggcagagagccatgcctgcatctcctttgggagttgtgacctggagcccaggagggagggagggtcagtgagtgagcatgaagcagagttggatatttgggaatgtccgcctcaatggccctcctgagaaaaccatgacactggccagactaaagcagaagctgaggtggaaagagtgcttgtgaacagctgccgtcttggacgactggtcttcttcctgctgggccatgtccaccacctgccacatctcacccactgaggaggccacaaagtgctcttcgaactgttcttgattctggtctggaacaggggaaaaggacaaggactgagccctgaccctggcctgaaccagaaaggagaagttagaataggaaaaacacgttgaagcctagggctgcagtcccaattgcccatatccttagccttcaccagagaggggatgctctttctagaggttttttctggtctgtgttcaatcacagccccaactcaaacacacacacacacacacacacacacacacacacacacacacaccattcctaaggttagctgcctcctctagggtttcaacactgggggagtcaggggccaccttgaagcatgacaaaagccagccaaatgcaccatgcttacacacacagaagttgcatgcaagctcagctggcccatggtgagccgacactattatttcacatgataaccatcagtggctggagttaccccccataaaccagacctatgtcaggtctcaccctagcctcatcagtgacctggggcctggcctcacacagacctcaccctgagcctccagactctcccgtctttttttctacctacctgaagagggtgttttctctgtatggctcctgtctttttttccacctacctgcagagggcgttttctctgtctggctcccatctttggggcctgggctcccgttcagaggcttcacctgcagcagcagcaagataggaaccaggaacactgccctgcagagctggggggccaggggaggcatggacctgcccacccactgcctttggccgccccctgctcccagtgcccagcaggatccgtgcacctcctgccccattcctgtcctggcccttaaccctttccaggggcattttctcccctcaccttccataggacctctgacttcacatgttctgtgacatcacagccatgggcctgaacttcattccggctcactagagcgttccaatggcgaggcacaagaatggagcacagccagcagggatggccgaggcttccaagatgaccacagtgggtcattctgtatttagcagaaatgacttaacagcttgcaatgtacattcatatccattacaccattagatccacgtagaaaccaggactgcaaaatcatagtgttctcatatctattacattcatgaggaaactgaggctcacagaaaaaatgactctctcactcaaaatcgcccaaatactaaggggcagaaaaggactcttgattaacttttacttttaaatatgatatc

SEQ ID NO: 13152 - DNA, 57875 bp, Human
  misc_feature (1)...(57875): n = A,T,C or G
ggtctattttaatccataatccgcaatataagatactatggctccccatcaccttcagtataaaatctcaaactcagcctggcatgcaaagctccttatagtctagtccctacctatctgtccattcatgtctttctgcatgcacttatatatagcctacattccagccactttggatttctcatctgttctatagtctttcaagcttccatgccctccttcacagtttcccccacacctgtaataccttccccctcttccttcactcacaccttcctgacttgcttaatgaatgcctacacttccttcaaatggatcaaaagttaccacctttgagcacctttccctgaaactattcctccctcttctgtgctctcagagcacttacttgattgattataagcactgttctgtcattttttgttggtctttcttttaccccctctgcaaaatgaggtcatcttcataccctgacctctagcatattctagatgcttagtacagagtgaaggaaggaatgactgttacaaagggatttaaaaagaaagtacatttctgataagaacatactttgggctgggcgcagtggcccatgcctgtaatcccagcactttgtgaggcaaaggcaggtggatcacctgaggtcaggagtttgagaccagtctggccaacatagtgaaatcccgtctctactaaaaatacaaaaaaaaaaaaaaaattagctgggcgtggtggtgcgtgcctgtaatcccagctactcaggaggctgtggcaggagaattgcttgaacctgggaggcggaggttgcagtgagccgagatcacaccactgtactccagtctaggtgacagagcgagactctgtctcaaaaaaaagaaaaaaaaacatactttgaataaatttaagattgactatgcgtgatctggccaatctagaacaaatcttcacttttaaaggttaggtggccacaagaaatggtgctaatggacagatcagaagcaaagaacaagtttaaagagctagggcttagttgtgttaccccagatttggtgcagtataataaaaacaaattttatatcttagaaacttgtcttgtcacagacacatgacatttatctccatgacttaatgaatgccttataaagtgacgcagtgccccagtggataagacacgaaagcaaagagaaaagatgagtagcaacttataacacaggatgtagtttgtactaaagatgtgtatatcagaacaactaaatttcccttgtagaaagggaaacattcttttctgattaaaaagataggccgggcacggtggctcacgcctgtaatcccaacactttgggaggccgagggggttggatcacctaaggtcaggagttggagaccagcctgaccaacatacagaaaccctgtctctattaaaaatacaaaaattagccaggtgtgatgatgcatgcctataatcccagctacttgggaggctgaggcaggagaatcacttcaacctgggaagcggaggttgcagtgagccgagatcgcgccattgcactccagcctgggcaacaagagcaaaactccgtctcaaaaaaaaaaaaaaagataatagatattaaaacagaatgcttagaataccttgaaaatcacaacaatataaacctcccccaaatctaaccacctaaaattaactgttgttagttccttggattttttccttgaagtcttttttcttgtatgtatgtccttttaaataaatttctaagttaatgttgtatatattgttctaacctgttttttatattaatgtgtcatggatattttgtcatgttcataaatactcttccacagcataatttttcattgctgcactcatttccatcacatggactaacccacaggttaaccaatccccattgtttcagttttttttaatgcaaacagaagtgtcgtagtgtgcatactaaagaaaggatgatctcttatctccctcctgtttttctcaggttttggagccctctcttaagtcagaactctgtcccaaaaatcttctgagtgtcatctcaggactttggttatactcatggcacgatggccaactttcaggagcacctgagctgctcctcttctccacacttacccttcagtgaaagcaaaaccttcaatggactacaagatgagctcacagctatggggaaccacccttctcccaagctgctcgaggaccagcaggaaaaggggatggtacgaacagagctaatcgagagcgtgcacagccccgtcaccacaacagtgttgacgagcgtaagtgaggattccagggaccagtttgagaacagcgttcttcagctaagggaacacgatgaatcagagacggcggtgtctcaggggaacagcaacacggtggacggagagagcacaagcggaactgaagacataaagattcagttcagcaggtcaggcagtggcagtggtgggtttcttgaaggactatttggatgcttaaggcctgtatggaatatcattgggaaggcatattccactgattacaaattgcagcagcaaggtaagctagaatatggacttggaagatatttcttgtgtaaacacaccatcaccaccaccgtcaccaccattagctggataacctatgacctttgggcaaattaaagaactagtgacagatgaatacctcatttcagtttccagtagaccagctgaagggaagagattcacatttggtgggtcttttttggttgtagcccatcttttgtggtcatccagtctagcggtgtccaaagtacagtacatataaaacaatccatgggattataagaagaaaatattagagatcatgtttatctcatcatttaaaatttctattttcatacattttcagatatatttcatattttaatatagctgtgcagatatataatacataaagaaatcatgcagtggccacatatttaaaattttttgccaggtgcagtggttcacacctataatctcagcactttgggaagctgaggcaggaggattacttgagcccaggagtttgaggctacagtgagctatgatggtgccactgcacttcagcctgggtgacagagtgagactgtttctctaaaataattaattaatggataaataaaaataaattttaaaaagtttactgataacttatacaatcaaaaaaatctgatggctgctggaccaatttaaaaccagacagaagccacatggtaatgcccctgaagattgtagggcttagattatagtaaaacttagattatagtaaaaaggagttattttcttacaataaaggcatagaaagcttacattttgaggaaatgacaaaatatctaaccaatcttgagaagcattattatttctagatcacacagcttttaaaaaaaggaagttttgttgggcgtggtggctcaagcctgtaatcacagcactttgggaggctaaggggagcggatcacctgaggtcaggagttcaagaccagcctggccaacatggtgataccccgtctctattaaaaatacaaaaattagctgggcatggtggtgtgcacctgtagtcccagctatttgggaggctgaggcacaagaattgcttaaacccagcagaggctgcagagagccaagatcgtgccactgcattccagcctggttgatacagtgaaactctgcctcaaaaaaaaaaaaattaagtttttaactcccatcattgtgtaacaatatattcaatattctaattcaaatattaatattacacttttgaagccctggtgttctttataacctcatttttttaaacttttattttaggttcaggggtacgtgcgcaggtttgttatataggtaaacttgtgccatggggatttactgtacagattatttcatcactcagtatccaatagttattttatctgatcctctttctccccccaccctccaccctcacgtaggccccagtgtctgtcattcctctctttgtgtctatgttttctcatcatttagctcctgcttgtaagtgagaacatgtgatatttggttttctgttcttgcattagcttgctaagggcgatggcctctgactctgtccatgtcctcgcaaaggacaagatcttgtataacctcattaatattcttcaaagtaacttttttttctgataacaaaagtaatatacgtatgaaatttggaaaatacaggtaagctccaaaaaaattttaaaataatctatgatcctccatctcctgagaataaccattaatgttttcattatatattaggttagtctatttgtgtatgtgtgtgtatacttttaaaaaatggagtcatactgtattaatccatgttcacactgctctaaggatctacctgagactgggtaatttatgaagaaaagaggtttaatggacccacagttcagcaggcttaacaggaagcatggctaggaaacctcaagaaacaggatcatggcagaaggcgaaggggaagcaagaaggtcttaccatggcagagcaggagacagagaaggggcaagggccacacattttcaaacaaccagatctcgtgagcactcactcactatcaccagaacagcaagggggagatccgccccatgatccaatcacctcccaccagacccctcccctgactcgtgggaattacaattcgagatgagatttgggtgggaacacagagccaaactatatcacatattgttttgtaatattttgtcacttcatattgtgaacattttccatgtcttaagtataattcttcagcatcatttttaatggccacataatattaaatgatgtgaatgtgccaatatttttaagcaatcccctagtgctcaacattaatttgtttacatttttagctattataagccatactgcaatgaccatttgtctactcctttacttttgcatatatctttgattagtccttgggataaattcctaggagaggaatagttgaattcaaaagatgtgttgttttaagacttttgatacatatctttgtggccttatgtaaatgattaaatttttatgagttctctcaccaagaaattctggaaagggaaaatatggaccaaaaatgagattctatttattttataactgaattttagactctgggaccctcccctaaaagtctgttcatctcttttagtcaagactgttgacagcttttccacaacagccagcagacttcagttaccattatccacttttttcatgcattttatttcccctgtttctgcaatacattccttaaaccaaataccaactcctccctctatacctgttttccataactatattgggattactggtatatctatcacttccaggtccttttcaggacttgtcaaccatatcatctattcttgctccatgcaaaaattcttcgtcagtccctggttttatgtatgtgtatctctctctctctctctttcatacatactccgacacgctacacattctgctttcattttccctccaccccctggcccccatgatttcaaggttttaaaggaaattagttgttttttgctaacagcattattatgttttacattggaaataaatataagcaggaaaataaaataaagaagaaaattaaaatcacctgtctttccacaatccagagataaccatttctaattgcttttttttttttttttttttttgagatggagtcttggtctgttgcccaggctggagcgcaatgggtgtgatcttggctcactgcaacctctgccttctgggttcgagcgattctcctgcctcagcctcccgagtagctgggattacaggcgtgtgccaccacgcctggctaatttttgtgtttttagtagagacagggtttcaccatgttggccaggctggtcttgaactcctgacctcaggtgatctacctgcctcggccttccaaagtgctggattacaggcatgagccaccacgcccggccctaatttgttattttttaaaagttccctgttctttggttggacacaaaacctactgatagctgcataagtgatcgagtacatttggtttttagggtctctgcttgtccagtcttagacttacttttggtgataatttgaagatctcaggatccaagtgcatcactgaggttcagactcagaatgaggggcgattcacccagcccatatgtttgtcaaaaggaggttttaaaattttttgttattattctgtaaactagtatttaatttgttttccaactgattatgtgactttcaaaagggtttatttcacaaataaataagaaacagccctggtcagcttaagattctgacacaggcacagcaggtgcctggcctttcagcagattgcaggatatcctactgagggctggtgttgctgtgcaccatgaaagggtttcgctagccagagactagcaaatttccttgtcaggtctgggatcagggagccaatcttcaatcctgcattgcagtcaaccgaaggctaacacatatcacagatgtgtccctacatttggtacttatgaggaactgtcactggatttttaaaaaattttaatgatgtcctcacctccctttgagtatgttgatagtgagcccaagtaaagtagcatgcaatttaatcttttattgtcaaatagtttccagtctcaaagcaagtactgtcatggccatgtctgaataaacaaaggagaactgttgccttaaagtgggtgggcatgtgtctttttctcagtcctaaggattctggtggatattggaattaagatcatagtcattgggaagataaaattgaagataaacgctggggaagagtagcagtgggacagacatagaagcaacgaaaagtttgggactaactctagagagagtgtagtcagttcttcattattatgagattagttatctcactcatcaattatctaggcccttaattttgtgcatccttatcaccaatttccttttttctgccattttcccatttctgagctctctgctcattattgatagggactttgagactggtcaaagagtgctaaattcatatcaatcgattttacttctgataattagtttcagtaaaaagatggatagaaacattgttgaagcattactttctttattttacaatctgtgttctttcattaccagtactatccactttatttttctatggataatcaagacttggctgaacatagttgaatagcacaggcatgaggtagaggttggtagaggataattttattttttattgcaatactcggaatactttgtatttgagtgccaaatgtatttgtattttagtaattaatctgtttatcatcttataaaaatactaataggcattatttctaaaaaatatagtgagttacaatgtaagtatcctaaagcaatatgaaaagaaaggatttttaaacaaattatttgggaatcattaaatagcaatgtggaaaaaaataatttatatctgtcctcataccatacaccaaaataagtttcagatgaaagtaaagattaaatttttaaaaatgaactatagataacttttagaaggtagactaggcagtggaagaaattacaaaggaaataatagacaatgatatagaatactttgttcaaaaataataaaattaaaagaaaaaggcttataaaaatattctcatttgtatcaaagaaatatagaaggagtttcttcaagtttatgtgaacaatggaaggctaatagataaatgaacaaaggggttttgacaattcatgcaaagcagattatgaatattaaacaaatgtgagcaccggcagttaaactagtgcaaagttataaaacactaaactaaaatagaaccaaaaaagaattgataacacttactgccaacatgttcataccttgctattgtgagcgaaactatcaaaatccttttggacagaatttggaatgtatgtattcctggagccaggaaactgtcctctttaaccaaggaactgaatctggggatatacttatgcagaacaggtaagagggtacagaacaactattagaacttataataaaaataggaactacatgaaggatacatgatatgtgaaaaagtagaaaaaattagacatcacctgccatttttacacagctgtaaacatgaacacaaactaggagggtagatggcaagtgggtgtgggatgagctttcacataaaatctgtgtttttctgacttttctgatctttctctaatgtttccaatgtttaacagtaactaaagattgagtaaatagggtaaaaaagacacccaaacagtctaattttagtagttattttattaaaaattagggtaatttgggcttgtgtaaagctgttcaaagacgtactgctcagttatgttcttgccccagagtccagtaataatactttattcagcccccagaattgtcaaaatgacactgaggtttttttatttttgtttttgtttgtttgtttgtttgttgttgttgttgttttgagacagagtttcgctctgtcacccaggctggagtgcagtggcgcattctcagctcactgaaacctctgcctcccgggttcaagcaattctcctgcctcagcctcctaagcagctgggattacaggcctgcaccaccatgcctggctatttttttttttttttgtatttttaatagagacggggtttcaccatattggccaggctggtctcgaactcctgacctcatggtccaccctgcctcagcctcccaaagtgctgggattacaggcgtgaaccaccacgcctggccaatgatactgtttttgtcactggacccctaatgaggaaaactatcttacaatatgccatcgatatctgtgtaccacgtgtgctgcatgtatgagcccatggaggtgaaagtgagatttcatgagccacttattaatacttgtcctctatagaaaccctaaagatagttaaaatagccaacgctatcacttgctgtttcctcccaaatctcacttggtatcatgtgtttcttgggtgattttaaatttgtcagctatttgtatttgagagagatttgcttttatctagcatttattcaatttcagtagagtggaaacctttaatactgctcatatcaggagaacgggatgaaggcccacggcataaaccaccctcattttatatactttttgctctacgtagttatattttgaaggttaggttttagcaattgtaatgagaaaacattttattaagaatctacaggatttcttttctcttaaggtagagaaaattagagaagagggaagtgtagctcacttctagaggcagataaattgtttcatcaatgcagtggatggtgagttgatttgctttcaagaccagagtatctttgaagctaactcaacactactttgttccatgttctgcaaacactggcttttgagtgatctgaggagaatctctcatgacctttcacactggcatcatttttctcactccgtggggctcttagctctttgatatttgtttcttacctgtgataatactctggtaagaagggggaaaggagaagcctcaatggattacattcttttttaaaaaagtttcatgagattaaagcacatattgattgaatttttgaagtgctttatttaaaatagcattttattcattataaaagtgatataggcttatggtaaaaatagtttttaagacagaaaacaatagagaatatgaagcactaataatgccaccacttagaaatgacccttcttaaatttctggtgcaaaaaaatattcaaactctaaggaaaaagaaacttgaaaatactacagctatataagtaagcatatcatgactaatgactaatggctctctcaattacttttgagaggcaatgtcatataggagagaaagcactcttcgtaaaattggccaatcctgggattctaggcccagttctaccagttatcagttatatgattttaggagaatttacttaaccaccctatgccttagttttttcatctttaaataactataataaggccatacctgtagggttgttgtaaggattgaacatatgatatatgtaaagtactatgctagtgtatggtatatagtaagtcctcaataaaaggtaaatattaatgtaagtagtatgcataatgaagttcttaggagagtatcattaaaaaattcattagcagcccggcgcagtggctcacacctgtaatcccaacactttgggaggccaaggcgggtggatcacctgaggtcaggagttcgagaccagtctgaccaacatggtgaaaccctgcctctactgaaaaatacaattagccagacatggtggctggtgcctgtaatcccagctacttgggaggctgaggcaggagaattgcttgaaccccagaggcagaggttgcagtgagctgagatcgtgccattgcactccagcctgggtgacagagcaagactctgtctcaaaaaaaaaaaaaaaaaaaaaaaaaaaaaaaattagcaaagattcactgagcatctgcaccagaaattaaaagaggaataaaataacaccgatagtgggtgatggggtagggatagttgcatagagacagacgggtaaattgactgacatgcaagcttaaggtgaggaggtaggactgcaggagtggtaggatatgttttatttggaggaaggtatattggaggcttctgctctgctttatttcagtgatttaaaaattgatacaaactaatgtttatgaatatttgatctatagttccaaggtacataggaaggttctatcttttgccgggagacagagggtaagggtcatcctgggtgacgatgaagttggtaccttcagaatggccttgtagagtggtcccttctgagatctcttcaagcttatttcttgcttgtgtgcctagatacttgggaagtgccatttgaggagatctcagagctgcagtggctgggtagtggagcccaaggagcggtcttcttgggcaagttccgggcggaagaggtggccatcaagaaagtgagagaacagaatgagacggatatcaagcatttgaggaagttgaagcaccctaacatcatcgcattcaagtaggtcaaggcttttttttttttaagaagtagacctattttctttcccccaatatatacacacaagtttctgctttgagagatatttcaaaagcattctctagacttagcactgtgctaggtgctttgggagggtatcaaggaactattaaattggagttgtgtcctcaggcatcttataatccagtggttcattttgccgaagtatgtgcaaagtacatggaagtacatggaaggggcatgcacatggggcaggaagggaaaatgtgggttcctgccaagcagtcagatctgctgcatcaacctcatttatcaatgggataacagaggttacttcaatatcacctgaacagcctaagattcacttaacaaaacaaagttggccgggcgcagtggctcatgtctgtaatcccagcactttgggaggccaaggcaggcagatcacttgagcccaggagtttgagaccagcctgggcaatatagtgggaccctgtctgtaaaaaaaaattttttttaattagctgaatgtggtagcacaggcctgtagtcctacctacttaagaggctgaggcagggggattgcttgaacccagaaggttgaggctgtgttgagccatgttcatgctactgccctccagcctaggtgacagagtgagaccctgaaaaaaaaaggaaagaaagaagaaagaaagaaagaaagagacaaaggtaacatctgaagtgatcaaagaacaatcaatccttgtgtagtagatacatattttgtattaggttctgttagcatcccttcttaaacattaacgtgtaatggcaggtacctttagagtatagcctctggttttcctagatctccttccaagcaatgtcaaacattcagctttcttaacctaatgattgttgagttattgatagtaagtcatatgttatattcatttcacaaagtgattgttttcaagagtctgtgaacatatttttctagcctagatgattcttttcataatattgcctgggatccctaacagaaggaggagagtcaaagtttaaagggtggaagtgctgagctctaaatagatattatctcttctgcctgaatctttcccttgagttctctccctcactagccttttaatgttgccctaggcttaaacaaataagtggtaagtggctttagaggaaagaaggtgaagaacaggacaagtatctttaggtaggatgaaagtttagaaactggagctttgtgatatatttgatatgtattttgcattcctggaaaacagtatgaccaatgaggctacagctaaaagtggaataacttacaaatccccctcctaaactaggaggaactaggatcagaatggatccttccttgataaaactctgattataaagctaaaaatgtcatgtgataagtcttaattgggatcacatccacaaagtaaggaaggtaaatcttgggtacaggttttgtagaatgggtttaaatgagtactgaagttgagttttgattcccaaacaagaccccttatggaaagggaaagacctgtgaaaaaaagagaagcattcaaccaggacactaagagacagaaagaagtacttggattcatttccttggggaagggacattcatgcagagggcatgggagaaagcttcaattgctgcagttaattctatccttggttgacctagtagggccaggaggatgtgtgactaaaatgaaatgctgcagagaccaattatcatctttccaaagaggataaatttcaaaagacaatggggagattatttcaagcagacagacaaacagagaccctcttctttctttccttcattttactacactgagaccatcttcacttccagtatgctacaccctcctaaatggaaggaagggtcaaaagcttttaaacttagatcactaggacgctgggtttgagacacagaatgtcccgtagatgagtatggccttttggcctcttgaagtgaattaggctgtgtgttgcaggtaagagggctttccagtagggtacccggggtcactgaaagtagaaatgtgtcctaataggatggtgttgtgagaagctttatttttacttcctttcttttgcttctttctctttcttcctttttcccacctctcccttctgactctcctacctgcatatgcagttttcagcactgccctgctagtgcccaactctttaggctgaagacacttgaatagtatttacctctacatggaaaacaatagtgagactgtgttcctggcccattacaccatgctcttgggcattgtgcagtgttatgtttgcagccatctgtgccatgtgttgcttggccaatgaatcccattcaggaccgtctggaagatatatgagagaatgattagattttagtacatctctctggatactgatttctgtgcttacagcttcttttgaagttaataaaaaccacatacagaaggggaagtacaagataagaatgctatactctttttgcatccaatttttttgttaatcttttaagaaaactcaacctgactgttcctaatggaattcagtgccaaggggaagaaaaggtagcaattagaagtgattatagagctgttatttatagctactaagaaaccttgtcatagtacagggatgatggaatgattgctcctcgttcgtcagtcaagagaaataaaaggtgcgtaagatcactgttagaccgtttctatgtggaacaagttaaaacatagtcgaataggaggctgagtaccttcaaaaatgtttatgttgatatacttaagcatattacattatacctgccgtatttattagttctctgtaatgataattaatcatttgtttgtagctgccagacacttgggttcaccaagctttcctaagagacatataaccggaacttgaaaaaaaattattaaaaatcaagataagaattctctgtagcctagaaaatgataggagagtaatagaaatagctttatggcatttgacaggcacatcagggcaggggaaaatgaagactaattatacttcttcataacctgctattgttataagatcatcatcaccttcatatgatcagtgccgtaagccatgacctcaaaattctttcatcacttacagcagctgaagagataggcatgggttggtagctggctgaaggctttaactggatgtcttacagatactctgctaacttctctagaaagtttcaaaggaaggcatgtatacccataagcgataagacatagagaattacatatagtaatttttcttctcatcttgagaacaaaacagaagtagagttactatgatcattcccttttatgagataatggtgttaacacaagaattcccaatgtgcttgtctaaacagaagttaaaaagctaaaagggaggcagtattgtacagagtggagtgggcatggactttcaaattaggcagactgagtttgaatcccagctctgtcacttattagttgtatgatctagttgtgattaggacaagtcactttctcactctgagccttccttgtaaaaatggaaaaggtaatatttatcttatggtaatttggggcagattaaataagacaaataaacatggaaatgtccttgaaaaatagaagaggttctttcatgttagtctccttcctcctcctccaggcctctgcacatgttatttgaaggcttttttagtcaagaaggttgaggtgaagttaacgaacatttgctagagacttgctgtgaacctctaggcgttgaggtagagagaaaagaacttgaagacctttcccttcaaggagcttacaatctatatgcagagagaaaaactgcatataaagaactagtggctgttgtatatcataggaatttagggaagagaaagatctttttggattggaataattggaaaaggttttcatggatgatgtaggaattgatgcaaataaaggctaatagatatataatatgttgtataggctggatgcagtagctcacgcctgtaatcccagcactttgggaggccaagacgggtggatcacttgagtacaggagttcgagagcagcctgggcaacatgatgaaaccccgtctctactaaaaataaaaaaaattggtggccaggagcggtggctcaagcctgtaatcccagcactttgggaggctgaggcaggcagatcacctgaggtcaggagttcaagaccagcctgaccaatatggtgaaaccctgtctctactaaaatacaaaaattagctgggtgtggtggtgggcacctgtagtcccagctacccgggaggctgagacaggagaattgcttgaacccgggaggtggaggttgtggtgagccaagattgtgccactgcactctaacctgggtgacagagcgactctgtctcaaaaaaaaaaaaaaaaaattagcctggcgtggtggtgcacacctgtaatcccagctatttgggatgctgagacaggagaatcacttgagcctgggaggcagaggttgcaccactgcactccaacctggatgacagagcgagactctttcttaaaaaaaaaaaaaagtgtatattttcatattcttttgtgattcataagcatgactgggtgttcccactcacgggtgagatgtgcctccctccaaccttgttacgacgtcaccacattacctgtctgacatgaaaaaaaaaaagaaatgtttttcaaagattatgtaagatggaaaattgagtcgtctttgggtcctcagtctagttagttatttttaatttgagtaatttaaaattcagcaaataatattaaaagtagaagtattttctctgaattatcttcctgtacactcataaaaccctctaaaactttaaaaggaagaaattttaaattattccttttttttcttttttttttttctgagacagagtctcactctgtcacccaggatggagtgcagtggcacgatcttggctcactgcaacctccttctcccaggctcaagtgattctcttgcctcagcctcccgagtagctggcattacaggcatgcactactatgcccagctaatttttgtatttttagtagagacgcggtttcaccatgctggccaagctggtctcgaactcctgaccttggtgatccacctgcctcagactcccaaagtgttgggattacaagcgtgagccaccgcggcctggccaaattattattattttttatttttgagagggagtctaactctgtttcccaggctagagtgcagtggtgcaatctcggctcactgcaacctccacctcccgggttcaagcagttctctgcctcagtctcctgagtagctgggactacaggcgcgcgccaccatgcccagctaatttttttgtatgtttagtagagacagggtttcaccatcttggccaggctggtcttgaactcctgaccctgtgatccacccgccttggcctcccaaattattcttaatgatctaaaacaacacagtatccagcctgcacaaacttcagaaaagtgtgctctttgtcccggaatggaagggtcccacagaaaaggcaccagacacagcacagcatatagatagccagagtgaacaaaacaaacaaaaattgtctatgtgcatcatagagaaacctgtagactagagaagtttccatgctaatttgagaatcaggaactattatctatacacatttttaaaataattcgggtatagaattggtttttattaaatattctttaaatatacatatgtatacttgtatgtgtgtattgatgtacatgtttatgttttcttggaaggggtgtttgtactcaggccccatgttattgtattatcatggaatactgtgcccatggacaactctacgaggtcttacgagctggcaggaagatcacacctcgattgctagtagactggtccacaggaattgcaagtggaatgaattatttgcacctccataaaattattcatcgtgatctcaaatcacctaagtgagttctggggctaatgtttcagctattttggtttgttgttttgaaatacagaatttttatcaacctcagttgacgttttcagacatcatacctttagttcagtttcaatcagcacagtgggtaattctgtttgcgcatctcttgggttattgttgacctacctggttacctgtagggcagatacgtccaggtatctgaaaccacttttcctttttggtgcttttaaatcatacaactgtgaaacaaaattcattattatctgaagtattcaccttctgtcatctcagatagctaatgccagaccttcccgctagaaggcttgatttgttgttttccatgtgttcaaaaaactttttaaactgagtttcagaaatgtatacaacaggataaaatggataaataagaaacaggctagctgggtggagtggctcacgcctgtaatcctagaactttgggaggccaaggtgggtggatcacttgagatcaggagtttgagaccagcctgaccaacgtggtgaaaccctgtctctactaaaaatacaaaaaatcagccaggcatggtagcaggtgcctgtagtcccagctacttgggaggctgaggcagaagaattgcttgaacctaggaggaggaggttgcagtgagctgaaatcacaccactgtactccagcctgggtgacagagcaagactctgtctcaaaaaaaaaataataaaaataaataaataataaaaataaaaagaagcagaggcaaaggaaaagtaaaaacattagaactaaaaattgttcacaaattatatgccgtaagattctgtagacgtggattacagatttggctttgagcttctagtgtctaagcaaaggaggaaataaacaattacaaggttcacaatggccataggaaaaataaacactggctatgtaagagaagcagggctatttctagtaatctctgttttcaaaatgatttcttggctaccaatcactttaagaggagtgtgtagttagttccccaaattgaatgaagaaagaaattgataaaatgatttatttcagtataactcctatttttaaacattatttttattatttatcatcacattttgggttagataagcaaaggattaatctcttttcaaaatatatttgtagcctgggcaatatagtgaaaacccatctctacaaaaaatttaaaaattagccaggcatggtagtatgagcctatagttcaagctactcaggaggctgaggtgggagaatcacttaagcccagaaggtcaagcctacagtaagccatgatcacaccactgcactccagcctggaccacagagcacaaccctgtctcaaaaaataataaaaatttaaaaaaactatatatttattgtatatacacacacacatatatatatttgcatagtgttttcatggtttataatatcttagggggaatccattatcacatctttgatcctggcaaaaactgtgtgggatacgtaacaagtattgttattttatgtaaggaaaactagagattagcccaaagtcatggggctaggactcgaacctagaatttctgaaccaaaggttactgcattctacctcattatgtgaaggtaggggactcacaatgaatcctgcctttcctccatggacggtataaatcaatccttcattataaacttcaaaacagctcttatttatcaccatcattctcagcaatatttattacagtgcttagttgactgaacaacctcctccttgctttacttgcaagtaaacatgattgtgtagtgttcatttcttccgttcacattcttaccctgttgcttttgccatccagtgcatacatgtaaaggacatgaactacctgaaggcctctctgaatggtctcctttttaaccaacttgttctccttatgaattaatcttagagggaaggagtcaggaagccgtagaatagagtagtaattgggttacccagtaagcctttccctctattagcaataacactcccaaccccagcagcgttggcttctttaggtttcaagctgactttgggaagacagagatcaatctgacttgctgtaacaagagatctcattacttacattaaatctgcaggctctgtgaccacaactttgtctcagagaagatttcagaaaaattctaatgttatatttttctagtctcctctcaagtccatcctctcttgtcacaccaacagaggcagagaggaagttcccataaaaagttccctcttttaggggcttactgcctactctcactttcctggtgtatgatatcaattctccaattctctcatatatcccataatattttaatccttatgcattttcactaagactaacactgttaaatcaaaactcctaagttatataaattttacatattacgtgcaaaaccagggcatggaggatggtattcaaaagcaattgtaagctctgagctatttggtaaatagccattggtgttggggttgtgagcatggtaaatgtgaaggaatccctggttcaaatggagaagcaaggggatagagtcagatgctttctgccttacagcctcctcaattctgatactatttgaggatgaagcctcttatcatttttttttttttttgagatggggtctcgctctgtcgcccaggctgtagtgcagtggcacaatctccactcactgcaagctccgcctcccgggttcacgccattctcctgcctcagcctcccgagtggctgggactacaagcgcccgccaccacgctcgtaagcctctcatcattaaacataggtccctagatcattaaagcctctgaaaccctaagtctttaattttctaaagttctgaacaggttattgcaagtgaattcgatctaatgtgaagctgtcaatttggtaccggattgtattcatcttcaaggctggcagagagcactttgcctcaggccacattttcagataactactatgacaagtaaaacaggactggtgtggaatttacttaagcttggatttatttctgcttttccttatcagcactagtgaaatcccagcatatatattagccttttaatgtaatgaatcccaaacatcatggtctcattcatgatattagttggctatcatttaaacagtgttttaaaagaagtactctttttagtggcctggctaaagccagcaaggatggaaaccaatatttattgataacggtgccttatgtatcttacctcatttaattcaaatgaaaattcagtgagattgttattacaggtctatcatcccttatccaaaactcttgaagcaagatattttcagaaaggtagtgcactaccttagacatccagcgaggtctggagcagcatcctaaaatcaaccacattaacaaatctgcagcaaaacctattgttcacacaaaatgggatgaagaaagtgagtttgccttatacatgtgaaaaaaatataaactggttgagaactttttgcattttcaatttgtgaataagacctgaagagtctccatcctacacatgagaaaactggcttagaagagttaagtaaggccgggtgcagtggctcatgcctgtaatcgcagcactttgggaggctgagatgggtcgatcacctgaggtcaggagttcgagaccagcctggccaacatggagaaaccccatctctactaaaaatacaaaaattagctgggcatggtggcaggtgcctgtaattgcagctacttgggaggctggggcaaggagaaaatcccttgaacccgggaggcagaggttgcagtcagctgagatcgtgccattgcactccagcctgggcggcaagagtgaaactctgtctccaaaaaaaaaaaaaaaaaaaaaaaaaaagagttaaataacttggcaaaggtcacacagcaagtagaagaggcagaataagactaggtgttaaaagcccattacgctaaactgcctcacaagtatgaatgatgctatttctagtgtatagccaatgccccagtgacattggaaactgcaagctgaatgctacaagataggaagtagcagataaagtcttcagtttcagccatttagaatcatggttttcgttagtactaatgatccagatgttttctttttatttctttttaaagtgttttagtgacccacacagatgcggtaaaaatttcagattttggtacatctaaggaactcagtgacaaaagtaccaagatgtcatttgctggcacggtcgcatggatggcgccagaggtgatacggaatgaacctgtctctgaaaaagttgatatatggtgagtggcgccaccagttgtgccaactaaaaagccttttcccactttcgccctattagcactgtcttccttcagcacttacttttccagaatattcttcagtgttgctcacttttggttgatttcagcctcatattttctgaggtacttcccagtatggtgatatatggggagaaggattagggggaattagggtggctatctactcagtaagtcaccagtttgggggacctcagagaatatgctgaactttctaggaaactgaaagtttacttcaaatgatcatttagtatagaagtctttctgaaatgtgttacatagttctcaccttcttgagtaaagtacaagagcttacctaatctcaatgactcaggtcatcattacacatatcaataatgtaccttgctatgatacaattatgttctctagacatgtttgagatgtaggaggttgttttgcccttttattgaacagcctctataggctatgctttaaaaaaaaatctctgtaacctttcctctgaggttataagtcttttctattaacagtatttttccctgtaatagcttttcttttacccttaaaattggcaactagtaacttctaggcttaaaaccaaaataatagcacatgtcaaaattgcatgtaataccagagcaaataggaaaaagtagaaatgtggggtcattcgtaatttagataatcattactaaagtaccctccttagggattactaattgatgttcccaccagaaatatgtaagagtgttttctcagtctcaccaacaaaatgtgctaaactcttggatttttgccaatcatataggtaaaaaaacggtatcttgggtgcattcctcttaggataagtgagcctgtacttttgttcatatgtgttacagccatcgtatttgcttatttgtgaatgactcataatctttgctcagctttctgatttttactcataatttatcagagtattttatgtattaaggagattcacattttgtgtaaattgtagatacttcacattttgttattttgcttatggtatttttttcagtgtcagattttgaaaatacagtttaatttctcaatttctccttttatggcttttagatttcatggtttaaaaagtctttaaaagccaggcgcagtggctcacacctgtaattccagcactttgggaggccaaggcgggtggatcacttgaggtcaggagttcgagaccagcctggccaacatggtgaaatcccatctccactaaaaatacaaaaaattagccaggcgtggtggcacgcacttgtaatcccagctacttgggaggctcaggcagcagaatcgcttgaacccaggaggtggaggttgcagtgagccaagatcgcaccactgcattccagcctaggtgacagagcaagatgctgtctaaaaaaaaaaaaaaaaaaaaaaagtttttaacactcctagataattttttaactccttattttttagaagatttttatggtttcatttttctatttaaatctttgattcatgtgaaatttatcttgatttatggtgagttatagatttaatttttttcctagctgttccaacaacatttattaactaatcaatttttccccactggtttttgatgtcacttctatcatacattcaattcctaaatgtatttggtttatttctggatttcttgtccagtccattatgctggtgatctgttcacacacgggagttaattattcaggttttaatttctggtagtgttgattaccccacatagatttttttttttttttcagagttgtcccagatgtttctgtttttcttatagcagtattagaattttaaaactgggtatatgtactaatttgatttcaattaatagagaactaaaatacaaatcagtctttctgaaacatcttctgtccatgttcccggcgctactgtaggtcttttggagtggtgctttgggagctgctgacaggagagatcccttacaaagatgtagattcttcagccattatctggggtgttggaagcaacagcctccaccttccagttccttccacttgccctgatggattcaaaatccttatgaaacagacgtggtaagaatattgtctctaaaacaatagggaggtctctaatgtgtatttggagtaaatatcctggtggtggaaagaataggagctttggagtaggagaatcttgggttcaaatactagctctgcccctttctatctgtgcaattttgggcacgttattcaatatcagttttctcatttgtaaaatagagacaacactgactcatagagttattgtgttgtaattaattaaaatttagaaataaagaacttggtgttattatctcaaaatagtaggccttggtcaatgatagctactatttctttgctagtcctaatggactattattaaataggtcactaatcctagatttccatttcatcattagacgtatctcataattacattttccttttgctcttcagtatatcaaaactgtactgcagggcagccaggcacagtggctcacacctgtaattccaacactttggctggcagagatgggaggatcacttgaggcgaggagttcaagagcagcttgggcaacatagcgagaccccatctctgtgttaaaaacataaaataaaataaaatataaataaaaaactgtactgcagggccaggcatggtggctcacgcctgtaatcccaacactttgggaggccgaggtaggaggatcacttgaacccatgagtctgagatcagcttaggcaacatagtgagaccccgtctctgaaaaaaaaataaaaaataaatttaaagaaatgttaagggccgggtacggtggctcacgcctgtaatcccagcactttaggaggccgaggcgggcgtatcacgaggtcaggagatcgagaccatcctggttaacacgatgaaaccccgtctctactaaaaatacaaaaaaattagccaggtctggtggcgggtgcctgtagtcccagctactcaggaggctgaggcaggagaatggcgtgaacccaggaggcggagcttgcagtgagctgagattgcgccactgcactccagcctgagtgacagagcgagactccgtctcaaaaaaaagaaaaaaagaaatgttaaaactgtactgagatacaattcagttatgctatcctgatataatggagtacagctggttttactcagatatagccattttgaagtaaacaatcttcttcataaagtaaaataaaatcttcattctcctggatacaacttctgaaatgcacaaactgtctttttcacttttaggcagagtaaacctcgaaaccgaccttcttttcggcagacactcatgcatttagacattgcctctgcagatgtacttgccaccccacaagaaacttacttcaagtctcaggtaagttgggaaacttcctaccaggtgctactaaacagatagagaactctcaatgaaacagagtaactcttagaagggcccattgtgtttgttataatagttatataactccattcattgtgacacaataaatatgatacttcacacatatgacatcttaagagcttttaaagcacttaacattattattaactcatttgaaaaaacacgtgttggccgggtgcactttgggaggccgagccaggcagatcacctgaggccaggaattcaagaccagcctggccaacatggagaaacccccgcttctactaaaaatacaaaattagccaggtatggtggcgcatgcctgtaatcccacctactcaggaggctgaggcaggagaatcacttgaacccgggaagcggaggtagtgttcagccgagatcatgccattgtactccagcctgggcaacaagagcaaaacaccgcctcaaaaaaaaaaaaaaagaaaaaagaaagaaagaaaagaaaaaacacgtgtcagaatattatccttatagtggctcctggtaaaactgctgaagagaaaagagaaaaagaagataagaaagctgtaatgtacatacacctgaattaggattactgctgaccttcaagaaagtattatcttctttgaagtagaaaagctgaagtacagacgtgggaggttaaataccacaatgagcctatgatagaactcagcctagagagaaccttttctctaagtgtgtcacctagtagctccaagtaagtataatttaatgattctgttagcctctactgtactacaaaccatctcaaaacttttatttttatttttattttttgagacaaggtctcactctgtcaaccaggcaggagtaccgtggtctgatctcggctcactgcagccttcacctcccgggctcaagcaaccctcccacttcagccccccaagtacctaggactacaagcatgcaccaccacacctggctaatttttgttttttgtttttgtttttttggtagagatgtggtttcaccatgttgcccaggctggtctcaaactcctgggctcaagcgatctccctgcctcggcctcccaaactgctgggattacaggcatgagccattgcctggccccatcccaaaacttatggcttagaacagtaagcatttatgtgtatgtagctcatgattctatgggttggcaatttgggccaggcagttctactggctttgactgggctcactcatgtgtctgtggtgaattgtcaggtcagctgggaggctggctggtcctaggacggtctcattcacgcacctgaccactggctggctattagctagagcaccttgcttctcctccacgtggcctctatccctccagcaggccaccttgggcttgttcacatagtgttctcagggtaacaaatgtagcgagagagcaagtcccaatgcacaagtgatttccaggcctgtgctgcattattcctgctaatgttccatcggccaagcaagtcacaggccaacccagattctcgggattgagaaataggcttcacctcttgacaagagaatctgccacagcacatcataagggcgcagatctggagaggggaagaattggtggcaattaaattaaaagggtgcaaatgtcataaggattggtcatctaaccactatcaatgtggataagggggtggtgagagatgaattttttataaggcccttatcccttccagacccaggcaatatcaaaaggaatggaactataacttttgaaataaatgtgatgatcctgaattatagctgtatgcttatagaacataacaaaattacctaatttctcatttctcatatagctttatctcacttaatgttattgtgcttcagaaatgaattttgtaaagtgaatcgcatctccccactgacttccagtagcatttcaaagattcagtctcagaaaagacattttactagcaattggcatttcagcctccttctcatagccccccatccctgaagggcgatgagtttacccaccaggaaagtgtctgatgaaaacagtcctgaacttttggaggggcatcatccctgggagctgaacaagtccttaaatatgcttttcactttgggaggccgaggcgggcagatcacgaggtcaagagattgagaccatcctggccaacatggtgaaaccctgtctctactaaaaatacaaaaattagctgcacgtggtgctacacacctgtagtcccagctactcaggaggctgaggcaggagaatcacttgaacctgggaggcggaggatgcagtgagctgagatcacgccactgcactccaccctgggggacaaagcgagactccgtctaaaaaaaaaaaaaattatatatatatatgagatatatatatatgatacatatatatgagatatatatgtgatacatatatatgagatatatatgtgatacatatatatgagatatatatgtgatacatatatatgagatatatatgtgatacatatatatgagatatatatgatacatatatatgagatatatatgatacatatatatgagatatatatgatacatatatatgagatatatatatgatacatatatatgagatatatatatgatacatatatatgagatatatatatgatacatatatatgagatatatatatgatacatatatatgagatatatatatgatacatatatatgagatatatatatgatacatatatatgagatatatatatgatacatatatatgagatatatatatgatacatatatatgagatatatatatgatacatatatatgagatatatatatgatacatatatgagatatatatccatatatatgatatatatatgagatatatatcatatatatatgagatatatatgatatatatatgatatatatgagatatatgagatatatatatgagatatatatatgagatatatgagatatatatatgagatatatgagatatatatgatatatatgagatatatatgagatatatatatgaggatatatatgatatatatatgagatatatatgatatatatacatatatatgagatatatatgatatataccatatatatgagatatatatgatatatacacatatatatgatatatatgatatatatatgatatatagatatatatgatatatatgatatatatatgatatataggatatatatgagatatatatgatatatatgagatatatatatgatatatatatgagatatatatgatatatatgagatatttatatgatatatatatgagatatatatatgatatatatgagatatatatgatatatatgagatatatatatgacatatatatgagatatatacatgatatatatgagatatatacatgatatatatatgagatatatacatgatatatatatgagatatatatatgatatatatatgagatatatatcatatatatgagatatatatatgatatatatatgagatatatatatgatatatatatgagatatatatgatatatatatgagatatatatatgatatatatgagatatatatatgatatatatgagatatatatgatatatatatgagatatatatgatatatatatgagatatatgtgagatatatatatgagatatatgtgagatatatgagatatatgtgagatatatatatgatatatatgtgagatatatatgatatatatgagatatatatatgatatatatgagatatatatatgatatatatgagatatatatatgatatatatgagatatatatatgatatatatgagatatatatatgatatatatgagatatatgagatatatatatgagatatatatgagatatatatgagatatatnnnnnnnnnnnnnnnnnnnnatatgagatatatatatgagatatatatgagatatatatgagatatagatgagatatatgatatagatgagatatatatgatatagatgagatatatatgatgtatatatgagatatatatatgatgtatatatatgatatgtatgagatatatatatgatatatatgagatatatatgagatatatatatatatgagatatatgtttttctacctgcccctgctggaggcttggagtacttctgtggtgtctgatacacagagagacactctgcctgtcacacagatattgaggaatatcttagtaaaggcataggtttttgttgttttgattggagttcctaagaaatgataaatcagagactcctgtcctgttaccaaagttctaacacaccctctctgatccataaacttagatctccccacaactgtgtctttaaatagtcaggcttgcccctattgtttgttactatttctaagaaattattatgtaagtaaagtgtttgctttcagaggaaataagatgaggtaggaggttgacttcatggcatttcctgcattctttgatacacattcagatcaattcccttagcactatcgcccatctgttcagatacatgtaggtatcggggcactggatgagaaatctttatcttctgttagtaatcagaaaaaacacttaacccttttgtgaaatgaaagagaatatagtactcgctaggaaatctttcgaactttaagatatggttgcaatcacagctttgcttctccttttttttttttttttttttttgagacggagtcttgctctgtcttacccaggctggagtgcagtgtcgcaatctctgctcactgcagcctccacctcccgagttcaagcaattctcctgtctcagcttcccgagtagctgggactacaggcgtgtgccaccacactcggttaatttttgtatttttagtagagacaggtttcaccacgttggccaggctggtctcgaactcttcacctcaggtgatccacccaccttggcctcccaacgtgctgcggttacaggtgtgagccaccgtgcacagccaactttgcttcctttacaataaaactgtacgtagcataattttgaaaagcaatttctgatgatggtattaagtcacaagccattaagacggtcaatataagtttacatatttggaaaaacttccagttctgaacagatgttacttaagtcctcctaaaacgtcacttctgaagccagtcacacattttgagaacctaccacttgcagagccctgtgcagggcagctaagttgccacagtcgggttcctcacctgaaccgctcccagattatcaagacacccatagcatggagcattaaaactgaactcagaaaaggttgtcttgggaaaagaataggaaagaaaaggagaggagagaacaggagaggaggtcagaataggagagaagaggggagaagaaaactgagtacattaagcatctatcttagctcaggctgctacaacaaaatgtcacacactgggtggcttagaaacagcagaagttagtctcacggttctggagactgagaagtccaaggcaccagcagagttggtgtctggtgagggcctgagttctggtttataggtgatgccttctcactgtgtcctcacgaggtggaagggtgaacaagctcccttgggcctatttgataagggcacttttctcattcatgagggctctgccctcatgacctaattacttccccaaagccccacctcctaatactgtccctttgcagttaagatttcagcatatgaatttggagggaacacaaacattcagaccatagcagcattttttcatattcacttcttcttcttccacatttttcccaacataaaatttctcttctccttaaatagctccaaatctgctattttgctacctcctagaattttctcggtatttataagtcaatttgtctctggatctgaaagtgagactacctctagctaatatgaactggctagtgaggtactacaaatagtaagagacctttagtctaaactccatcctgtcacttcatactgtgtggtcttggctaagtcactcagttacactaaacctcagcttattcaccaaaacaatgaagataatcctatcttcccttccttagggagtttctgtgaggagcaaatgaaaagataaaactgcaaatgcattgtagaccatcaagaacagttgattgtaagatgtcattattcttggctggccacagtggctcatgcctgtaatcccagcactttgggagaccgagatgggtggatcatttgaggtcaggagttcaagaccagtctgggcaacatggcaaaaccaagtgtctactgaaaatacaaaacttagctgggtgtggtgtaatcacctgtaatgccagctacttgggaggctgagacacaagaatcgcttgaacccaggaggcagaggttgcagtgagccaagatcgagccactgcactccagcctgggcaatagagcgagaccccatctcaaaaaaaaaaaaaaaaagatgtcattatgtcattattcttgagttgcgtacgatagcataaaacaaaaacaaaggtgccattattcaccttaatttttgtagctttgtactaagtacaaaaattaagcctcctttgggttgttagattctggattctttttctgatgaactcctgagatgaataagatggcagccagggaactcctattgtgtttgactttatcctgccccagtagggaagacctggctttttggcaggcacattctctttctatagtcctcttgtacctgaggccttgcctcctcctgcctgctaagatcctctcaacgtcagttatcaatcaatagttgttagcacctggtctccactttccaccaaaacttcggtcaagaggtgctgccaagagtccagctgactccttcctgagaaaacgcggcatttgtttttcgtcaacagcacatgtataaagatgtagcctatatggagcagatgaacaaagcaaccgatttcaatacaatgttagattctgccaaagctatagcttcattgctagacaatcacccatttctccaaataggcaattactgttcctggtattcaattacatttgacatgagtctttagaaaacactgtcacccaattccagatcccagttgccaggtggatcgtgtgcctggctttgaagctctctcaccctgctgcctttgcatcattctagtgttctcttgagtgccattgtgaccgcccagaaatgcagggactgggagttgcggagacaccccaactgtgaggttagactctgctgccttaaaagtaatcttgtgagggagcagatacgtatgcagaggctggacactcacatcaggagaggagtcgtgtgcccagaaagggttggactggaccccactatggcttttctgatcccatctgatttccctctaataagccccccaaatcttgcttctctactccttaagctaggctggaactggctcaatttcttttttgttgttgttatttactttttaaaaagtgtggtaaaataaagatagtataaaatttgccattttaaccattaaaaaaaatttttttttgagacagagtttcgctcttgtcaccccggctggagtgcagtggtgtgatctcagcccactgcaacctccacctcccaggttcaagctattctctcctgcctcagcctcccacgtagctgggactacaggcacctgccatcatgctggctaattttttgtatttttagtaaagatggggtttcaccatgttggccaagctggtctcgaactcctgacttcaggtgatccacccgcctcagcctcccaaagtgctgggattatagacatgagccactccacccggccgattttaaccatttttgaatgcatgactcagtggcattaattacattcacaatgttgtgaaattgtcaccactatctgtttccaaaaattttcatcacctcattcagcagtaactccccattccctcctccccaccacccccggtaatctctattctactttctgtctctatgaatttgcctattccaggttatttcatttaagtagaatagtacaatatttgttcgtttgtgcctggcttgtttcacgtggtgtgttttcaaggttcacgtattttgtagcacgtgtcacaacttcattactttttatggctaaataatattccatggtatatataccacattttgtttatccgtttatctattaatttgactttattttgacatctatacagtattccccacttatccgtggtacattccatgacccccagtggatgcctaaaccttgaatagtacggagcctgactgctgtccatcagaacacgtttcttttcatatcttccacccacaaatgtaatgtctcttctatcttaactaagctctgtctttactttttattttatttttttattttttggagcaaccctattaactgattagcctcttatcaatactgtggacagcaggagagcaacgctggttctgttccagggtatctcaggccttgtagtgaaacgatgggaaatgcccctccactcctaggaaggtggctttgtcacaggtcaggctcatgcaggactcctcccacccttagccttctctctcagagcttcctcgatagctgtgcaaattggctgtgggcttgcccatcctccctttcttcatatgtgcccagacatggctgaattgcagattaagctcaaattggaactccttttccatgagattctaagtatataaaatggaactcgaaatcaacaagtgccaggaataggataccttcgggggaaacacattattcatcagtacctggtgttttcccatacgtccttttttctgttcacaggagggaacttcttttctggaaatctactttcttacagatttcaatcttcagaaagttctccttgagtttcccgtaattataagctagatgtcaggagatttatttcctctagaattaaaacaaatctcatctgtgatataaaattcctcaccaccagagggaggtactccttttctcgtcccttcttggagtattttagtaggatacagtgacagttttgcacaaaagaggatacttcaagacacaaatctgaccctcttattcttttttggtctaactactttcacttgtcattctttcgcctcctaaggctcaaatactcctcctgctccatgactttgatctgatgattgagagaatagcattagcaggggctcaaccaaactttcgtttacagcttagatgctgtcaaaggcccctatcaaacaatgcagtagtgtattctgatgagattgggcacgttcagggtggtatggccatagactgcagtactgtattctggatcttggctttctaatggcattgttggatagatttgctgcctgaaagtcaaccaaccaacagaaacttctctccagtgttcaacctatatgtgggaaaatctagcatattatagaatgatcattttttgcatgattaaaatataatttcctctataaaaatagatgagaaacagctaatttggggaaaaccttctataaatccacaattacttaagaataactacttacttgatccagaaagatactctattattgttgtacacttaatgagagctactgtcttttattttattttatttttttaattttttttctgagatggagtttcgctcttgttgcccaggctggagtgcaatggcatgatcttggctcgctgcaagctctgcctcccgggttcaagcggttctcctgcctcagcctgccgaatagctggcattgcaggggcaggccaccacacccagctaatttttgtatttttagtagagacagggtttcaccatgttggccaggctggtcttgaactcctgggctcaagcaatcctctcacctcagcctcccaaagtgctggaattccaggcatgagccaccacacccacaatagcaattagggattgctattatttttttttaattttaaaaatatatataggcaaggatgtagagaaactggaacccttatacactgttggtgagaatgcaaaatggtgcagctaacatggaaaacaatagggagactcccaccaaattcaaaatggagctacctgacgatctggagagatactttttaacatgaatctaaaggtagtagaataatttcaggagaagattatatagatacatttagttacaaatctagccttcactggaaattatgtctcactggcttctggagatggaagatagtctatacataatatgaggaaacttattttcactgtttgtttctctctgtggcctattgcctgtaggccatattccagtagtggtttttttctaccccctaaaatttaggtaaaattagcttgaaatttcatgccctgtggaaagctcaatgtcctttctaatacttctgtacatttctgggagagtgataatttcatggctgctctgcctctgccttcctaaaattcttggtccccacccctgctgccttgtggttgtgcctttatctttgtcctatattgaccaaacattcaattcagcacctttctttaaaaaacaaaacagggccgggtgcggtggctcatgcctgtaatcccagcactttgggaggccaaactgggtggatcatttgaggtcaggagttcaagaccagcctggacaacaaggtgaaatcccgcctctactaaaaatacaaaaattagccgggtgtggtggcacgttcctgtaatcccagctactcaggaggctgaggcaggaggatcacttgaacccgggagacagaggctgcagtgagccgatatcacgccactgcactccagcctgggtgacagagcgagactccgtctcaaaaataataataaataaataaacaaattttttttaaagcagtcattcaaagcctaggtgaatgtcagagacctcactgaaagtttagaaaatttaaagaagtttacattttgaacaacttcaaccatgtattagacatccatccctgctctaaaaattttgtcaaactactagattgcttggccatactctctctttcctcctcctccttctctcctttctgttatttccctcaactccaaattcccgtatagcttcttatatttctattctaatttcctgctgttcatgcctgtagggtcttctactctaggtattttctcaagatactttcccaaacaaagcctaggaggaattctgggcccaaaaagatgttcgtaatctcacatgcacacatacgtttccatgtggttatcagagctgtttttttctggccaggcgatctcagccaccatcttgccttaaagtgaactcttttattccaaaagtgatggccagcatgccggctgtgatgttcctcatagccagtgctggaggaaaactcggaaaaacacagcatcatatattggagtagaaatatagaagtgggctggggcgtggagatatagtagcaggagatattttgctattaatcaaatcatatttattgaacatctattctgaaaaaggctcttcagtagaagcatgcagggaaaaaaaatcttgtacgtgactttatggatatatcagggattgaaactcctggaatttatcaaaatctaatttgtccttacccaggctgaatggagagaagaagtgaaaaaacattttgagaagatcaaaagtgaaggaacttgtatacaccggttagatgaagaactgattcgaaggcgcagagaagagctcaggtcagctcatccctccttccccacctcccttcatccccaggtcttcagatgttaacaggcacccttatcataaccaccatttcactttccacacacctttcacctctgctttttattgttatgctctttaaaagttgccccaaaagttagccttcctttgtatctctttcctatcctttcttcccaactccattatcctcttttattaggtctctgcaacaaagattcttgaaacaatgctatttaatcattcagccagtgtcctaggtgccatgcaattccagaaatttataagatttagtccctggcttcaagatgcttataatctattaagagatataaggccaggtgcagtggctcacacctgtaatcccagcactttgggaggccaaggcaggcgggtcacttgagcccaggagtttgagaccagcccgcccagcatggcaaaaccccatctctactaaaaatacaaaaaattagctgggtgtggtggcgcacgatgcctgtgatcccagctatgcaggagacagaggcatgagaatcacgtgaacccaggagatggaggctacagtgagcccagattgtgccactgcaccccagcctgggtgacagagtgagattctgtctcaaaaaaagagagagagataagacatgttcacgaataatcactgatatggtttggctctgtgtctccacccaaatctcacctcatattgtaacccccataatccccatgtgtcaagaaccaggtggaggtaactggatcttgggggcggcttcccccatgctgtttttgtgataatgggtgagttctcaggagatctgatggttttataaacatctggcatttcccctgcttgcactcaatccatcctgccgccctgtgaagaaggtgcctgcttctcctttgccttctgccatgattgtaaatttcctgaggccttcccagccatgcaaaactgtgagttaattaaacctctttcctttataaattacccagtgtccagtatttcttctagcagtgtgagaacagactaagacaatcacagctgagtcagttctgaatgctataacgaactttagactggataatatataaacaacagaaatgtattggtcacagttctggagctgagaagtccataatcaaggtgccagcagattcagtgtctggtgagggcccattcttcatagatggcaccttctatgtgtcctcacaccgaagaagggcaaaagggctccctcaagtcttttttataaggggactcatctcattgacaagggcagagctctcatgacctaatcacctcctaaagaccccacctatttatttatttattttgagatagtctctctctgtcgcttaggctggagtgcagtggcaccatctcagctcactgcaacctccacctcccaggtttaagcgattcttctgcctcagcctcctgagtagctgttgcaggtgtgctaaccatgccgggctaatttttgtatttttagtagagacagggtttcaccatattgcacaggctggtcttgaactcctgacctcgtgatccacctgcctcagcctcccaaaatgctgggattacaggcatgagccactgcatctggccaaccccacctcttaacattatcatcttgggtgttaggtttcaacatataaatctggggggcacaaacattcagaccataccaaccactatatcacacagggtctgggccgtggctaagtgtaaatgagtgatcatggtgttggctttaactgcatatttccattaacatatgagtctattctactgtattcttattaagatagtgacaaattatagacagatttttatctgtggccctcttggctattctatatggctcatgggctctttaggataaaccaggtggagagcttagatttcccacctcccgttccattttgtctgagttactgcactggacaagggaggcttaaactaagagggccttgggcaaatgcttttgtgatcaatcatcctgtttcttatttcatcaagcggacttttttctcccgaagttggttggctgggctgaccctgtgttttctctgacaggcatgcgctggatattcgtgaacactatgagcggaagcttgagcgggcgaataatttatacatggaattgagtgccatcatgctgcagctagaaatgcgggagaaggagctcattaagtatgtatccagactagtgtctgttcttactgatttgagtctgtcaatcagcagaaacatactacccttccatgttgctgctactcagaactggcagatattttattcattcacccaacattccttccgggatgtgctatgcacaggtccctgcccctggcgaggtatacaaataagtggagttgccacagagcaagttataggagaacatgcacttggcagtcatttgctgcatagggaaggggtccccatttcaagaagagcacggggtgaagaccggggagccgattgccccctggggaaatgtattggctgctgaaagtggtgtaaggtactcctgatggtggcaagaaaaccctgggaatcctgaccaaataagcagctactgaaaacaagcaggacttctgtcattgtattatgttggggaaatgaaagtgagtattagtgtctcagtgcatgagctgaagagcagaatgaagtcaggttaatttgaatttagtatttcctttttttttttttttttttttttgtgagatggagtcttgctctgtcacccaggctggagtgcagtgacatgatctcagctcactgcaacctccgcctcccggattcaagtgattctcctgcctcagcctcctgagtagctgagactacaggtgcatgccaccatgcccagctaatttttgtatttttagtagaaatgggatttcactatgttgcccaggctggtctcgaactcccaacctcaggtgatccacccaccttggcctcccaaagtgctgggattacatgcctgagccaccgagcccggctgtttgtttgttttttaaacctgaatagcagtcttgttattcaaatagctaaatgtggcagaatctgtggtagaattagccggtgaaaatattctgcctatcctttctgtctgcaatgactgaggtgtggcttttgcctttattctgcaggcgtgagcaagcagtggaaaagaagtatcctgggacctacaaacgacaccctgttcgtcctatcatccatcccaatgccatggagaaactcatgaaaaggaaaggagtgcctcacaaatctgggatgcagaccaaacggtgagacacctgtacaaacgcagtattcagataaatagggaaagacccacccacaaatccattctcacatgatggcggatgtggcctcttctttagctcatcagatgactgtagagatactcagtactctaggtaaaacagagtaagaaggtgagggagtatcacaaactttaggaatctagcttttacatctgtggcataaatatttattgtcttagcatggaaagagaaataaactgggggccagacagacctggatgcaaatcctggacctgccttataagctgtgtgagttgacctctgtcaaccccagtgtcctcatggataaaatggtacaattacagcacatgagatttctttttatttttctgacctctaggacacagaattgggttagtcataattcttgatttacaacacaatagaccatgcatggcttacttttattcacacatttagttcgttctttttaataatgtggaaagtacctgcaaactcactgtattagtcccttcttgcattgccataaagaaatacctgactgggtgcggtggctcacgcctgtaatcccagcactttgggaggccgaggtgggtggatcatgaggtcaggagatcaagaccatcctggccaacatggtgaaaccccatctctactaaaaatacaaaaattatctgggcgtggtggcacgtgcctgtaatcccagctactcgggaggctgagacaggagaatcacttgaaccagggagtcggaggttgcagtgagctgagatcatgccactgcaccccagtctggtgacagagcgagactctgtctcaaaaaaaaaaaaaaaaaagaaatacctgagactgggtaatttataaagataaaaggtttaattggctcatggttctgcaggctacacaggaagcatgacagcttctgctcagcttctcgggaggcctcaggaaacttataatcatggtgaaaaacaaagggggagccagcgcttcacatggctggaataggaggaagagagagcaaagcaggaggtgctacattcctttaaataaccaaatctcatgaaaactcactcactcactatcatgagaacagcaccgaggagatgatgcgaaaccattcatgagaaactgcccccatgatccaatcaccccctcaccaggccccacctccaacagtagggattacaatccgacatgagatttgggtggggacgtagactcaaaccgtatcactcatcatggaaacaaaagcagggcctttgataattacctatatctaaccatatgggttcccctcattgtaccctagcatgggagttttgtgaagtttaaatatgataacatgtataacatgtgaaatcatctatcaaatcataggtgctcgaaaaatgtattttgggatagtttaaaaaaagattgccctttcccctttttactacatatttgccttgtattagtttaatcttggaattctcttcctctcatttttccttaccaaactctgtagagactcattcctcaataacagagggttggctctctcctagctaagttaatgtaaagggaaggaaggtccctaaacctagggtatagacctaatagtgagatgtgagttaaatgcagtaagaatagagctaatgagagaacacaaaccaagaatgtattatgactctatcagaatggcagtcattctaccatagctggactaataggtacctaacttctaacgagtaactacacggactaattccaattttgcttttaccttctgccccaaccatctaatggtcaagttctgagaaacttttttcagattccacctgacacaatccttggggttgggggaaatcccaacaccccttttcttttgttgtactaattagggacagagtctgcccgatggctgctccctgccttctgcctacagttaaaactaagagcgctgggggagaaaatagaactatttagctttttcaaatatgagctcatgtttgcttttattttggctatgagaaatgtttgaaagagtttgacaacacaagtagatgcttagtcaatgagctagctgaacacgaggaaggcaacctgcaaagagctgtactgtcagctgattgtcccttgaaggacttccgtttcagatgatttggacagtccaatgattacctagtgagaagtctggagaccttgaaggaaattagagaggagaaaccattcaaccatccttaagcccaggtttcagtttatgtttagttagagactaaaaagagtgtcaagttcagtcatggacatttccagcctgtcataagtgagtacagtccaaaaagatagtctaaataccctgtaataatgagaggcttgaaatggggaagaactatgccttggggtcaacggacttgggttcaagttatgagttctgccacttgctggctttgtgatggatacaacccagcataacctctgatcctcagtgcacttctccatcaaatgggtattgtaatagtaggaacaaagtgctttctgcagtacaaattggccagctgaccacagaattttgaatctgggacaggaagctgccaatagcagacaataccctacccaccttatcataaacccttaatacctggaacttccatgctaagacaagtccttaactgtacttttcctgtaaacgaagaaaaacccatctcctgctgcctgctgcctacttatgagctgtggctgttcaatgtgtggcctcactttagcatcatctgagagcttgttatacttgcaggctcttaggccccaccccagacctactaaatcaaagtcttcgtgtttaacaagctccccgggtgatttgtatgtgccttcaagtttgaactctgaccttcaataaaccagattgaaaattaggagagactttttgtctggattctaccactaatgagctatgagagcatcagccattttggctgggctgtgagctctttgtcacatatggtgaagacaggactgtacctgtggtttccaagcaaagcctggaacacccaagggcttgtacagaggtttctcagaggctattgcaggggtaggaaggacaaggagggggaacctgggaactctgcagagaagggctgctgctctccacttcaaccggttccactataccttttttatttattgcatttctcataataattcgagaggattctgttgttaaaaacaaaaaagtctgggcccatcacctgtaaaatttcatgctgacttgtgtctttctggtccaaagaagggtaaggctacttgctggtaggaagaaagcagtggttcttcctggtaatcctagaggctctgccctgaatcagttcatcagtttagaaaccatttattgttcacctgcaggccttggagtcagtgtgggcaaggtgtaacttcaggcctctgattttcttttgcacgtaatcttcacaactggcccagtgaagacttgaaaacaggactgtgaaagaactccctccctttaggatcaaagtgaaatgccagtgtcactccgcactagcccgtctcttcctgcttctactcaacctcctgctgagctctgtctttcctccttctctgacccctcccttccttttccttccttcaagcttctctgagtactcactataaacaagagtccttgctttctagggtgaggtgtaggatataatacagaaggaataacagaaatcctctgtaagtggacatgtaggttgtttccagctttttgctatttcaaaaaatactgtaacataacatcatcaaacatgtattttgatgcacatatgaggggacttcaaaaagttcatggaaaatgtaattataaaagataacaattaaaaatataaactttacttctcaacataagctccatcaaggttaagatagttttgtaagtgatgatatcagccatttaattcatccctaaagaactgagggtcctggaaatgtatccatgtcaataccgtctttttacattattaactgaagaaaaaatggatgccctttaaaggtattttcagattaggaaacaaaaagaaatgagaaggagccaaatcgggactgtaaggtggatgcttaatgatctcccatagaaactcttgaaaaattgcccttgtttgatgagatgaatgagcaggagcattgttatggtggaggaggactctctggtgaaggtttcctggatttttttctgctaatgttttggctaactttctaaaacactcctataataagcagatattgtcattatttggccctccagaaagtcaacaagcaaaatgctttgagcatcccaaaaaaactgttgccatgacctttgcttttttttttttttttttttgtagagatagggtcttgctatgttgctcagactggtctcaaactcctggcctcaagcaatcctcctatcttggcccccaaagtgctgggattacaggtgtgagcctgtacctggacgacctttactttttttttttttttttttttttttgagatggagtctcactcttgttacccaggctggagtgcagtggcacgatctcagctcactgcaacttctgcctcctgggttcaagtgattctcctgcctcagccccctgagtagctgggattacaggcgcccaccaccacgcctggctaatttttatatttctagtagaaatggggtttcaccatgttggccaggctagtctcgaactcctgacctcaagtgatccacctgcctcggcctcccaaagtgctgggattataggcgtgagccaccacgcccggccgacctttactcctgaccagtctgttttgactggaccagttccacctcttggtagccattgctttaattgtgctttgtcttcaggatcatactggtagagctgtgtttcatctcctgttacaatttcacttatgcaaagagatgtttgaagatcttgatcccaagtgtttaaaatttctattgaaagttctgctcttgtatgcagctgatctgaatgcaacagttttggttcccattgagtggaaagtttgttcaactttaatttttctattagaattgtgtaagctgagccaaatgagatgtctattgagttggctattgtttctgctgttaatcatcagttctcttcaattagggcatgagtaagatgaatttttttcctcacaaattgatgtggttggtctgctcctgtgggcttcgtcttcaacatcatctcatcccttcttcttttttttttttttttttttttgagacagagtctcactctgttgcccaggctggagtagtgtagtggcaccatctcggctcactgcaacctccgcctcccaggttcaagcgattctcctgcctcagcctcctgagtagctgggactacaggcatgcaccaccacgcctggctaatttttgtatttttagtagagacggggtttcaccatgttggccaggatggtctcgatctcttgacctcgtgatccaccctccttggcctcccaaagtgctgggattacaggcattagccaccgcacccggcccatcccttcttaaagaagttacccatttgtaaactgctgatttctttgggacgttgttccataaacgtttcataaagcgtcaatgttttcaccattcttccacttaagcttcaccacaaatttgatgtttgttctttaatcgtagcagaattcatgttgctctgataggggctcttttcaaagcgattgttcttagtgcctcaatctagatcgtgcttagagatgttaccgataagttggtatgagtttatttccatgcaaaaaattttgagatccatgcatagtttcttcataatatgcatcttccatgaacattttgaagacccctcatacgttatctctattggataaatcctgatgactgctgattcaaaggctctgtgtattttaagtcttaggatacatttccccaaacttgaatgtgttttcatgtgtttcagattaaacctgttctttcctcccaggccagacttgttgagatcagaagggatccccaccacagaagtggctcccactgcatcccctttgtccggaagtcccaaaatgtccacttctagcagcaagagccgatatcgaagcaaaccacgccaccgccgagggaatagcagaggcagccatagtgactttgccgcaatcttgaaaaaccagccagcccaggaaaattcaccccatcccacttacctgcaccaagctcaatcccaatacccttctcttcatcaccataattctctgcagcagcaataccagcagccccctcctgccatgtcccagagtcaccatcccagactcaatatgcacggacaggacatagcaacctgcgccaacaacctgaggtatttcggcccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaaggtaaagtgtaatgatgagagtggcctgcgtcactgccttcaaagaatgccagagcctgtcatgttatacacattagagagcatatgtaaaaagtatacattttgtaaaaggacaagataacagaaacataaatagaaatttattttactttaaattcgttctttccacactgtttaagtgataaactacggaatacactttagcaactactgaaccagaggactgagtcaagtgtatgtataataacttatttatagataactatatactggggatatgggctgcacatggtggctcacgcctataatcccagcaatttgggaggccaaggcaggaggatcacttgaggtcaagagttcgagaccatcctggccaacatggtgaaaccctgtctctactaaaaaaaatacaaaaattagccaggtgtggtagcacacacctgtaatccgagctactcaggagactgaggcatgagaattgcttgaacctgggaggcggaggttgcactgagccgagatcacaccactgcactccagcctgggtggcagagcgagactctgtctcaaaaaacaaacaaacaaaaaaactatatagtggggatatgtaatcaaaatagtttggaaactactatgctacagctctagtcctgagggatgttatgggaagtaaagagcctgttatagagtaagtttaagaagcacagtattctctcatcccctcatacagattcctagggcacattaacagtcctctgctttgagaaatcctgcagtaaacttgtttaaccgagcatttccctcacctatttgaacatacagcctttttaaattaacatctattaatcccctgaggcactagctttcttcacactttggaaaacattgccttaattgacaggcatcgtgacccagatagttcttaatcattgaaacctgtttctctcctccttatccactggctgcctgggatttgttacctgggaagcagactaccatagcagttaagagcatgagcctaggagtcagacagaccttactttaaagccaggctcttggccaggcacggtggctcatgcttgtaatgccagcactttggaaggccgaggcaggtggatcatgaggtcaggagttcaagaccagcctggccagcatggtgaaatcctatctctaccaaaaatacaaaaattagccaggcgtggtggcaggcacctgtaatcccagctactcaggaggctgaggcagagaatagcttgaacctgggaggtggaggctgcagtgagccgagatcccgccactgcactccagactgggcgacagtgtgagaccccatctcaaaaaaaaaaaaaaaaaaaagccacgctcttccatttagtacctctatggacctcagtttccttgtctataaaatgggcctaatattggactctgcctcatcagttgctataaagactacatgcataaatacatataaagcatttagaacagggcctggaacgtagcacttttccaaaagtattagctcttcttgctatgagtcaaaaaataagattatgtatgaaaaatgtttacaacatggtagacacccacccaattctaagtatggtttcatctcatcatcattgttcaccaggaatttagctgaaggaatgaaagggtataaaatgtaatgagtatgtttggtcaactaggcattgagtagaaaagaagctgaagctgagggctgtcatctgggaactgcatttccccctccacctacattgctgctcctatactgactaagcagtcccagagattaaattgtgtttcagggggtggccgtggtggctcacacctgtaatcccagcactttgggaggccaaggcgggtggacacctgaggtcaggagttcgagaccagcctggccaatatgggaaaccctgtctctactaaaaatacaaaaattagccgggcatggtggtgcactcctgtaatcccaggtactcgggaggctgaggcaggagaatcagttgaacccaggaggcagaggttgcagtgagccaagattgcaccactgcactccagcctgggcaacagagcaagactctgtctcaataaataaataaatacataaaattgtgtttcagctggtgcagttgatttgggccgatccattctctcctcttccaactccgatggccagtaacttgtattttttgataacttctttattaagatataatttgcataccatacagtcctcccatttaaagtgtatagttcaatgctttttatccacagagctgtgtaactatcaccacgaccaattttacaacacttttatcaccccagaaagaaaccccacaccctttagcagtcaccacattccccaggctcccccaaataacatgtatctttgaacctttctcatgccattgtgataccatctacgggtctttaggccatagaacacacaccttgtacatttggcttcattggaacctcactcccacagagcagctcaacttttctttaccaaaacatagtcccacaggtcctcctagggtaaactgctcatctcagcagtcaggataacttcatctctgtctttcctattttaaaaaaaaaaaaaaaaaaaagcatatcagaatacaaatgagtaagattcatgatattttagaactgactttttaaaaggtaaattattctcaatatttggtacagttccttggacccaattacccaccttacaagcgattgggtaatccagcgtatcatgatgctgtggttaaggacagttgatcttaagtgtggctgctcctatgcccttggtgtgagatgagttctctgtaaaggaagatcacctcagtcaggacacttaccccgccttccagatcaaccatggagccccagcaatcacggggactcaggtgtcccagccagagctcccttattgctgccaacatgctgactcaataaaaatgcattaagcactttcttttaattgacaaacaataattatatatatttatagggataacaccaattttgtatgcagtattgtattaatggagtgaggcatacagtacaaacaggatatagtctgaccctcaaaaatgtctatctaactacataatattagtgaaaaagggattggtatataaaaagggaaaaagtaattgttcggctttgaggatttcaaagatcaattctataacagagcctggaaccactagtgacaatgattacaagagactgaccccaaatccaagacctcctctccaacttccctctccatcactcacctctggacactttaatagagccatcacctctctgaggacaaagaaaatttcactcagttctacacgtcttccagcatctcatgcaggcccgccatcataggtaccctggaaaagttactaaatgaataatgaggacatgtatgtttaaagatgacattcagcaagctactactaaatgaatgacttttgatgataattacattttttacagttagtggggatggggtgagagagacagagtgacactaaaataaataaaactcttaatccttgttctcctcagagtggagatgactcctcagaagaggaagaaggggaagtagatagtgaagttgaatttccacgaagacagaggtaaaaccaacaaatgcacacgattgcttttagtggaatggggaaaaaaaatcctaagtttgccacacctgctcttcaaccacaggtgattccctggcagccaccttatagggaactttgaactcactgtgttcatgttttcctgttgctacattttggcagttgttcgtgcacagcagatcctagttcattagcattcattttacagcaacttcatgatgaggagcatgaatacagattcaaggttacaactgagaatacagtgggcagtttgtgacagatggccatgctgttttatgggtaattgtgttggtttctagtgtgcctccctgtgttggtctgctcaggcttctgtaacaaactggatgcttaaacaacagaaattgatttctcacaattctggagctggggaagttcaagatcaaggttctagctgactcagttcctgatgagggctctcctactggcttgcagacagccaccttcttgctgtttcctcacatggcagagagagctcttccttcttttaaaaggtcacagtcttattggattaggggtccactcttatgaactcatttaatattaattacctcctaaagaccctatctagagggtctatctagatacaattatattggagtttagagcttcaaccgatggatttgggaggaaggcaattcagtccatagcattccccatgccttagattttatatctcaagttaaatatgattagataagttgaatccaccttcaacccagccttagaaatagcttcttgcttagatagcgataataatattcctgctaggagtcaataagggccatctccccttacttctagaataaaagctgcctctaatgtagagaataagatagttttcctaccaagaggtctttttctgctaatggacattctgttcttgaagagtaatgctctaagaagtctccccaggaaggtttgtgtacctgcctggaaacaggaattccctacaaaccaaaggactcctggccctttgataagttatatcctggatccctgcattatacacaaaattgaaatctgttctcattccctgctattcctggactctttatgacctcttcttatatatccatgatctgcccccctgacccccaaccaactcaccccatcacctgtcctgggcatcagccaggcctaggtcatatggcataaaatctctttgtactaggccgggtgctgtggctcacacctctaaacccagcactttgggaggctgaatcaggagttcaagaccatcctggccaacacggcgaaaccccgtctctactaaaaatacaaaaattagccaggcatggtggggcatgcctgtagtcccagctactcagaaggctgaggcaggagaattgcttgaacccaggaggcacaggttgcaatgaggcgagatggcaccaccgcactccagcctgggcgacagagtgagactctgtctcaaaaaaaaaaaaagaaaaaaacaaaacaaaacaaaactctttagactaagaaatacagaaagatcagacaatggcaaaagaaaaaggaagtctttattatttgttttcttatgtttttttaagccagtgtaagctagtaacatccttatttactaagctgcttataaacaacgggaaggaactgaggaacttttgcaaattatctccccagaagcgttggctcatcagagccaaactcagatgttaactggaatgagctactaactagctgggcagtacccacagctgcagagtgaatgttccttccatgctcatttctgttgaaggttggtcaacagaggtagtgaaagcacttgggcctccagggccaccatgcccagtggacactgggctctgggaaatgaagctggggtggattgacagggaggtgagggatggaggttagagaaggacactgatcaaagtgtgtgtagacccagcccaagcctcagctctgccttttctcatggtgtggccttaaacaagtcacttcccttctctggctccagttttctcatctgggaaatgagttagtccagagattctccaaagtctctttcacctgtgagaatctatgactctctaaataagaggcataatttcaatttggacattccatactatgcatatatgtacataacgtgattagacaagctgatgtttttcaaaggccagtcatagccatcagcttggagtgtagtgtttagtcacataaatatataaaccaaatgaaaggggaaattaaaatttccttcttgtgttagtcaccttgggctgccataacaaaatactacagattggatggcttaaacaacaggaacttatttctcaagttctggagctggggaagtccaagatcaaggtgtcagcagattcagtttctggtgagggctctcttcctggcttgcagacagccaccttctctgtttcctcacatggtctttgccccgcacatgaatgttgaaaaaaggtgggagggaggaatggagagaatctcttcctctttttataaggctgccaatcctatttgatcaggacctcacccttatgatccatttaactttatttacttcctaaaagccctatctccgaatacagtcgcactggtattagggcctcaacatggaatttcatgggggataaaattcagtccattgccttaatgttaaaagttaaatagtttctacctatcttgatttcttaggcctccttgatggcagggaaaaaactagattatctctaccactactatgagtgacagataaggaaagaaaagcagttgttcctctgactaagttctcctggttcttcttggttctaggccccatcgctgtatcagcagctgccagtcatattcaacctttagctctgagaatttctctgtgtctgatggagaagagggaaataccagtgaccactcaaacagtcctgatgagttagctgataaacttgaagaccgcttggcagagaagctagacgacctgctgtcccagacgccagagattcccattgacatatcctcacactcggatgggctctctgacaaggagtgtgccgtgcgccgtgtgaagactcagatgtctctgggcaagctgtgtgtggaggaacgtggctatgaggtgggggcttctcccttctcctcccatcactgttcccttttttgctctttggggttcaagtctctagggcctttacaattttcatttaataataagatacaacagtggccttgtattagtctgttttcacactgctataaagaactacctgagactgggtaatttatgaagaaaagaggtttaattgactcacacttccacaagctgtacaggaagcacggctgggagacctcaggaaacacaatcatggcagaaggtgatgaggaagcaagcatgtcttcacatggtggtaggagagagaaagcaaaggggaaagtgccacccactttgaaaccatcagatctcatgagaactcactcactatcatgagaatagcaagggggaaatccactcccatgatctagtcacttcccaccaggtgcctcccccaacattgggaattgcaattcaacatgagatttgggtggggacagagagccaaaccatatcaggcctccaagaagtaagtagacgtacagagatcaacagagctcccagaaatgagggcagtttctcccaaatgacacacacacattgaactgctcaggaacccttcatgtcaagatttaactcaaacatcacttcctcccactcctatctcccaacacggttaaaggtctgagcccaggtcaggtgtggtagctcatacctgcaatcccagcactttgggaggctgaggcaggaggatcactttagggtcaggagttcaagatcagtctgagcaacatagcaagaccttgcctctacaacaacaacaacaacaaaatttaattagctgagtttgatggtacatgcctgcagtcccagctactcgggaggcttgaggtggaaggttctcttaagcccaggagtttgaggctgcagtgagctatgatcacaccactgcactccagcctgagcaacagtgagaccctgtctctgaaaaaaaaaaattattttaaaggtctgagcctccccactccataccctgactcttccctggatgatgccatcataggacatatagcactttatttcatattcaggactgcctttggagaggcaggctagcatagtggttctaagtgtaaagcctggaatctgactgcctgaatgcaaattgtagcattccacttactgtgggacctggcaagccacttaacctctctgtaaaatggggatgataatagcatctgtctcatagtgttatcatgaggactaaatggattaacagatgtattaataaagtacttaccaccgggcgcagtggctcatgcctgtaatcccagcactttgggaggccgaggcagatggatcacaaggtcaggagatcaaaaccatcctggctaacacagtgaaaccctgtctctactaaaaatacaaaaaattatccgggcatggtggcacgcgcctgtagtcccagccgctcaggaggctgaggcaggagaatcgcttgaatccgggaggcggaggttgcagcgagccaagatcgtgccactgcactccagcctgggcgacagagtgagactccatctctaaataaataaataagtaaagtacttacaacagtgcctggagcatagtaaacgctatataagtggttgtgtggtgggcactgtttttattgtcgtagcaatcataatcatcatgtgttttctttctccataagtcccacaaggacaggacctggtctcgtttacctttgtagcccccttaccaagcacagtgcctgttgtgtgggaggtgtttgacatatatttactgagtgattatcgaaatgaattaaggttttgtcttgcctttgcagaaccccatgcagtttgaagaatcggactgtgactcttcagatggggagtgttctgatgccacagttaggaccaataaacactacagctctgctacctggtaatgaaggaatacacatcctgaagatctcgtgactatactggcatttcagatccaccccacccccagactcatcccactctctcccagcattttgtctgggaagagagactaccccatctttaccaccccctagaaatgagctgcaataacaggaacatgagacttcgcaaatctctggaaaataatatccaaatgaaattaagtctcactgaacatttcaatcaagaatggcagggatctattttattgaatattctagctactgtaacattgatatttatttttgtttgacattttaacactttgtactgcaaagagtgaactatatatgagatagagagacaataatttcttgcaaaaaaaaaaagagataaaagaaagaacagaaaaaaagaaataagtggaatttaagagcaacatccttgggaatttgtggggccgggaggtattattgctgcttgaacaggggaccaggtcttttggccataagtgactaaagaagagccagagcaagacattgaacattttagaacacaaagaacagcaaaagaaaagcaattccaggcaacttgtgaacagaccatattcacttcaaccagcttgtccaggtggcttacggaaatgacctagaaaagtctggtgaccagatacttgcacccaatgtcttcaagggcatgtgcttcctctaggagggaaaaacagacaaacaaacaaacaaacaaacctgtgtatgtggaagctggtttcatttttaaatgtttaagcagcagttggtagtgaggtttacagatagtgtcaaatcttgtttttggcaaatacgtccctttttagtgctgtcactgtcattaccttggcaaatgtgctaccttgacccaacgtgttgatctttcatactcaagtgccatttccttgtagctcatttcctttctgcctgctgaccacttcctgtaggaacaaaggttggggggcagtactgaggaggagaaaagggtgagagaggaagaacatctacagtggtgttaggaaaacgaacgtggaatttataaaactccattctcaggatcactcagttcagctacgaggagaagatggaaccacccctctctggagccaggttgcttgtctacttgagtcatattgattcaagcaggagaacagactttgaaggcagctaggatgtatgtgtgtctatacaatgtctgagcccaaaccatccctttgtttttattcaataactcattctatcttagaagttctttttttttttttttggtttgttggtttggttttttttttttttttttttgacagagttttgctctttttgcccaggctagagtgcaatggcacaatctcagttcactgcaacctccatctcccaggttcaagcgattctcctgcctcagcctcccgagtagctgggattacaggcgcccgcaaccacgcctggctaattttgtatttttagtagacacggggtttcaccatgttggccaggcttgtctcaaactcctgacctcaggtgatccgcctgcctcggcctcccaaagtgctgggattacaggcatcagccactgtgcccggcctatcttagaagtcttaatgactggctaccactgtcagaataaaagcaaaaacaagcagcttgcaaaaggcaactcctctcccagcacaatagcatttttgttcaatgctacttgtaaaatatcttttacttcactccaaatcaatgcagttttaaataactggatttgaacatttgtggaaagaacaagggatgctgagcagggataggaaggatttttacattgccaaaagcatgaggtcctgcctgtctccagggtcatgggctctgaaaagcattccaaggtacttcatggtgccttggccttaaggaaaaatttttttagaattttatgtacaaataggtgttgacctagtacctgtccctgtctccaagacagattaccgtcaaacaacctctctagattcactggactctttgacactgcatcatgttggacgttaggaaatacttgcacagacagctgttaaaccatttccaatgcacatgaaaatgttgccgctcctctgggttttactgattgcatcagccaaaaaggaaaggcaggagggaatttagagttccttttgcttgtttgatccatttgtttacactttatgttgatacattgatttaaaatgtagtgtctgtgatttatagctcttaggatgaaggaaaatgtttaatttatacaaagagcagtattgtttgcattaatttattccattttgtaaaaattctgtagctggactacatgaaagatcttaagttatggcattattatcattgttattttattttataatattatcattctcattttctgtcgatca

SEQ ID NO: 13153 - DNA, 25230 bp, Human
ctaaaattgtggtgatggttgcacaattctgtgaataaaagccatttgaactgtacactttaaataagggaactgcatagtaggtgagtcgtatctcaataaagctgttaaaaaaaatcaggagttggggatatggggctgaggcaggaggaacacttgagactgggaggtgcaatgagccaccgcactccagcctgcacgacagagccagagagaccctgtctcaaaaaaaaaaaaaaaaaatcaaatgaccctttaccagtatcaaagtgcctcatcagccaggtaccaccttttcaatggatggggagactgaagtgtagaggaattaagtatccgacttgggggttgggggaagtggctcacgcctgtaatcccaacactttgggaggccgaggtgggaggatcgcttgagcccaggagaccagcctggccaatatgccaaaactccgtctctataaaaaatacaaaaaattagcctggcgtgttggcaggcgcctgtaattccagctgctacggaggctgaggcggagaatcacttgaacccgggaggcagacgttgcagtgagccgagatcgcgccgttgcactccagtctgagcgacaaagcaagactccgtctcaaaaaaaagaagaaagaaagtatccgacttggtcttgggctcttctcactataatccaactatattctcttacgaaatggcagaattaatcttccctccttgtgacacccctgtagttatacatgcctctggcacttacaatcattttttctaattgtgtttaacggttctagcacattactttgtaactttagaatagagattgtgtctgattcctgtgtattaaggtccgaccttttttatttttatttatttattttttagacagagtctcgctctgtcgcccaggctggagtgcagcggtccgatctcggctcactgcaacctccgcctcccgggttcaagcgattctcctgcctcagcctcccgagtggctgggattacaggcatgcatcaccactcccggctaatttttttgtatttttagtaaagactgggtttcaccatgttggccaggctggtctcgaactcctgaccatgtgatccgcctgcctcggcctctcaaagtgctgggattacaggcgtgagccaccgcacccagccgatctgacctttttttttttttttttttttttttgagacggaatctcgctctattgcccaggctggagtgcagtggcgcgatctcggctcactgcaagctccgcctcctgggttcacgccattctcctgcctcagcctcccaagtagctgggactacaggcgcccgccaccgcgcctggctaatttttttgtatttttagtagagacggagtttcactgggttagccagaatggtttcgatctcctgacctcgtgatccacccgtctcggcctcccaaagtgctaggattacagcgtgagccagcgcgcccagcccgatctgaccttttttaaatgaagacgtattcaggaaggaaatatctacaagtaagacaaaattaagtaagaacccaatgtacgaacattcacttctctaacaaaggaaagacacaaaacaagaaactaataaggcggagaaaggaattgagattgggggaaacagcatctccttcctccctgcacactcggcaggttccctggaaagttctagaagggattcagaagtggctggtgacatcactgtggctccgtggcgcccactacagcagccaaacgacacgctagctttcccgcctcatagaggctcgtgaatgggggtggggccctgcgaggggcggggtcacgtcacttcctgtgcgggacgcgctgcagctggagaggaaaggcagagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtacgtagagctgcggtagggggtggctgtgtggtcctagctccttgcatctttttctaggcccgtcggcctcgggccaggaggcaggggcgttttaggctccgaagtctgaagccgggagggcaggcaagggagacagcatttaaccaaaaaaagcccttgtggatagtgccttagtgcctttggtcgtgaaggagggaggcccccggcgggtttatgtggcttctgcccgagacggccgtttttcccgttataagagggggaagatgaaaatggccgctgcgtccccgcggtgttgggggaggggagcgatatcttatttcggcgttgctctcctgcgaaggtccgccgcagccatcttgggctggcgggctgggcgagctgccagaggcacaaaatggcggagaagccgcgcggcaacgcggacccgacccgcagcgggccgcgcttcgtaaggccgcgtggtggggtgcaaggggacagacgacgttcttttgggtctttgggccggtgtttaggttaacgaaggaccgtctttgcctccacggaaaggacggagtctgggatgtctttggggcctcttaagatggaaactaatccaaggccgactaagttctgggcccgttaggtggaggggattgcgtgagggctttgtgtttggcctaaatgaagcgcttttctctgatgccgaaagggcttcccaggcaaaaatctgtatcagtattctattaggacagaccacaaagtcgttaagatgattttgtggacatcgcatttccacgggattgtgaaggagaaattggcgggcaaccatttacggcgccgttatttcctttgttttgaggcgttctaatacttagaaccacagcgtgtgttggctacagttttctttcccttaagtttccacctcttaaaggtgttcagtgagggttgattgaattgcgggaacaagacagttctagggtttaaacagcatacgtagctggtctgtggggctctgggtattggattcggaaagcattgaatgatgcgaacatacgaggcttgctagaattaagaggaatctgttagaagggtgatagaaaagcaccatagaaattgatttttgaggctgtgggaataatttgtgcttttttaaaaaaaaaaaacaatttgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaagtaagcgattttaaagtcttttgttattaaacagaaaaattcaattattgggtacctttctactcttcaaaaatactaaatgactggcttctgactagagctctcgattgaatacacgtgaagaatgcttgagaatggaaaattgcccagagttcattagtatattttacgtgagaagggaaacaattgaaactaggttccagtttgagactcggctcaagagaaatttgaaattttctgatgggttatctttttactagtaaaagtacactgtgtttttcgcaatctttgaattgtagagggaggttaacttaatgtgttaaaaattgagttttttttcttacataagagtcttcgctttctggccgagatctctaaacttttacgttgtgaaatacttccatattgttgtgtttggtgtttgcgtgtttgtgttccaattggaacctttaagggttggaatacacctgaatcaaacacgtgtctaggcttccaaagcaagcttgggaaaaccataaagctcaatggaacagcttgatcttagacatgcctgtggtgtaaatgatgcttctctggagccagaaaaatgagtgttattcaactccaggcttctgaactgggtcttaatgtaaatcactaatctcttcaaatcagtggaattctcccttatttatctgtctctaatccagacaaccccacccctctgtgccccaccttttccagtgactgtaggagtttgttgttgtgtccctcccctttaaggttgggtgtgtgggataaattattctcagtttgatcactcaatagaatacatttgggtgaatataatgacatttaaagaactggtgtgtccctcatccctcgttggtctgtgggatttattttttcccccctctcaaaggtaatagattaacactaaaatctgtctataggggtctaattagcaggcttaacctgatctggccaaaccactttcaaaagtaagatctcgttttcatctccggattcaagactcttcccccaaaattgcttgcattttgtaaaggggttgactagcaccatttctttgtaaaaagaggcactcctggcctttaagtcacaattacaagaagttgaataaaaagttgatgaagtgcagggtaatctttagagcccaataatggtcacagcgtataggttgtgtgagatttgtatgttggtcttgcacgcagtgtaatgttctgagcctctcaatattgtaatgagtttctacgagtgagtctttactaaaggaatccagaaactaaggagacactgatgtatggaccagatgttaaagaaaatgttttgacccagcagatactctgatagaatactggctattatttttgtaaagccgatgtgattgcaacataggcacgtaatctttatcattagagatgaatagcagcatctggacaccaacccatcaaactgcttttcaaattctgcagtttttctcatcttctgctgaatcttgggatgtctttttatattccttggttttagctcctaaactctaaattctaattttcaaaactgaaacatctctgaatctacttctttctaaagaattgcagccatctcaccaaatttcctttaaaaaaggattgaattgtcaaataggaggaaattgttttgtattgtgagtctggttaggtttatcagtctcttgaaacccggttgaaatatttttttcttggttttaaacaagaatgctttaatattgtggatattgtctggaactagaacgtgacattttcaagctgacattacaggtgattttataaggtaagtactactggttttgccaaaaggttgaagaggaattcaggtggtgggggaagtgttaatgggatttgccttacatagcgttttttcctcctttctctacaataaaatccgaacgtaggtggtaaatattaatgctttcatagctattttgcccaggacaagggcagagctacagctgtgtatatttcttgagccttagcattttatgttgatcagtgtttttacatatgcgactgtttttttaacaaggcatggtgactgatgtttaggaattttaagtgttttgacccaggttagtattgggggtgtgggctatgtagaattagatattgaaatcacttagtcttgtttttaaactgcaaaccaaaagaagttcttcactgtagcaaattacagtcttgaaattcccccaaaatctttgctttgaattgggttttggaggttacattgagattgatgttatcaacatagattgttacctgacagtttggataaggggcccctttttctctaatttttgtggttagaaattaggttaaaaggtagtcttctgaaaagtcaaaagatatttatatttgcttttgttggggagtactgactgttttatgaatgtaaatttaacagtctgtgctatatttacaagagagtttttataagcacaggcctacaactaatttcagatgatgtttttttccagacactattctccagtttttgaggatttacttatccatttactcttctggtagacagtttggctgccagaaaaaaatatagtccttattatattgatatgagcattgacctttccataacaggattaatgaggttttctttgcccctgtccctcccaatttttaaaatattgccttgtcagtcaacttaatgagtttgtgcatgtttaatgttaaatggattctagttgtatcccctagaaacattttaacaaaaattgtgttgataggacaagtttctgtttatttctaactagggtctcttaactaaatgtacataacattagcccaagagttgatcttctggttttataaagtagccacttgaacttagctgagttgaattaaatctaatatttataataatttagtaatggttttgttcttagactataagagaaggaaccaggttaggaaggggtaatgaagtaacagcaggaaggtatccacattgaaaacagttgtgatagctagagctatggcctctattcttgtatcttctgcatctaagtgccctgtctgtatcgaagttttaggaggccctaaggaaacctgcttgggcattctgattccatgattacatttgtgctgccagaaaacatttcccattgcattttagtgatggagatttaaagaaagccaattactgtaactcccttaaataaaaacatatttaaaaattttcggattaaataaacaataattgactctaaaactagactggaaattatccttttgttaggaaagacatcacagcacttgccagattaacgatggttgtctttatgcccagataggtataaagacttgcaatttttttaaacaaagccttacatttttttcaggaggaaaaaccaggagaggaagtaattgacaataaaatgaaagatcatcaaagtgaaatgtaggataacaagaaaaactagcatgttttatgtaggcagtattttattttgtttagtatgttcaacagacatttacagatcaactaaattcaatctttttaattatttgaggaggtgagctgtaatttaaatagtgccaccttttaaagtagtatttctcctttggacatccagaagacttaatattttctaaattgagggggaaaatgtacaacaaaactctttgaaaataccagtgttggattcaagtttgttctgctttccttcatagctactggcatattgtaggtggttgacttgattttgtctttttatgattcatactataaaatctcactagagcagcttttccagggggtgggttacacttaagctccaaattgtcaggttccctgacaccgtctttctgcagagctctttaaatacagtacaaaaatgtgtgacgctaaatacgtttctttatcctatctagacaagtcacaatactgtaaacctcttcaaccctgagcgtttgtcattgtacaaatgaattgtccgtgctttcctttcatgcacttatgtattaatgtgtcactttttgactagaggtgtgcttttgacacttaacctattttctattgaatataataagaagtgtgaaatgtaactaatagttcttaaaatgttaaatgaacagtaaatgttcagtggcgcacttcacattcaacttaagcatgataagtctatttggagtagagaaatgagattaccatatattctagaaccagcagaaaactatgtagttttcagttttttgagctgcatattctagtttctttttttttttttttaatccaaatcaacaaagggattttttttttctagtttcagttttggcactggattttatcctggagttttaaaatattcttcatcctgttctttttctattaaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagtaattactagtctgtttatgtgtccctgtatattttgctaaacatgcatgcattatttgtttaatagaggaaaatatatacagggtaaagaagtgccttccaggggaaacgtttaaattaggtaattctgattttaactgcttagttaaatgattgaaatgcaatttttaaaaaatatttagtagtcaagcaccaggcagcagtgagctctccagcatgggtaacagtgggcttcatgttgtcctctctagataaactttacctgtctaatgttgctggtcctggggcatgagcgaatacctccagggttggaactggtggtctttgccacctccctggactcttagattgcactgtcccctttccttcagtactgagcaatgtatagtagaatattttctgttaaaccattttcaaaggaatgtcaccaggatggttatggaaccaaacccccaaaatccaaacaaagcattgaacaaaatagttccctttggcattagtgtgttagttttttccatatggcactagtggaaatctgtgagcatttgggccctaaatttaagatgcatatttgctaaatacacagggatggtttttcaaattctgtttctgtttaatgcctatttcagctgattgactaggattactgataaaataccgtagcttccccttagaagaggtgggtcacacaagtgaacaggatagctaatacaaattgcagtaatggcagatgctttcattcctatttctccttttttgctatcaacatttagctattgtaatgttagaggtaacggttacaaagtagctttattctggttacctggtatcccttgcacttattgagaaattcaacccaaaagctgtcccttcttttctgtgtgttttgttttagctgagtagaagggtcaagtgattggtgtaatgttactttcagttgaatgagacaagtacacatatcaaaaataatacccagtagtagtcagccagcggttttctacccagttgagaatgccaagggtatcatgtcacacatgtcttcctgaaataaactttctctgagagttgtcaggtcttcatgctcttggagaaagtgacttaaatggcatttcttggagaatccattttctgatgctttcaggcctgtttatttctatatcttgcaagcagaagaaaattttctcttaagaagttttgcattcctttgtcaaatttcttgccatagataaactaatgatgataaatgttattttatgttccaaattactcaaagagcaggcaggaaactgaggtaaatgtgtgaatgaatattacattttaattccaagcccatggattcttttatcaagaaacctgacaggtccttggggtgcaaaagaggaaaagacctcttaacccccagcccactaaaggaaagaaagcaatttggaatctggttatgacccaagctggatagacttaaggtgagaaaacgttgctagtggaccattgtgtccatttgtttttgttttcccccttgaccaaagcatctgtgggtcctaatgtgtctcctcctcgggccatagggaagatgaggaggaggccggcttctgttcctgagaacaggcagtgtgtgaaagactgccttaatcagaggtctgattaatgctaaggggagtcaaaacaaggaaggggatgacagtgtttcaggaagataacctttgccaagggaaaaaaatgagtaggaagcatgtaacttctgaggttgactaagtcaagtaagtcagacttaactagtatgataaacagtgttttaagagatgcagtgtttatgagccactattttaaatctaacaaaccacattcagtttttaaaataatacagggattggatggttagtcctttcaaatatgtttttgtaaggtggttgctgttctcagaatagggagatgtggattattttgttggaaggctaagtgtgttgtatttttacttgatgtattccctttaggttttgtattaggatgtggctgagatccagtctgtgagagcttgattgatttcctgagcattttttcagggaaattttggttttattcatgctaattttagtttcatggtccctttttttgaggcagtggtgtccagttctgtctgttggtgtggttttaatgtgttgaccatgtcagccctgagagtggaatttgaagtatgcttagatttagggacttccccaactggtttttatagctttacctgtctgcattgagatttaaagttaattatgcttttgatttgggtgctaattttaggtcttatttcttgtaggcaagttttattcccttgccatatgtatttcccagccagttaaatggccaaaataacttcagaaagctttaacttctttaagaaaatatccctgataaaggatcgagacgtttaggtgttacccaaacaagtgtcagtatagaaaaggaagcctttgcattctggtatttcccttattcctggcccaagaaatgattgcttacaaaatatatctgcatagtccgttagttttggaggctgagtgaaaactcctgtgatttcagaaatattgtatctgtgatctgctagattttaaggagaaaacttcattaagtcttattttctaggttaggagtactgtctcttccctcagtggacaggctgccgaagcatcttagcttagaataaaggtttttctgttaaagccaggagcttaaagaggatcttgacttgacccattcttcctttatactcagattcctgggctgactgatttctgttaactacagttactttattggtagtcttaactgttactgtgaaacacccatattctgctttcacttctggagaaaattgtttcatttccatagaggtaatctttctagtgttggagtaaacaggcttttagcaacttttgggttccccatttctatattctcacctatgttaatttttgcctgtggtaaaaatagcaaaaactacaccctcatttttgagacttcctcctttgtccatggagagaagggaagtgtccgttcagaatacttgatagggaattccaagggattgttgttaattggaagccccagagcatcactacatcctttaaccatttcttgatgttaaaggcagctgttcatatatttttcttttaatctttttacagtcagtcatggagggaggtagaggggaaaggctgtcacatttcatgtcaccccaccatgttttataatggctttgaagtcatttgaacgtttctagagtcgtctggggcctagagacctgaactcattttactggatgagttagcctttccttctgtgttaaacctcaaaccttaatttgtctattctgtgttacattataaatgttttccctgagcatcaaaggatcatccaaattttctccattatgttgtaaaccacaaaactatcttctaaagtgttttgagctgtaatttagaataatcctctactgtcctttcaagaatgtccagaatactctgaagatgtatcacacaaggaaatctcttgtgattttatctgaaagcttcacctttgattcatgccatatagtgacttactgtaatactgcttccttttgagtcttgccatttctgctctctggagtagaaaggcttaccaggctttactttgtctaagtttgataacctaaaataaaggttgccttgataattttacctagctatcagactgactaggagtaggttctgtcctttcctcatctactgttttggtgccttggcagaacttttccttggtttcattacttagtatacccttttgttgattatgtgtctttagctcgttggtgacctagttatcctggttaccattcctttgctatttttcattacaaatccccccttaacctgccagccaatcccagttttggttgggaaagctatgagtacacaatgtttacctaaactttggcttttgtatgtagtttctgtactcttttgcttcctgggccctaggttaggagctcctgatttagctgcctggttttgatgtgtacttaagtaactaggtaagttaggttaattcctggttttccataagtttgccctggctcatctccatttagctggagaagctgtggaggatctctgacaccctctctactcttatttgtgtgtagttcgctgttctgttgtagctccatctggttgctttcagttttttagggggcctcccaccatggttagatgcaatagggttttacagggtttagtgtccttcaagctagcctttgctttccactaggtttctgcttttctctaggatttgaaactgagatcatcatctttatctcttatcactgaattataagtagtaacttgaaaggtcaaggtctttttaaaaatcaagcatttttttaagtaaattatataaattatataggattttgttttattgattgcaacttgattgaaataggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtaagaaagactgtcttgagatttcctcgttactcttagctctgaaattggtgcgtgttttgtaaaccaggaaggtagagagggttagattatttgttggcctattaaatattggtactagaagtgaacttaagttctgggaggcaagactaaaagcggttaagagcctgggcttttggagtcagggttttctatttttgctggtttgggcagattaacctttcagctttagcttctttataaaaggcaaattagtaatacagtaccagttcttcagggttgttgtgaggatttactaaatgtaagtaaactgcttactagtatggcaaatatactgcagaacattggctttcagtaattagaattcttgataaataagtatatatatggtgcgcttttttttttttaatgttggtcaaaagtaggctatatatacatcctggtttgcctggggcgataccatttatgcctgtggtcaggcataattaacagcaccccttttcttaaatgtgtgtcctcgtttcgatgacaatttagagtcactctagttagtcaagagccactcaattttttgtttttttaactgctggggaatactccttgtgattttgttactgtattaaattaatggtgggcataatgggagacagaaaagtagagaatggtcttctgagggggaaagatgggcacaagccaagctagtaaaatgctgcgtgccttgatttgtaaaagataagtaatatgtctttaattggaagaaatactggaggagagcttgtggtttttagaacgcttcctagcaaagttgaaatgactaaataattagagaagaaaagtattgatcctactaaattggtaaccatgttagcatattcctggattgttccctcttttggagtttaactttagaacagagtaataaagaagacaatatttgttttcagtcataaccttaggaggtctttgtcttgcaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatcaaaaaaaaaaacttccgactgcattactatactgtagtatagtattagtacattagttcaaaatatagttctatgctaacattaactctttccaggctgcataaacctagttagatgctctcctgactttcccatttaatttgaagctaatttcttttgggtgttgttaaggcattttttacatttcatgaaaggcttcaaatgagatgatatttattgtgatttcactgtataatccaagtggtttaggaggagggtgcagggggggacttaatgtttttagagtagagtagaatttttccctagtaaattgttagtttatgaaataaatggaatctttaggtaaattcatcacagcatctggaatgttagcaacatatggctcactctttattctttcctcttgtcatctttttttgagacagggcctcactctgtcgcccagtctggagtgcagtggtgcaatctcagcttactgcagcttctaccttgcaggcttaagcgatccgcccacctcagcctcctgagtagctaggactagaggcatgccaccacacccagtaatttgttatatttttgtagagacatggggtctcactgtgttgcccaggctagtctcaaaactcctgagcttcaagcagtccaccagccttggcctcccagagtgtttggattacaagcatgagccactgcgcctggccaactcttgtttcttacgattgcaagctgtttatgacctgtaaaatggtttggtacgcatcccctcaggcttcgtttatgtacttacttgtgtattgtgtttctgaaaaaatcgaaccatacatgctcatctttttggcaattcagagcattctattgaatggaaggtgtgtcaacattacaattttttctagctgatagacacagtgtggttccagttatccttgtatgtcatgttatgaatatgtgaatttttcttagaataaattcatagaaggaaagatgccaagttgcttttcgccagcacgagtgcttgtttacctacttaattctaaggttgaaattttttcttttgcattctttcctacccattcccaaaaatacttgtagtacttgctgtaattttgtaatttctaagcagtgtttggtctaatcattatgtacttttcttgttagtgacattttggctagtatacagctccctttttaaacaactttgattttatgacaacttttccaaagtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagtaagtaaaagcccgttcctttgtaaaccatcagttctattgttaacgccaagttatcagtgaccaattgctaggataaggacaaggacaagtcagtaatacttcgaactttttctccaacctcttgtggagactcaagatacatgcagaataacaaaattttgtataacttggggaagttggtcctaccacctgctttattagttgccacctattggggtcaactataccccaattccgccaggatatgtagtcagtgtttacactgggttcacattctagagtcaaaaataaccaaaagcaaagttatgatgcagaaggaaaacattgttccttttttggctagtgaatgatgtcatatttggattttgatttgttttgaggcagaatatagagtcaagatttgaaatgtggggctagaccccatttaagaaattcagattttaggtacattaaggatggtagctaaagtcatctccaagtatagagaagaggaagaactgagaaacacttaatgacaaacggagtttcactcttcttgcctgggctggagtgcaatggcgcgatctccggctcaccgcaacctccgcctcctgggttcaagcaattctcctgcctcagcctcctgagcaggtgggattacaggctaccacacccagctaattttgtatttttagtagagacggggtttctccatgttgggtcagggtggtctcgaactcccaacctcaggtgatctgcccccctcggcctcccaaagtgctgggggattacaggtgtgagccaccatgcgcggccgcccatttcctaattaaatttttgcagtaggatcatagctctcggaaaatagcataaattttatcttaatctctagtgccagaaactgcctgggcgtaaacactagcttgaacatctgaactagaagatagcatagtattggaattagaaacttaaattctatttaggtgaaaggatgtttcctcaaattatgaacaaactttaatgtgtttgaaacggggtatttttattttttaaatgtatgctgttaatacatactttgggaaaaggaactatatgtacttaaggctgtgcttcagtcttagcttttggcttccagagaagggctaagaaaacttccaagggttaaataatgtgttcaggtttcagtcataggatctcagtcgcaactatttaactctgttgttttaacccaacagcagccagatgaatgagttggggccctattccaataaaagattattttggggcattggaatttggattttgtgtgtttcttcacttgtcatgaaatactgtttttccccctagttatttaaatttttagcttatgggttatacagaaacagccagctggccagatttgacctacaggctatagtttgccaattgtgtgctgctttggagctggaaatactgtcaggatcatagttaggtaaaataattgtttcaagtttttatgagtagcttttacaaatgaacatttagtagagggaacaacacatttgtaagttgtagaccttacgttctggctaacattaagataacttaatgcacctaactgaaatgtccagtgggatcttactcatagccacaggataattagtggctttgttcaggatgtatgtaacaatttatttaccttttgaaggctaaagaacgtgccaatggaatggagcttgatgggcgtaggatcagagttgatttctctataacaaaaagaccacatacgccaacaccaggaatttacatggggagacctacctagtaagtttattttcaaaataaatataattggcagtttttcacttgtcaaagaaacacttgtattagtggaaagtcttcagcacttaggtttgtgccataaacttgactgttgattgattaaatgctcctcattagggcatttttctcatagtagaagttcaaccattacaggtaaaactaaatcttagtcaagtccatttttaaattttttgtttgttgttgtttggttttgtttttgttttgttttgagacggagtcttgctctgtcgcccaggctggagtgcgatggtgcaatctcagttcactgcaaccttcgcctcctgggttcaagcagttctcctgcctcagcctcccgagtagctgggactacaggcgcgtgtcgcaacgtccggctaattttttgcatttttagtagaggcaggttttcaccatgttagccaggatgttctcgatctcctgacctcatgatctgcccgcctcggcctcccaaagagctgggattacaggcgtgagttgctgcacccggcctaaattttcttaaatagagcaaagtgatactatttttgtttcctcttagaaatatgtgggatatgcagattgacctctggcaggatctgtgtgcctccttaaccaaagatttttaaaaataggtttatatatattgaaacaagggaaagggcaatgtttgctcaatataggtgagaattttaacaggaataattttcattttccagttaatgtgtcagaaaaggcctactagtagatataaaaactcatgtccagaaagataagggaggtcacctgaatatttttttcttcatagtggcagctctcgccgtcgggattactatgacagaggatatgatcggggctatgatgatcgggactactatagcagatcatacaggtaagttatgaggtagaaaggtcaacgtctgaatctcagtacagtgtacagagcagcactatgcttaagttttagcctttgttaaaagctttgctttagtacttttactcgagaaatgcagagtagaaagttaaatcagattctaaggttctgtgtcttaatcaatttaatgtgtaactggatttctgttcaaatattctagaatataaatgggatttaaatgataacttggaatattaataataaaatgtgttttatttttaaacattgaatgaggccaggcgcagtagctcacgcctgtaatcccaacacttcaggaggccaaggcaggcagatcacctgagatccagcctggccaacatggtgaaccccgtctctaccagaaataaaaatttagccggttgtggtggtgcacgcctgtagtcccagctactggcaggtgaattgcttgaacccggcaggcagaggttgcagtgaatttagattgcaccactgcactccactgtaggcaacagagcgagagactcaaaaaaaaaaataaataaatgaatacatagtgaaagcaaaattataggctgaggcaggggaattgcttgagcccgggaatttgagaccagcctgagcagcatagggaacctccacaaaaaatgaggcaggaagccggggaggttgaagctgcagtgagccaagtacgctcccacctgagtctcctcccccagagcaagaccccaccttaaaagaaaaaattatagcctctgtcttagccttttaaaagcaaatttataatggcttataaaagcaaatttcataagccattttggaaagccaacacttttcaggcagtttcttgtaatctcttaatgcatgcatcgtacactgagggcaggtaaaatggatgccttgaaagagtccagagaataattttaaagatgttaatttagtatgacaagggtatgtggctttttatttttgccaaaaatttggtatttcggggtttgggtagggaaatgtcaatcatagtttaaaaataaagatatctttgagaatacttccaaagataaaaatgaagtaaaattgtgacattttggtcctcccttgtcaaaatgtgtaatttgacaagtcaaataatgtagttagtaagtattgaccacagttgtcattgataatggtattgaggtatatggatgtctattttgtgcattatttggcaatgtttaagaagttaacagttgtcagtcattgtctgaaagtgagtctgtaagtgtattgttcagcattttatcacccatgaaaaccctttttttatttaaagcatcactctattgaatggtactaaaggtacaaatttgttggggctgagatttttttcttagtttgatttttttttttaagagcatttacttaggaatgttctgtgttctaatactacttatttcagccaccagagagaaccctatgccagtttctaaaaagggtggcaaatcacttgacctgcaagaaacatctcattcatgctctatgaaagtttttattttactaaatgaatgacataattttttaaaacttacaaactgaatgcgtgttgtgttgcctttctgtcttcacagaggaggaggtggaggaggaggaggatggagagctgcccaagacagggatcagatttataggtatgccaggagaggacttagcatctgtacaacagtataaagcttcacataaagatgtttgcctagtaatgttttggtaaattataagtggaatacccaaaatcagactgtttgaagctcatgaaaatattctaacggaaactaaatgtataaagtctttgtatatttataaaaattaattggttttgcaatagattatttagtgataccattttataccgtgatgaggtacagtgatgttagtcactgataactcattttttttgtcattatgttcttgtattacattttccttgctttttaaaagtaagcatctcaaatagcacaagaacattcaagccagcctttttaacacaaagctaaatcctgaagcacttgtgaaattagttttgggtgttcaagagggtgctgttgggattatttaatggtatgggaattttctcatttttatttttaatttttggagacagagtgttgctctgttgcctaggctggagtacagtggagcaatttgagctcactgcagtctctgcatcccgagtagctgggattacaagcatgcaccaccgcacagagctaattttttttttttagtagagacaggttttcaccatgttggtcaggctggtcaaactcctggcctcaagtgatcctcctgccttggcctcccaaagtgctgggattataggcgttgagccaccgcacccagccaggaattttcttttacaaaactctcttaacatagttcacaaaatttaaaaagtaagtagattaaaatatagcaaggattatttgaccttaaagttattaagagtgcttatttgacacttgggcctgataatgtgcttcattctcaagatttaaacagaccttgaaggttcatgcagctttccttttttggggaactgatgaaagggcagtatatatagtcataaatttatatgtttggtctaattgtgatctattgagacttagacaatcttgacatttgtttatagaaggcggtcaccttctccttactatagtcgtggaggatacagatcacgttccagatctcgatcatactcacctcgtaagtttttatcttaatatgattgtttatattgtagtatggcttgctctgatgacagtgtattccctttatcagataatggattggtttcaggtagtttcatacctaatgattctccacacatcctgaacattttttggttcaagaaagtttgtggaaacaacccttagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgctatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgccttgctaacctttatcgcatctaggtattagtatgtttcaggtactttgggaagaactttacatataatctttagcaatgaaatgatgtagagtaacttaccttagttcaaatagctgtttaagtggcaatgccacgatctgaattgaacctaggtgatcttagtccacagttctcttgatcatgatgtctcaaatctgggtacctgggtgatggaaaataccagtaatggagcataggcagtattggcaggtcttaatttgtaaaacttactgtccagggtgttttcagtgtttgccaacttgtggtaaattaatatgcttagagaactacccttaggtttgtttctgataagcatgtggaaacaacttagtatatgcctgatgggttatttcaaattgttctcaatgagttttgaaacaagaatttgtagtatttatatataaagttgagttttagggtgtggtcccagagggggttgtgttatggatggatacattaaaggctgagaaacctggttttatcgtggtagtatatacaggcatcctttcctgaagtaactacattctccaccattttctccccaaccaaacctctccccatcagttaactgatggcttgcgagttcacactcctgataatctcgaacataaccctcggtttctatcctaaagcctgagttttagccctttagttgtgtagccatcctttatcctgctgattgaaagtttccttttttaggctagtttgagttgttttctggcttttagatttgaaagaattttagccatttgacatggctacaaagagtgttaacaggcaaaagactgaggaaaatttggaattttaccaagttgagatagactgagaagtagtgagacaaagtggtagtcttttgatgtgctgtaatgctagtcgccagtttcatgaaagggaggcagcagttacccgtaggtaacccctaggtaactgctgccatgggcagctgaatcagacaaaagccatgggaaaggataaatttgagtcttaaagttactgcctcaaggcaaagggacttggaggcttttatatgccaatacaaacaatccatttcttatagctgtagggctgagactactaaaaccaaatgtaaagttcatttggaagattgctaagttaaatagttttatactaggcttttgtgaaacttctcaggaaatcaacagggtcccagcaagtggaaataaggctgtgtcaaaagatttgtagacctgggagcaggggtttccgatctcctggccatggattgcctgagctccgccgcctgtcagatcagcaacagcagattttcatagcaggaatcctattgtgaagtgcgcttgagagggatctagcttgcacatttccttatggaaatctaactacatgttagagaatgctcaaggtctgcaatgtttacattgttgcccctacataaggaatatatgccttaagataaaactaatagctcttagccctcttacaccattgactaggattccaattctgcaaggcccaggaggagaaattgagaattagaagtttcaccgagaagaaataaaaagatttggtttgcattatcaaaatttctgtaaattatatggaaattttgaggatggattaggctggatttattagcagtggacacgcctccaatattcc

SEQ ID NO: 13154 - DNA, 52398 bp, Human
  misc_feature (1)...(52398): n = A,T,C or G
tctagcacctacttggctccaagaatggttctaggcactgagaatgcagctatgatcaaaacagacaaaatccttgcactcatggaactcaacattctagcgggtgaaggtaaatgaccaataatattgataaataaaacagaagtggtagatagtgatacataagcagggaagagggatagggaacatgtatgtgtggtgatggagaaggggattgttgaattacaattttcaataaagtggtctaggaaggcttcagtgagaaagtgacatttgagcaaagacctgaaggaggtgagagtgcatgcagagtgaacagcaagtgtaaaggccctgaggtaagagtgtgcctggcaagtcctagcaacaacaaggagtcagtgtgactaagcaaagctagttagggagagtggtgggaaatggtgggagatgtccgaaaggtgatgacagcttgtcttttttttttttttttttttttgagacaaggtcttgctctgtcacccaggctggagtgcagtggcgccatcacagctcactgtagatgtgacctcgctggctcaaggggatgctcccacctcagcctcctgagtagctgggactgcaagcacttgccaccacatccagctaatttttatagtttttgtagagacagggttttgccacgtttcccaggctggtcttgaactcctgggctcaagtgatcctaccacctcggcctcccaaagtgctgggattacaggcatgagccactgtgcaggccagtttgtcttttaacttgtttatattgtcttaaagtacatacattttgaaatttcatgtagctaaatgtcttattctcattccatattccaagctcatactcaatttttttttctgaaagttataaagttttgcttttcacatttagatctttaatccacctggaactgatttttcttccatggtttgaggtaggggtctaatttttataattttccatatggataagcagtagtcctagtaccacttagtggataatccattctttccccactgatttgaaatgtcccacacgctgcatatcaaccttccgtatatgtgtggtctgtttgaggggtttatattgtgtttcattgattgtctatctccacagcatacttttaattactacagatttacagtcactcttgatatctagtgtattatagattctggagcaaatgaataacacgatcgaaaaattactttgggaaaaatatttttatggctgtcaacagagtaaacatgtcaaaggaaagagtaaacccaacaggatttatttaaagaaaagtgcaataacccagataggctatcacaagggcttacaataaagttatggcagtgtgaatggagagaaaataaggaatctaaaagtaattccacgtaaaatattaacagggtgtgttgactgattggatatagagatgaggagggggaagacgatatatggctttccagtgaaatgataatgagttagttttgtgacgcagtgatgtgttaacaatggactctattaggtaagaggtctgggccagggatatatatttggacattgtctagttagaggtgaactggaggggacgcagaggaggagcaaaggtctgggctttggggaattctccgatttagggcgtggaagaaagaagaggaaaggaaatggtaggataaccaacacgggacattataaccttaagaaatatatatatatatatatatgtatttttttactgaatgatgtgggtcgtattgacacaacaggtttgagatctcccataggtatgactgtgttttgtttctgtggccttcaaagtcctcagaacaattttgatgtcacaggtggcatttaaaacccattccttgctggacctggtagagacgcccccagtccgtcaggtctctcgctgcagttccgcagtttgaccgcaggggacggaatctgcggcggcctggaaaactggcgggggcgcgaggcgccgctctctcttgggtcagattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccgtatccgccggtagagaagggagaggggaggccgcgcagggccgggggtgggggtcgggggccctgcggaacacggtggggcggggcaaccgggtggcccagaggccgagcagagagggggagggggccggcgcgggagacgaagcatggcggggcggggcgggggagggcggtactaatccgagggactagattctgggctgtggtcatctcaacaatgtagctactctattcaatcttcatgattttgtttttacattagaggaaaccaaggcacacaagttttactggtttgcccaagggtcacctctctgtaacccactctagcctttggaaatgttagtggtgttccacttttctgctgaattttgttttattaaattctgaatttagnnnnnnnnnnnnnnnnnnnnctcacttctctccggcggatacggcaaacggctgggctccggccggaagcggcggctccatccaggcaggctccgggctcagcagatcagcggactgcgggccgatgggggtggaagacccccttcgccccgcagtgcaccactcctccccaccgcgcttccgaaggagacccttgactagcgcccgcatactgtcgagggtatggagatgaagggtcctctccgggagccctgcgccctgaccctagcccagaggaacgggcaatatgagtaagtaaccacctgattcccacagaggaggggagcctgccattacctcccaaccccaaaccgcgacgggtcacccactgtcctcctactgaagccacgcgggcaacaggttcaggtccaggtgtgaagtgccagtgctctctaacctcggggctttgtccccaacttccaagcctctggattgtgcttggcagtgtggctcagtggaaggactgaatgggcggggaagcaggaagcctgggttcttagttcctgcccctgcaactgacatgtgttgtgtaacgttgggcaagtcaataaagctttctgggccaaagttaactcttcagtttaataaaaccattaactgccttaccttacagcctttggaattataactgggggaaaaataaatgcgagagtggcttccaaaaagtaaaagtgctatggaaatgcttcattgttaacgttacagacttgtcttaaccctattcagctggtttctccagtctccccgtccccttatcccactgggttgaaggcatattcattaattcagtaatggtttagtgtaggccagaaactgcctcacttactgactttactgttagaaagaaaaggtaatgaaatgtgtagagatagaaatgacagtattttatcagtgtgtcaccttcctctctgccataggagctccgtaaatactgttgactgattgatcaaaagattattttgataagctatcaccatagctgctaacctcactctattgtcactaatatcttatctcaaaaatatccatggtgaccattacgtatcataggcccctatccctgtgtgcccaagacacctcacttggatattcattggcttcttgacatcatattccttcccagtttaaaaattgttcacttaaatcttgccatctcccaacattggcttctgcctaaaaccaattttctcagtccccacttttagatcctctgtatctatgctgtcagatttacacggaagaaattcccactggcccaacctgctcttctctgagactattggtgccactctaactggatgtcagctaattctgtgaagtagctctttcataggtcctgcttagtcagctctactgggaagttcatcaaacccggatttcatcaaaccctggaagactagtttaatgaaactaaactaaattcagaatttaataaaacaaaattcagcagaaaagtggaacaccactaacatttccaaaggctagagtgggttacagagaggtgacccttgggcaaaccagtaaaacttgtgtgccttggtttcctctaatgtaaaaacaaaatcatgaagattgaatagagtagctacattgttgagatgaccacagcccagaatctagtccctcggattagtagatttggaactctgttgagctaataaggaagtcgtgtgttccaattctgtgtaagttatgggggtatagttgggggtatatgtgggggtatggggctgctatataactaacattaatatataggtaacactatataacaactatataactaacaactaatatagttgttgctatattagcagtttatatataaactatgtaaatagttttaaatatatataaactatagttttaaatacatataaactatagtttatatataaactaacatataactaacaactaatatagttgttgctatataactaacattcaatggctgcttatgtgccaggtactgttctaagcccttttcattagttagttcatttaatccacatgtgagggttactataagatagtaatatcatcatcccccttttatagatacagaaattgaagcacagacaggttaagtcacttgtttgcaattagggagtagaatacctgagatctgatcctatgtaacatgtctcagaattacactgagaagtttctcttgaaagcatttgctggagacacctaataccataataccatctgtaatcctcatattcttgtctctctggtgtcttttctgactcgagtgtccagaactttttacttttggcttttttatcctagaacttgaagcctgacttaaatctttaggtctgtggttcctactgtcaaccataggaaatttgcttgaccaaaattacaattaaaaatcagggtttttttggaaacagggaatcaaacacttaagattcatatttttcaaggataatagattatgacaaaacctgtttgacctttaaccttccttgaacaaatcaaagtgtttcctagggataaggcagagttggcattcaggatttgtcactcttttctgtttgacaactaccaaattctgaattccattgttttgctgtataccaattatttctaatctttatattctgaaatgaataattacactcagaatttttatgcttattcttagccctactcttttattgtaatttagtgggtaacacgtagtaaatactcaataaatgttggtgaaattcacttaaattctcagtttatttgttttgtaatagtttttaacagtactgtccagatgaagctttaatgctaatgttcaacaccatttcttgtttatgtattttgagattttagtggtttgtgtttatcttcctcaaagtaagctcttcctccttaacccttgatttctcagccttttatctggtttctggtttccatctgggtttataggactctccactcaactcatgaactttccagatggaaaggggcctgccccatattcctgtaatcaccttagagtacaaacccctgcaaattaggcaagaaggatcacagcagaaaaacagcattaatacttttatttcccttagttctatctaagtaattacttatcctatcccaggttatcctcttcaaagttaacacatttgaaaatgcaaaaagcaaaagcaacaagcacccccaaaagacaacaaaatagaaatcaaacccttcaaaacaatgacattttaatgtcagaagttggacagtttcattgaaaaattcaccgctgcttatagcttaattaagctagttaatttattcagccagtatttgttgagcatctattaggctgcagacaaaactgaatatgatctggtctttgctttcaaggagctgaaatcagtgaggggaaataaatataaccataatggagtgtgtaagtgttctattagaggggcaaacaaaggcgataaggctgctggttctgcttgggggtactgaggacagtttcatggaggaggtgatatttgagatgaaactcggaaagaaacagagtgttcctgacaaaaaactaaaaacaatacttgaagagtgcttgactttgagaatgctagttgacgttcagaatggctgtttaccagtaggtcgtaccttgattctggaccactaaggataaataataaatgaaaaattaatatttcaggagtacgtatggatttagaagtatggatttcatctggggagtcaggtttactcatgtttatgtagaaataccagcgtaaacttggaaaccagagaagaaacaagggatttgaaggcaatccagttgtgatatctgccaccttgttggtcactgatattttgaccaatccagctggctgagcaccccctcttactcctccatgaacctgaatgcttgtttgaagagacagatccattctttggtaaaaagccatgggaatataattggaaggttaatttatgaattttctaattcattgattccacacacacgagcaactcctgtgtgccaggctttgtgctaggtactagaaattccgtggtgtaaagatagctgtggtccctgcactcatggacttcacatctagctgtcagttcttcactctggtatgcatactctgaagctatatactctgtaattcatgctcttaagcttgtacactgtttttaggatatatggcctagagaacagtgtgggtaatcagatgttcatcaccactagcatccttttaggcctagagcaatatctagctgtcatgatgctcagatccagggaactagatgcagcaagtctagtaaatacagactagatttgtataacaggacagtgaagtatttttttgctaaatgagtttttcagtggctgttctttgatgcgttcttctgtttcctaggttaataatccagttgcatgagaaggaacagcatgttcaagatatcattcctataaatagccacttcagatgtgttcaaggtactagctttaattccttagctagttttataatgttttttctcggtcattactgcattatgtaataccatacatatttaaatttgtcagtgcatgtaaaatgaaatgtattactctttgcataaaaagataacattgaggagatgatactttctctaagaatgctgaagggttatatcgaaatatatttgtatatgtgtgtctatagtctcacctgtttccttggcttgggttagagatgtatgtagattgttacctgtgtaggtagttttttatgctgactgacctatatgtggatttaaataacattcttgggcttaacggacacagtgctcataaggtaccaaggtcacttggattcacacacattcagcactttctccacatgctatttgaaattaagacatttggcaacatgccttgccagactgtaatatcttacactcaattgtgctgattctcaaaccttgacattggtgaatcataagaaaattgactctggggaggaaatatttggcctcctgccctcaaatttggggacggagcatagaaaatctgttgtttcatctgctacaatgaaacttaaaaattgggaggtttgtgtaggaggtgttgcttctgtcatctcacattgctctagaaaggaaattgatactagagaacaaatgcattctgttttcactaggaccagtggctttatctagcagaagcattctgtatcaattgtagcttcttggaaaacttgttttttcaagacaaggtcatttcccaggctcaagtgatcctcccacttcagcctcccaagtagctgggactgcaggtgcaccaccccccagctaattttttttgtaatttttgtagtgacggggtttcgccatgttgcccaggctggtctcaaactcctgagttcaagcaatctgcctgtctcggcctccaaaagtgctgggattacaggtgtgagccagcatgcctggcctttcttggaaaacttaaatcttaccttgcatggattatttcttaaactacattgaactttttttttaatcactaagtgacatgtacataatgtaatacatttggaaagaacagaaaagtgtaaagaaaataggtcacttaaattcccatcctttcagagataaacacctagcattttccttttttctacacatacattgcagggtgagtgatactcatcttatacaattttttgtctcttctacatgctattgtattatgagcacttttccatgccattaatggctatataccataccagtttatgaatggtccataatgtaattattcccctatgttgacatttgggttatttttcactagtatcaatagtaatatgatgaacatctctgcacctaaatatacctgcacatctcttatttcctcaggatgtattcctataagtgaaaatactaagctagtggatatgactttttaagaatgcatgtgttaagaattaaaaataacttcaatgaatagtgtccatatttgtatggaagaatgaagtgatagctatttagcctgccctatgtgagagagacatactaaacaaggtagccacgttccatagtaagttgctgtggccacctcacttttcaaggtgtaggccttcacagaggggaagagccaaagaacatgactttaaattaatatcctattagctttgtacctttttactctacctctaggatctcttttaccctgtttctcttagtatttttaataagaaatcaattgctgattgttagatcgtagtgctgcttcttagaacctgggaaaatatgtgcacacatgtaacgtagttccccatgactaaaggaagacttacttttgattttcatctcctttctatttcctgacccctgcatctattttgtaaactgtggccaggcgcgatggcttgcacctgtaatcccaacattttgggaagctgaggcaggaggattgcttgagcccaggggttcaagaccagcctgggcaacattgcgagaccccatctgtacaaaaataaaattaaaaaaacaacatttgccagacgtggtggcagatacatgtagtcccagctacttgggaggctgaagcaggagggttgcttgagcccagcagttcgaggctgcagtgagctgtgattgtgccactgcatgctaacctgggtgagagagtgaggccatctctaaagaaaaagaaaaccggctgggcgcggtggctcaggcctgtaatcccagcactttgggaggccaaggtgggcagatcacaaggtcaggagattgagaccatcctggctaacacgatgaaaccccgtctctactaaaaatacaaaaaattagccgggcatggtggcgggtgcctgtagtcccaactactcgggaggctgaggcaggagaatggtgtgaacctgggaggcggagcttgcagtgagccgagatcgtgccactgcactccagcctgggtgacagagcaagactccgtctcaaaaaaaaaaaaaaaaaaagaaaaagaaaaccatctgtaaacactcaggttttacagaactaaaagttaatgaagaacagtagtaagcatacaatatctatgtcttgatgccctaattccccttgtttaatcatcctaataataatatcgagactactttttagtgttaaaggagttagttccttgccagttgcttctgttgtacctgagtaatggagccaaataaacaattcagtcttgggagggaggtgaaaaaggtgagactactccatttgaccaaggtagatccaggctaatcccaaggagtcagtacccagagttcaattagccaggagggtctggcaggtgcacttggtcaaatccagagaaatcagaggggaagagataggttgggtctagacacttgttgtaaaggaagaagtccaggagaaccattgagagataagagaaatccaaacttgcagactgctttgcaccctgtttggtacggagggccttgggcccacaggtagtagttgtaacctgaaggtatactctgcccccatgtgtggggcaggggcagaggtgatgagatcactgggaaattttcagagaatagatctgagttaagaaagtaattcacctctgggctttcagggtcacttcctttgccttctgttatctaaagaagtatctaaaggacccagagttaaatcattatgttacagttaaggggaattaaacttgctttcgctgaattaacatgttgttatgttctgtactattaatttctcattcgttgatttgctttgaggagttccatttggttacttcttcagttcatttttattttagttgatttgctcatagtctttagaacccagtgctataaaaaatccctttaaaaaatattaaacgaaaagggatttaaaaaaatatgttctaagacctaggagtagtgactgagagaagcagttatttagttaggcatgtattcttttggttgtagtgagtggttttctcttccctaatcctactctcttttttttcccctctcagaagcagaagaaactcttttgattgacatagcttctaacagtgagtatctttctgaatgtgcttgatttttactcaacaaatatttacttgaacactcactacatttaagacaccttttggggcacattttttattttaccatcttttcctgtagtctcctgtagcagccatacaaattagcactgtttcccaaaaacatgtaggctaagcctaagaaaaagcaggtggctggtaagaatctttataaaaataaaaaataatgatctacctttctaatgctgaacttccgtgagctaccagtattgttgctgtcagttgaatcattgctgtagaattgataattgtaggaagggctgatgtttaaagcacataaggtttattggtggagtttttttggtcattttttaactgctattacattttaagttttttccctaccctctttttaaattttgtgtgttaagtcataatattttcctttatttgttgtatttttttggaaggctgaagagtcccttaaattgcttgtccaggcattcctttaaaaaaaaaagtttagtcttttatttaagccccatcccctcaaggcatctctttattagagggaacatgatcttcttttcaatgtttccattctctcatttttatctgtttgaagcaaatcatctttgactttctgtgcaaactgttctttgtttatcatctaattgtactattttatggagtggagaaaatgggcactcgatgctactgtgaggttgctatggaaaagagtatctgaccacatgaatctaaatcaaatgggttgccttatctcttggttgagtccttggatgagtgggaactggcactgagcttgggactaggggtttacataactttgtttagacagtccctgcccttggcactattaatttgtattgaacactttaagtaggctttttttctggcttgagtttttttttttttccctttggtcgtgaattttagaagtcttaaaggctgtgcctgaaaggccaggtaaaccccagctgcaagtatccaagagagaaaataacttaatgtctatttcttattgtgcttagaaaggagaaggcaaaaacaacacttaaaaaagcaaaactagaacaaaagcaattccataacaactgacactgctgctgaaataagagatggaaatgtcctgtatttgatgtggagaagtatttgattcaaagctgaaaagttaaactgagctgtgccttttctcttataagcacctaattttcggcattagttttgttgtggccgcttctacattagccatgtgttgctatgtccagagttctagttactggctcatagggggaaaataggtaagtgaccacttgaataaaatcctttgttatttctacccatttagtagtatttgcactgaaaccatattttatcttgatccttgggcttcatacataaacctttatggtacacggtgtgttgcaggaaggagatcttgggtttgttaggcaggcctgattttaatgtaaatatgcattttcccattgtctggatattggtgttaaatgctttgtaaataattttttctcacagaagtaatacatcttcattatatacaatttactaattcagaaaagcttaaagtatcaaattaagattattttcctgcaatctagagatcaccactgtggttaacatttttatgtatttccttccagtctttatatttttacataattggaatcctcatatgcagtttttatcctgcgtcttcatttaacattatattgtcccattttcttatgtcatttacaattactttataatatgctttttaaaaaccaaatatttcaccatagggtctgtgccaaattttattaaattaacttctttataaaattaagtcattgtcaaggaacatgatatatctgtttttttcaggtcctcttttatatctttccaataaaattttatagtttcttaatatatatagtttttaggttaagtatttcgtggtggattttatttgctgctattgcgagtggaggttttttctatgtccttctaattgtttattactagtatacagaatagctgttgagttgtggatatttatcttttatcccagttgcttccattgaaatttatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaataccttctgtctgtgaagtctgatgttactgtcaccagtagagtgaccagcaagccttatttgcctgggactttcccagtcttagcattggaagtcctgagtcctaggaagcctctgagtaccatacagtgctgggacagttggtcaccctagactcctgaaagtgctgggttcgctgtatgtgcaccctgcatgcgtaccctgcctcttgcccttaaggagcttgtagtttccagaggcatgagaaaacaacgtatgtaataaatcagttacaataagaatagaaacaagtacataggtttcctggatcaccacatccaaacagttgatatagatgataactatagggcatcaaaaaaggggagacaatatgttatacacataataaattaaagccctagctaactttgcttctaattctcctagtttccaattggctgtacttgaaccaaaccacttctgagcataggtcattatattgtttttgtatgtttattcaagacatacattttaaacttgaggtaatgagttgtagatgcttcttttcagaatacttcaaaccagtatcactatttttaagttattttgtaaatttaatctgtgcttacggacaaaccatcctacttattttattcccttcatgcttcagatactctgacaatgtgatctggacttgaaatggtaggaatttccagctaaggaatgggagggagggtgattgaggaatttaccttttgctggaatttgaaggtccctgctttgatgtctgagagatagatcagaacgcaggaaagtataattttagtatgtgtcatatccttagatcgggctgctcatggacacggttcatcagccttaggagttctcacttcccttagggttccctctctgcatcaccccttccaccaccgtcatactgactctcttgatcttgtatgtgtgcttcctatattagagatctggaatatttgtgatctggaccttcttctgttaacctgataagttgagaatatgatcccagtaaaacattttatcccatagcagtatatgtatggatttcaattctttttaggtggctgcaaaattcgggttcagggggactggatcagagagcgccgctttgaaatccctgatgaggaacactgtttgaagttcctctcagctgtccttgctgctcagaaaggtaactaaagactcagcgattttctttcttctatttcaacgggagtggaattctgacatgctgatacagaggaaagtggccattggcaaaatacctcaccctttaagccctgatagctgatttttttttcttcaggagtgaacacagggataggttagggaaaaaatctgcccagctttaaggacactaggcaagttttcagaatattcagtgtcatggcaagcacagcttaccatagactataattctccttctgcccctagatgaccccagagctgccctcatttccttagtttcttccactgtatccaaaaatggtgctggcccctgcatataaggaatgttgaaagaatggcttttggctatagtaaattctactcagtgaaagacttcccagtttctgaccatgaaccttatctctctagctcagtcacagcttcttgttccagagcaaaaggactcatctagctggtaccagaaattagacactaaggacaaaccttctgttttttcaggtactaaaaagttcctggtttccttgttgctatggtcattgcagagtcagtagattttgtcaggccaaatatggtgatgtagattaaagctgatgtcagacacattctcctgcagagtagttttatcaagtccaggcccactgaccagtgttcactccttatccttcctgtagcatggtagctgttcaggagccagcttagcagggtggtagaaagtacaagctcgagagccagacagcctggatttgaatcccaagtcaagaacttactagttgtacaaccttcatcaagttactcaacaactctgaacttcccttttcctttctgtaatatgggaagatttttaatagtacttacttcttggagtttttgtgatgattaagtgagatcatgatatagtcccttactctcaaccaggcattgtgctcagtcttcaataaatgttagctattactagtctgttccaagttcttataaacttctattgttctagttagtatatcagtgcttcagggataggtatgcttcttcgaactccaatccaagtaatttctacccttatgatagttttctgtttagtaataccactgatcaaattgtgatcaaatcaaagccctgttaccctggatatgttggatgttagattttttccccgtttgactttggggtctgtgtctttcagggcttcttggatttgaagacaatttttcttctatgaatttggacaagaaaataaattcacaaaatcagcctactgggattcatcgggaacccccacctccacccttttcagtgaataaaatgtaagtcccatgtgaaaacatatttgccttgtaggagaattatagtttaaacaattttacttttgaatctctcatttatttgctaggcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcaggttagtgtctcttttgcttcctgagtctaaaaagttagtatatataacagacagtggcctgttgatatttaagacattagcctaattaagaatcaaaatatgataaaaaggaatggttgcctgtttcaagctcctgtctctatgctggccaataacatgcatatcagaaataatgcagatgctacagtttcccttggattttctttttttgtgtgtgtgggtcagggtctctctttgtcacccaggctggagagcagatagatcatggcttactgtagcctcaacctctcagtcgtaagcaatcctcccacgccagccctgcaagtaggtggaactacaggtgcacaccaccacatccagctaatatttgtgttttttatagagactgggtttcaccaggttgcccaggctggtctcaaattcctgagctcaggcaatccacccgccttggcctcacaaagtgttaggattacaggcttgagccaccgtgcttggccttcccttggattttctaactactaataatgccatgtctactaatgtctctactgagtcctagagaaccaaatcaaggtcacatgtactagagaattttcccctagcacattccataagcaagcgtgtttatatatctggcctgttaagtttttttttttcagccaatattagaaaattaaagtccatcattaccactagctcttaacttacttactttggtaaataaagaaagtttcacccagtcctcttgattgggaggtctatcttgggttcttttatctgtattattttttatttcatcttttttctggacttgtgtgtgtatgctgcatgtgaggtaccatgtggcatgtatcgccaatgcatgaagcaacaccacatttctttgttattcatgagcagaatgtacccttctagtccaagattctagtcccatctgctatcctgtcatacctcatttattctaattcagtcataactatatccctatgctaaaacttgcagttcctcatatcccccactatgcttatatttgtgtgtaaacagttaagacagtcatgagttttcccttctgctttcccccttaatactatgtctgcctcatcagaatttcctacacagatgtccttgtaatccttcaggaagtgagttcctggagtcaactatagccccttatagaacatttatccatatttgactagcttacagcatgaagatacctctttcccatccataagctctcctatcaagtatgagtttggatggagcttaattgaaaggaaatgtggtatagcaattacctttgcattttttaaaaataaagacttggtttccttctgtagttttacttaatgtaaaatttagagaaaataagcccactgcctttgtgttctagatgcaaaagatctttcttacatatgtggcaaaacattttgaggaattatgttagcatattgtgaacatacctttgtatggaagcgaaaagaaagaacttctgttggtttatacttgatctttgttttcaaattatcttttcgtattatgtattagattttttgttggaacttggaatgtgaatggccagtctccagatagcgggttagaaccttggctgaactgtgatcccaatcctcctgatatctactgcattgggtaaagaacacttctggaatttccttttggctatatgtttggtgttcatttacatgatgttttgccttttttaaaaaagactgttggtaaaacctactgtagactatacacgagagttaacttgcgggtcaaatttgtgagaacagaaatgaacagatacctaaaatggtgtaaggaagcatctaattttcttgaaacccgtaggaatctatatattctgcatagaaactaagacttggggtcagttctaacagtgacagttcctaggatataagagcaaagctctgctgttatcctctgtgggaggtattttgatttattttttgcatagcttatgaatgtacttgtgggaattctttagaaaagaaagctacttgttcttactgataacctgggtgaacagagcagttctataaaatttatctctctcccatctttttttcatctaatgtttcaacatatgggacaggaggtagccagagataattatgggatatgtatagatctcatatcccttttttcctcagattccaagaactggacttgagcacagaagccttcttctactttgaatctgtgaaggaacaagaatggtccatggctgtagagagaggtttgcattccaaagccaagtataagaaagtaagccgcatttaattatctttttaagtgtatgactaaatagggctcaccgggagttattccattatctacaacttgttccaaaagaatagtttaattgaattcttctctgtgtgtaatactgggatagggcagattgatcattcatccttatttcctagaaaaaaaaatccctaagctttctgatactatattttcattgcttagatagcttttaggggaaaaaagaattttattatgcttatatcaatacttagtttgaaataattacatataagatttagattactcactgacatggtcagaattgaatgctttacagaaaagcaatatgaaacgtgggcgcatggtgcatgtgttgcaatcagagcaagaatagaagtggtgtggaatttgaacgagttctaaacttggttttaagttaagaggagagttgactttagcaagatgggccaatttgtttgtctttagaaggtatgtggtaaaggcatttagctaccagaagagttaattacagggctatcatactaaggtctctaaaagaagtaatgtgagtaatttttctctacatcttctaacagtttatataggtaataaaactcctggggatgttattcctctcatataggtccctgactaatgtatatctcagacatatttctagctgtagttcacaagttaaaaataagtaaaaaagattgctgtttggttgatttcaatttcttagaaaattagacatcagaaactaggaaggaaaggtggaaggaacaagctgggatagtggctttattatttgaacttttaatgctgcttactcctggtaggctaagaagtgattaaaagaatagatctagagctgaaagtactcattgtccctcccagcttttaactcttattggtcagtgccagattagagcctccccagagaatattagtttccacttgacggggtccactgagaaattagaggatatgaagtcagatttgggcactagtatatcatcttgatggaaaattagtcgtgggacattagaaatgtggcaaagattggtattaacattaaccttttgtaactccccggaactcataggttcaactggtgcgccttgttgggatgatgcttcttatatttgccagaaaggatcagtgtcgatacattcgtgatattgctacagaaacagttggaactggaatcatggggaaaatggtgagttactttggaaatgagcttgattattattcatgttcatgtaaagttcagttgcttgttctgtgtactaattgaataattactcttgctaacagggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgagtaagtggttaactcacctgtagcctttgagtagtggctacaggagtttggatagtgtagagattaaatgtgagatactgtagagctgtgaagagtgaaagattaccagtgagggattggggtcacaaaggagagggtttttgagtaataacagaatcattgaggcagagaaattagacttgatatcagaggaaaagatagttctattagtggggcacctagaataatgctggagggtctgtagttggagtcagtttttattgtttttatgataaaatagaaatattcattgcaaatgtaataaaagataaaattagaagttaaatttcctcatttcttattctctacctagccagtccctctctccaaaggaaaccattcttaacagttgggtgtgtagccttttagatctgtactgtccaatatgacaaccagtagccatatatggctgttaggtacctgaaagtgactggtccaaattaagatatgctgtatgcataagctatatattggattttaaagacttaggaagaagatgtacgatatcttgatttctaaaatattgatcacatgttgaaataatttggatatattgagtaaaatgaaatttattgatactcacttgttttttttctttttaaatgcagctactagaaaacttaaaattatattgtgaggtgcattataattctattaaatagcactattctagccttttgtctattcatatacaaacacacacataggtacttggtgtataagactgtattattctatttattgtggattcctttccaagccagtatatatagatctacattattctttttaatggctgtgcttattaaaaacaggggcagcagagagaggtcagtgaagaatgggatttaataagcatagaagcagagatgtgttgaggagtagatgtggtggtagaaaatgattagttttaaagaaattaatatacctaaaaccatgaaaaccctagaagaaaacctaggcattaccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaacgcaaatcaaaaccacaatgagataccatctcacaccagttagaatggcaatcattaaaaagtcaggagacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatataccccaaaggactataaatcatgctgctataaagacatatgcacacgtatgtttatcgcggcactattcacaatagcaaagacttggaaccaagccaaatgtccaacaatgatagactggattaagaaaatgtggcacatatacaccatggaatactatgcagccataaaaaatgatgagctcatgtcctttgtagggacatggatgaaattggaaatcatcattcacagtaaactatcgcaagaacaaaaaaccaaacactgcatgttctcactcataggtgggaattgaacaatgagaacacatggacacaggaaggggaacatcacactctggggactgttgtggggtggggggagcggggagggatagctttaggagatatacctaatgctaaatgacgagttaatgggtgcagcacaccagcatggcacatgtatacatatgtaactaacctgcacattgtgcacatgtaccctaaaacttataataataaaataaaatttaaaaaattaatatagagagtagagtcattggggaaagaggaggaaagagtagggatattcaactattttccataatgtctcaataattaggatcatgtagaattctatttcacagtggtaaagtgaaggccttaaaatgtatggtcatgaagttgccatgaaattccaaaaatttattttcccagattccataaatttcatgttgcatttgagattgtcagaatgacccattgggaacttgagctcactcaacaggagagtccattttgatgtgttaattgcattgtctccctttgtggggctctcagcacatctaagggcctgttgctgttattgggagctgaggatcccatggaatgccagtctccttcctgcctgtaacttgggcaatggtagaccaatcaggcttcactagagagccctggacctacttttcttagtgggtcctgcctcggagagctgtcactcagaccatgcagacttcagtggagaacctgcaggacttcaggactctgagaggcagaaaacgttcagattctcttcccctaaagacctggctagcagccaggcaaaattttgaagcttgtccagcaaataaactgcatgcttctcagtccattaactccttggcttctaaatcccatacgtaatatttcccagtttcattcttcatgtacagagtcctcttctcctacctattttgtaatccattgtctctctcaggtgttgatagtagttgccctcaaaggattagttacaactttaaaccccttgtgagatagtggtgagtgagcccttatcaataatctacccatttttcttctctccatccttctctgttttttttatgctaatcgctacttctgttcatacatttttttgatccttagggttgtcatttggttgggagatttgaattatagactttgcatgcctgatgccaatgaggtgaaaagtcttattaataagaaagaccttcagagactcttgaaattcgaccaggtaagtaaagtttcattttataggaactttcctagatgggagatgagattgttagagttatgggaggtatatcttactctagggagtgatggaaacgtcttactgtcttgtgaaaacagtgtgactagtgatgcattgactacatacaagatttgtagtacttttattaagtgcttggatgggaggagggaagataacattagtgataaaaagtaaatacaacatttattcaaaacgtctttatcattaagagatttcagagatttgtctaaatgagttggtgaatgggtggggttaattggggaacacttcctggaggaagtgggccttcagctatgttgatgtggtttggcagatggaacagtgaaaactgttctatgattacttggcaagctgaggaacagcttggaggtaaaagagggaggccctgtgaggggaactgggaagtacagaaaagaagtttgtctgggatcaacagcataggctatgggctcatgggaactagatgataagttgaagctagctggtatttaaaacctgcaggaaaagcattgagttggtaacatttacataaaacctgatattcaagaacctggtttccatatatttgaagcagtaaatttgcctcagaacctggcatgtgacttgaatttttacttcaacatatggatactggctgctaaaagtgaatgcttcttattgagggaggaaaatgttttgacttcattcgaataatctttaaatcgttatgagagccttttcaaccttcagacgtagccaacattcaggtgatttgcagcagaatggtttttgtagtgagccattcttgtctatgtctaccttcacgttgtggttggctgacaaatttctttgctttttctttattctgcctccaaaaggggtacatttaggataaattctgagtcttatataactctggtaaaatatttcagtgaggatctttcaaaacaatttgaaactattcgctgaatttggtttgcagaattattcattcaacatttgtgtgctttttctttaaattaaaattgtgctgggtggtttctgcccagctccaaggaacttacaattattcagatttcatttttccattttaccctctgccactattagcaataaaagaatagtgatgtgctaataacaagcatcctatctgagggtgagtttagatgctgtgggaatgctgagatttaattcataaggtatagaaatttcatttatgtactctcactacagttgtaaaggttgtggaactagatactttgaaataggaacagtggcttatcaacctgattatctcttatattaagatagtgttatcctgcttatttgatgcttctttctatctgtagctaaatattcagcgcacacagaaaaaagcttttgttgacttcaatgaaggggaaatcaagttcatccccacttataagtatgactctaaaacagaccggtgggattccaggtaaagtaataagaaccttctcacagagaaggttaaggcttgatcttatttctgaccctccatattggtaaggggctaggaattttttaggccatgccataagcagatatataaacctaatggctcagtgcctcagtgctattatagaacaataagagtgtttcatttatctatactcaaaggtgagcctatcttagggaagttattacttatatgtcaagattgttgaagttttatgggctacctacagtgccttatttctctcacctcagcaaacttgcttaaatttttgccttcctgattttgcctttgtttcttacctattacctgttctggctattttttttcccaaactacccagctatttaattcaggataccagaaggcaaaaacgaagccatgaagggttcttctagcaccagtagctctcaatccttaaaagactttagaatcccttagagaacttcaaaaaatactgatgcttggacctaatatctgccacagctggagaacactgagaaccactgtttagtagacccttttttttttttttttttttttgagacggagtctcgctctgtcgcccaggccggactgcggactgcagtggcgcaatctcggcgcactgcaagctccgcttcccgggttcacgccattctcctgcctcagcctcccgagtagctgggactacaggcgcccgccaccacgcccggctaattttttgtattttttttagtagagacggggtttcaccttgttagccaggatggtctcgatctcctgacctcatgatccacccgcctcggcctcccaaagtgctgggattacaggcgtgagccaccgcgcccggccagtagacccttttgatttcctaatcatcctagtaaagtgcccccagtaagttcttagtgagtatttgtcctctacctactatctctttcttttcttttcctttccttttttctttttcttttcttctttttctttctgtttctcctagctggctgagcacagaaacttgaaagagaaagaatccccacgcatgttcagctgttttgaactctgagagtactggcatgggtggggagtcgatattcctatgctcctaggtaactggccagcaaatgaagtgacactgttagatcttgtacactttgccatgtttgtttcactcacctgactttagagtcagctgcagagctactgatgagaaatatctgtgtcaccttctggatcagggtacaaggtgttgcttcttttaatagaatgatgaataggttctttttccctacccttggtattctgtggactgacatttgctcagacttgcatggtttgattttatttcgtctctattagaagaagctagacttgtccataaatgtctggtttaaaggagaaatcaatactgttattcctctccaaaaattaagcccagtctaggaagagaagattggagttttagacttgattagttatctatctgttgtgaagtgttgttgatgctcatagagtaaaggaaaaggaagtgttcaaaatataatccaaatcttctgaggatattttaagaacgtgctattttctcctgtggtgacattgttgaagatgtactcccaatcttaacagaaccattcattcattagataactattcgttgagcacctactttgcaccagataccatgctaggttctaggagttcagtggcaaacaagcaaatacagtcccttcacagagcttgcaaaatagtagggaggatgacaggggttgttagggaaggagaagtacacggttctttgggagcatgtaacaagagagcctaaccctgatctaaaccagtgtggtaggtattatgttcttgtgtgatatgttctctttataactcgtttctttacttacagtgggaaatgccgggttccagcctggtgtgaccgaattctttggagaggaacaaatgttaatcagcttaattatcggagtcacatggaactgaaaaccagcgaccacaagcctgttagcgccctcttccatattggggtaaacacttgtttgtacattcatttatttgtgtgttaagtatcaattactagaggattatttagactcagaacagatcagtaattcagcaagccataaatgttccataaccaaataaccatttgcagcattgagaggttagtgcccccaaccctcccaaatgctgtccgtatagctcttaatgctccaggccttttagtgacacagatgtttctcatgctacatagtggttaggtggtaacttgagcttcctaaagtaggtatgcataatgaagagttaaaagctaagttttatcagatagtaaagaagggaaacaccaggagggagattctgggtggaagggtagagacagcaggagcaaaggcacagactgatcagaatacagccaactctgtatattgtcttaagggatatagtgtcatccctacacttattttttcttttttttttttttttttttttgagacggagtcttgccctatcctccgggctggagtgcagtggtgtgatcttggctcactgcaacctcctcttcccgggttcaagcgatgcccctgcctcagcctcccagagtgctgggattacaggcgtgagccaccgtgcccagcgaatttttttttaactctgttctatcctgggctgcattaatggccagttatttaattttctgtctgtattgtgagtaaagtttttttcccattgtatttttaaactgtgtgttattggtatgtaggtcatatcttgtaatcatgctgatttaatttgttacagccagtacatttaggttatttcttgtggatttttcagatctacagccctataatctgtcagaatgtatatagtgcagtgcttagtagaatggactttgtagtagacttctgggatttgcatccgagttcaaccactttctaactgtgtaaccatggacaatttatgtaacatatttatgcctcagtttcctcctctattaagcgtgggtaatattggtacatactcatgaagattaatgagttcggacatgtgaagagcataatgggataggtttctttcctctgtgtgtgtgttgatttagggggcttctgagatagatatcaccaacctgttttatcctgctcctgttttaaggaagaaagactttggggcttttcatttaagatcagaattatttattggtcttagaatagattttaaattttatcaagacaatcatgactttacttttgtccattttgaaattttaaaataataatcattaataatagtaactgttcctcagatagcagctagtggctgtgtggcagggactatgtgaggcaatttgcacacatctcatttactcctcacaacaacgctttgagttaaatacagttgatccttcaacaacatgggtttgaactacacagatccacttatatccagatattttcaaccaaatgcagatggaaaatacagtattcacaggatgtgaaacccacgtataaggagggccaactgtgggacttgagtatgcgtgaatttgattatacacaggccatgccagaatcaatcccccacagatctcaagggacaactgtatttcccatttaacagatgagcagatggagaacagcaagttgaaataacttatttaagagcattcaactaggaggagagctgagattccaatcttaagttggcttaactcccaactctgtgctctttctactaccccacaatacctctataattctatagaacttgatgaaatatacctttagataacttcttttagcccatctaatttctagtttgtacttgcaggctgcccctttttcttcatttgaattctcttaatccattttgagagggtatctttcctcaaacactaacctctttggttagatcaggtatgcctggcttttttgtttacatttcttttcaaaaccttcagatttttttgtttgtttttgttttttgttttttggtttttttttttttttttttgagacagagtctcgctctgtcacccaggttggagtgcagtggcacgatcttggctcactgcaagctccgcctcctgggttcacgccattctcttgcctcagcctcccgcccagctaattttttgtatttttagtagagacggggtttcaccatgttagccaggatgatctcgatctcctgaccttgtggtccacccgcctcagcctcccaaagtgctgagattacaggcatgagccaccgctcgcagccaaccttgggatgtttttaatactccatacacattaatgcagagcttctagtgggatatttacattttttttcaggcttcctgtgtatttatgtatatctttaataaagatatgccttttgagtttttaatgatttttaaattatacagcaatgacaagtgcttttaaaaaaattaaaaggaaatttaagcagaattgacagataaggcagaagttcttcaatccctgttctgtctcctactcccaactttgcctaaacccccattccccagccaggccactacccttaggagtttatatctttctagaccagtgctgtccaatagagctttctgtgatgatggaaatgtcctgtatctgtgctgtccagtccagtggcttctagcagcagggggctattgagtacttgaagtgtggctagtgcaactgagaactgaacttctaatttaatttaatttaaagtaatttaaattcaaattccctatgtggctagtcactattgtactggacagtgcagttctagacctttgtatatgcttttttgttcactcatagacaaaatactgatttgtgtgtgtctctatatcataaacggtcttatatgtatgtgttggtctgcaacttgatttttttttttaactcagcagtgtgtcttggagaacctcccatcttattacataaagacctagctcattgtactttttttcaaattcctaattttgtcagtaatttcctttactaaaatggatgtgtcaggttgtgaaattctttggggttccccccctcctcattatctttgatttgccattaagtgctgtgatcatgataacccgctgagaaaaagtttgattttattgagtaatcaccccatgttttggattcttgggcatgctatgattagaggctttaaaaaccacactatattttcaccaccattggcaccaatgactgttaacaaaggagccaagtgcaccgtggccaattaatttcagaagactttctgtgggctggctgagatagagctaggatagggttccaaccctgcacttggtactgtgatctgttgcattggttctcagacttcagtggatgtaagaattgcttagagagctttaaaaaaagtgtggatgcatgtgtcctcacccctagaggctgtgattagtagacccaggcagctgtgcttttaagacatactcaagttgattctgtcacatatctagtatattggaaagagtcttaaactagtccagatgtcacctttggtattcactgtagcagtgagcaagtttgttgattgttttgtatcttaatgttctcaactatcggaacaaaaatattccttgctttggtagccttccaggttgtgaaaataaaaagacatgtgcaaaatacttttggaaattaaaagttgcaaagttttgtaaaagtataaaattcatcttaaactaatgctatactatggaccctggtgatggtaaagtgattgtttgatcctcggttctctaagagttacagttcaaatatgtgaaaaacttccccagtctgagatacttgactcagctttgatgttcttattttcaacattttaaaaaatttttatttcacttcaagttgtgggatacaagtgcagaacgtataggcttgttacataggtatgtgtgccatgttggtttgctgcacctatcaacccatcatctaggttttaagccccacgtgcattagctatttaaccttaatgctctccttcccctcgccccactaccccgagtggcctggtgtgtgttgttcccctccctgtgtccatgtgttctcattcttcaactcccacctataagtgagaatatgcggtgcttggttttctgttcctgtgttagtttgctaaggatgatggcttccagcttcatccatgtccctgcaaaggacatgactttttttattttttgaggtggagtcttgctctgttgcccaggctggagtgcagtggtgcaatcttggctcacttcaacctccgcctcccgggctcaagggattctcctgcctcagcctcccaagtgactgggattacaggcacccaccaccatgcctggctaattttttttttgtacttttagtagagacagagtttcaccgtgttggctggggtggtttcgaactcctgacctctagtgatcctcctgcctcggcctcccgcagtgctaggattacaggtgtgagccactgtgcccagcctgatctcattcctttttatggctgtatagtattccatggtgtatatttaccacattttctttatcaagtcttattattaatgggcatttgggttggttccatgtctttgctattgtaagtagtgctgcagtaaacatatgtgtgcatgtgtctttatagtagaatgatttatattcttttgggtatatacccagtaatgggattgctgggtcaaatggtatttctggttctagatccttgaggaatcgccacactgtcttgcacaatggttgaactaatttacactcctaccaacagtgtaaaagcgttcctacttctccacagcctcaccagcatctgtttccacatctttttagaacctttgctgcatgtatcaattttttttgacatgaatttttgtgaaatttcctagtctaaaaaagaaaccgatatctcaagttaaaatctgttagttatgttaattttggcattggtttgtatgaagttttaatatttaaaaaaacacagctatatcaggaagctgaaagtgctgtgtcaggtggaaaatttttttatcagtggagatgtgtttatacgttgtcatggttttactctagtctaggacattttgtttcagccattttctaaaatggctgtaggttccatttattaatatatctctgctattatgtaatctgagcagtgatattatacttcttggtattgtacatagaatctaatagagttaaaagctttttaataatatttgctgccacctcaccaagttatgattgttagaaacagtaattgctgtgttttgacactgtcattttgtacagtgcaagcaatcatttttaccacaattatcacattttttccactaccaaataacttaacaatgaagcaagaaaatattcttcccaaatatttattattaccaagcttcttaacgtaggggtttaacttttacaggacgttagccaattaatcttacctttaccttaaagcgtgtgcttctataatgctttgttcaatttatgtttgctttagtgaccttaaaaattgttagagactcttggaggtataaaagttgagaacacataaaactaaagcaaggatctgttttctttcaggtgcaagctgtggatgaagcaagatatagagagtgtttgaggatgttgtttgcaccacagtttattttaaatagttactgtaatgaccagttttaaattgttagataatctccaagggagatgagctagaaggatataagactgaaaagaggatacattttctttcaggtgaaggttgtggatgaacgaaggtaccggaaagtctttgaagatagtgtacgcatcatggacagaatggaaaatgacttccttccttccttagaactcagcaggagggaggtgagcaaaaatacatgatctccctgtctactgctcactgtggttagcacagaagaaactgctacttagaaaaggctacatagcaacgtggttaagcccatgtcgctggagtcagactgcctccattccagttgtagcacggctgtttagtagatgtatgacctcaggcaagtatcttacccgctcagagccgcagtttcctttcctggattaaggggtagttgtaaggattacatgagttaatacatgcaaagctctcagaacagcacccggcacatagtaagccctccgctgttagatgctcttatttaatatttcagagttgctagttaatttatatctcagaaaccaggacttggtcacaggatgaatactctgaaccaaggttgggttaccctcttaggatcctaggaatgatcagagtagcctggagaagtagcaagagccacctaactccttctctgctggtgtgagtataataatacatgcaagtggatgttgtgaagttggttcagttggtgaatgtctatggcatttgcacacctgcttaacaattaccttactcctcatatcctctatggaataatccaactgacttacttcccctactagtgatgcatgtttgtgtctgtctgttattccccagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaagtgagttttccctttaccattgtctctgctggtgatgtcatgactcccatccccttggtttaactttctgttttctaaccacatgtctcttacctttactgtcatattggtgatacctctggtgtgtgtcctgtctcttccccctcattgcttaatgatttttttagaggacacttttctgttggttcttatactcttttttgctttcccactggaggttttcctattaccatgtatcatctcttacatttcagatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggtaagaactgtcccaagacataaacctcttttacatttaattttcacaatacttaagtgacgtcctcattatctttgtgctttctgtcttcttttggccacgggggatgtcaaatgataaagaagaatgttactttagcactgttttgattagattaagcctaaggggaaagaggggggactaatctgcagttggctcttgttgtgagtacaatacataatactaagctcaccaaataagattaaagactcccctctcaaagatataatgcttgtttgttaagctcttcatactctcaagtcacttttgtataaattagcatgtacgtgaggtatgctaagtggggcaggcagaattatcctcatttgagcatatgagaaaactgaggcacagagacattgacgtgcccagagtcaaataccatcagttagtaacaaatctagcacccagatttcctggctcccagtttagtattcctcactaataccacattatatctaatcagagtaaaactttgctatttatggaagcatagaactatcctggaaccctggagtacctgaatcagaatccctgggggtgcttattacaggtaccctcacttctggcaatggaatcagaatctcaggatatggagcctacagatctgcattttatccgcattccagatgcttataatgtacattgaaatttgatacttacttaatgtgatgtgcttaagaaagaaaaggaggttgattttcccacctctccctcaagccaagctataatattaatgtttttatgaaggaagtacttactatcttcagtaacataagttgatttagtaataaagttcattgtattaagaaatttccttctaaatgaaaatattgttggattgtatgcagaatctctttgggctacaaaagtatattcttggtttttttaccaaagaaaattaggtgaggtgacagcatacgttatccttaccattagtattcacatggatcctttaggcctagccagagcgagtgattgtatctagcagggaggtctagaccagcaggcaggctgctggcttgtctgagtccgatctgttctgttgccatggaattgttttagctgtgactcagatagcagattaaaacactgagtccagccccggcattctttcttggaattatacttatttccccagagccctcatgactgagtatattacctctgtttgagagagaaccattttcttcagaaattcatatcctaccgttctgctgtttttcatgataattgtttttctcctaacattatatttctgtcttttagattttagtatttcaccttttagaatacattttggatgatgaagttgtttttcttatttctcctaccccctttccttcatctcagacattatttcccagctttctttgtttcagctttttattatgaaaaatgtcaaatgtgcagaaaaatggaaagaacagtacaacacacccccacatgccttctgtacatatatacacacagatgttttttgctgtgtcatgtaaaatttagtggtaatatgtcacttcaccactgaacacttcagcctgcatctcttaacaaaaagggcacacttaagcacaataccattattatgtataagaaaactaacagtaatccatagtatcatttaacattcggtccatattcagatttcttcagttgtcccaagaatttctgttatacctttttttaaaccaaaatccaatctgggttcatatagtatttggtgaggtctctgaagtctctattggagtagtacagttcctactttctttagtgacattgacttttttaagagtccagtacaaatgtccagtcaagggtcaaccatttcctaaatttttctggttgtttccttcttgttttttttttttttaaacttatcccatttatactctctccttccaccttcatgtaaacaggaacctacccttatttttagtcagagtcagtgaagatattagaatatctttgccattaatatgaaaaactgcaaagccattaatatgaaaaactttgcagtttttcatattctgggattggccagaagaggctcaaccctcataaagtttttattttatgtaaagtatactatcaggtaattttaccatgtttgcccatgaacagaaaggaaccaaaatcattagaggaatgaatggctctttgggaagcctttttccttctttttgtgcacaagtgattgagggttaaaataatagaaccctgatcatttttaattacagaatttctgagtttttattaaattgtatgtgtgtggacatcatttttcttttaaagcttttattttgtaggatttagggttcttttcacagtctgttgcatttcagtgttattaaattcctgtatctcattgatgaggaaattatctatacaggttgattatccattatccaaaatgcttgggaccaaaagtgtttcagatttcaatctttttcagattttcaaatatatgcattatatacttaccagttcagcttccctaatctggaaatcggaaatctgaaatgcttcaatgagcatttcctttgatcatcatgacagtactcaaaaagtttcgagttttggagcattttggatttctggattgggaatactcaacctgcattactgtggagcagtaaacaagaaatctaaaaacaattagtatcccatctttaataccttctcactctgttgtgacttgattttgaccttctgaaatgattcctcaggtatagtattcatgttttttttccccaagacccaatatcgtatttcaaatctcatgagatgatgctgttaataatggtacctgccctctgttgtattatttgctctaaaattttggtaaagccagaaacgagttcaatgtatgtgttgtctctctatgtactgttttagaaagatccttatgcactgttttagaaagatccttatgccacaccatcttcccaccaaatgcagaatgaaataactgacataattatttttcatccttccagcccttttcataatagtgactttgccactcctagaatagttgagattagcacaagtgggaaacggatgaaaatctaccatttgtaatcatctttattgtttttcagaattaagatagatttttctgttatattaactagaatattaagtagcaaataatcctcaatattgattcattacacactggatacaaagtattatggagtttatgtgagttcccataatttagtggtgatgaaagtatatttgcacataaaatatggctaaactttaagtcatggttaatagggagtttggttaaagataatctgaacattaaccacctttactggctaatgtctggtgtgcttggtaagtcagtattttggaaagtcgtttaaagtgactgctatgaaggttgtagtttgtattaacaataggttcctttcctatgttgtttattcaagcccttatatgctataaaagcttattgactgaccagctaatccctatagaaatcagaatcagcctgttttcattttaatgaatatttgatacatgtaacattaacatgactgagaaataagtttagcacataagaataaagtgaactaggaaggtgatttggagttagttatagaagtattttcagtcaagtccaagtacttaagaaacacttattaatatagtgggtgagcaggctcttccaggcttagaggacatcttgaataaagggtagaaggtgaaagtgaaaagaccatgtatgaaaaactgtaagatttccctgggacaagtgaagatcaaggataagaatgtatgaagctggttagggagaatggggcaggtggtagagagtcttgaagtcaatagataagtttatgcatgagccagagggtatctagaaccatcagaagggtttgctgattagtatgaggttgcaaattgatatagttggaagaacattctggtgttacttgtagaatggactaattgaaaggagacaagacttgaacttgccagatgtggctaagttgtaaatacggagatgaaaaaagttgagggatgggtagagaaactatatttgcttggggacatatctgttgggagaacaatatcaaaagtttgaaataacaggaataacttgttaatttgtccgtagtgtttttttcactatgtttttactttgtcttactaatctaaccatccatttcttactctgttaagtatatggcttgtatttcttctctatttcatatgaactaatcctttttagaacttcattttccattcagttttcggctatttatttatttatttttgagatggagtcttaccctgtcggccaggctgtagtgcagtggcacaatcttggctcactgcaacctccatctcccagttcaagtgactctcctgcctcagcctcccgagtaactgggactacaggcgcgcgccaccacgcctggctaatttttgcctttttagtagagatggggttttactgtgttggccaggctggtcttgaacacctgacctcaggtgatccacccgcctcagcttcccaaggtgctgggattacaggcgtgagccaccgtgcccggctatgctttttatttttaaatttgcatcttccacctctaattgactcttttattttagctgcatttaccacggggaacagtcttctgagggtgaatgttggggtaaagaatgatttgcattgcatttgctatgtgccagtgttgtcccactggggaaatcctgaactaagttctctttttaaatgtaatccatatatagccttttgcagagaatgggcatctctgctctttaaaattggttgaactaagtgattcatagtagaaaccttaggattattataggagtaagctgtttactaataaaggttaagtgatgcttctgttttcaaaattgagaccaaggttgaattcaatgtaatttctatgttgtttctttgtgcctgtacctagagaagtaaatctcttgtccctccatcagtatttaatcaaagtccttttgattcttctttcagaattttctcttgtattcattcatttgtaagtgtatgtatataccttttattatatatatatatcctttaatatatatacttagaaattatatatatatatatacacacacctgtgtgtgtgtgtgtgtgtgtgtgtgtataaaattttccattattaagatgtttaccttcttctgcttgacctacctcggtagcctttgaatgatccctttgtctttctctctctctctctctctctctctctctctctctctctctgtctctgtctctgcccttcattttttcctattcagggctgtcagattgatctttctgtactactgctttggggcctatcacttccttgcttaaaggtagtcagtggcttccccatgcctgctgaatacaatccaaatgccttaatctgtcatgcaaggtcctcctaagtctgacttcaacataccttttcagatttatttcacactatttttcttggcattctccatgccccccacaaacagatgactaacttcttcctaatatcaatttgtgatttactgtctctgtgccttttgtttatttctgcctcttccacttgtaatattctctccccatctctaccctttaaaattctgtgagtcttttaaagggctagcaatgatttattgagaactcgtattcatgaattataacaataccagtctgtaaactctggaactcctcaccccaactcagttgcaaatcagagtcagggacaaaccaggtctttctcctttatcctcatttctcattgccttcccctgcaaaggcattttagcacaatgccttgtactggaggatggctgctgcttaaagaaaacttttttgagagcctggttcgacaggttagtatacaaaatctctgtctagttttattcatatcatgtattagatattcatgggaggaaaaatataaaatgtgtcagatagattcttcatttgataacaagtcctaaattttacaagaggttctagtctaaaattgtatcagatgttgggcactcaaaatcaacttgacattaaaaggtatcgtaattatagtactataaatatgtaccttataaagactattctaattgctttatttcatgtgatatttaagagtctagataaacccacaaaagcatgtttaattcgtgaagtatctaccaatattaaaacgcctaatccccatggataacagtagtgtgggaggaatgcattcagtattaccactaggaatgccagggagcacatacttttcctcctccctctccactcccagctcctgtgcatctcagacagtaagattgggatttctccttttacctagcagaactaagacatgtaatttagacttgagtgcttagtggtccatagtcagattcgaaacaatccaggttgggagtcactggggaggtatgaggaactttgaggaacccagaccttctgctggcatactgccccatcacccattggttttaggctgcttcaaggtaaatattactatccctattttagagatgaagaaactgaggctctatgaagtttggtaacttgtgtgagggctatacaaaattgccaagaggtggaacgaagatttgtacccaagcctgtccaacaccagtgcctatactctttccattaaccacgctgtcttttaagtggggtttctcactgtccttagcctgttatggagaatacattctcacagttttcctctacctctctgtccaggaagcagtcacattgtcctttttgaattgtctaacggaacatagtgataatgactgtggagttggtcagacctgggatccaatcctgattcagccacttactacctaatagtgagtgtggccttgggcaaataatttaagctttcagagcctcagtttcttcatctgtaaaatgggaataatatctactttgcacatgtgtacagattaaatgactgtatataagcactttgcacagttcctgatacatgacagatgctccctaagtggtggtggtagttatcatggctgctattattattggattgtaataacagcataaaagataggaagattaaaaagataccttcttacctatcccctgcctctctttttttctcttatgcccaataggaaaataaaaatgggataatgatggatcttctgatccgcaaaggtctgaaatgaaattcatttatagttcagaaggaccttcaaatctgggcactctgggggcctttgaggaggggattgggtacgaggagatagaaaggaatctgggatgctgcttaggagactggctggggtgagaagaatgaaaatggaaagtagagtggtttaccatctccttccagatggccactgttgggcccacagccatattctttcattgaggtatatacctcaatgcacctgcctccaagcagcagacaggaagagacatcaggggcatttggctgggtcagttggcagatgccaaagggcactgaagtctagaactgcacatatttcttgagtgatattctcaaactgcacaaaaatttaaaatgtatagtaaactttgtgtatgaaaaatgtatttcattttcaacaatcataatttatttgaagaattcaaagctgtttaaagcatgtatatctggtaagatagtgagttctaatactgatctgtttctaattctgtaaattaattctaatcatattctgtctgtcaatgactttcttttcctgctccgctctcaggaagaagacagcttcctagaaaaggtaatgcaatccattggtggttatgagagtttccctgtgcttgattaacacttaactgtggtccctggaatttgtccctaggctttcccatatcagagacctctgacttggtgagactcccctaaagtcctgccggctgtccttaagtgtgtttgaagtacaggaaagatatttactgtagcagtcaagtcattgagactcagtacataaaaacagtaggactcaaggttctagatttgtatttttgaaatgagaagtaactacagagccgtcttgatgtatctgaatgctcatgaattggaggggggtaccagttagctgtcctccatttccaatgacaataaaacctgaagaagtagctttctgttgcattaaaaatgatttgaggttaatgatcatagcaattaatttcagaaaaaaatacacagatatgatcaagaaatagagcatagaatagaaccgtggacctgaacaagatcataaaagatcatctggttcaggcctctaccttcagacagggtattttctccattctaatagatgagacaaccaaggcccagaaaggttgaaaaacttgctgaagtcatgcactgtacccacttggtggaatttaatgccttttgatgatggggatggtatactgttttcatgctttagttattaacactaagtaaggttacagagtgtgggcttatcaggcgctgaatgtgtcttgttgaaagaagacaaagtaccttggttttcctttgaaaattagagttcaggataatttgtgaaattattcaagtattttctgtgtatgatctttctctagactttggagacacaactgtggcattccatattatcatacaggaatttgaaaatgaatagtggatggtgtatataatctactgacactttattaacctttttaaaccaccaaggtttgagacagctgtgcttcctagctcttccctgttaagagcagtccatgttctgtctttttatcttaggcagtgccttgtgttgccttaatgccttagtacaggaaaagctccagttggatgtcagactttttaaaaagtacatgaatcagtgctgcataatttctatatggcaagtttggaggcatctgctaaagaatcagtacacgtgctgcatttggtccagagagttagcagagtgcatgatggacagtgttttgtctcaaataccatgtggatgcttggatttgatatttgtaactggaaagaagtaaatggatgagccattgatagacattctggcaactattaggaacatgaatatcaagtgatagaatcccagggaaagaaaggaagcaaactgaatgtggggaaaaaaaagaaagattttaaatggtaaccaactgtcacactcccttctctttcttattcccttggaaaggcacagcagcttttaaaggtcatcagtgcttgttaaagaacacaatgttaagaagagacctcagctcggctgtagtgtatgtggtctctgtcaaagtagtgacatgctcctttttttttcttttaaagctacgtgactgggggttgtggatggaattcacaagttgcacaatgttaggcaagaatttcttagttaaacatacagaatatatatgacctcaagctagaggcgggggagggaggaggatgcaaaaaaattggtcatggttctctccactgggatttttatgaagggtgccttcaggtgcctttactatttcaaacattttttcatgtaatttatatttgattacatgaacctaagataactgagtttatttcctagccatttccaattcacatatagtgattgatttgatttatgtcacttctgggtttttctcttacaaaattctttcagaagaatataacagatagtagaaagatagatgaaaggagtaaaagcccctagaaatcttggctgagctattcctagaaactgtaacttctggactcagaccttaaacttttcgtggtatttctgcctcttggttagctgtattcagtttactatttttggaccttaaggcttacgagttttagcaccttaagattagaacttccatcaagcctgaagtatttacatatgtgggtctaatgttgtggagagttgtctttaattcctgaaaactaaagaagctaatttaaatcaacattgaaaacaaacaacagtatctgtggtaagacctgaaggaagagtaagttagaaataaacaaaaacctaagtgtagaccttgatctctcaaactactgtattgacaattgtaatttaatagtccccaagtcaccagtgctgtatggactccactgtgactgtatcaccggagcactggttctcagtgtcacctttgaaaggatttaaacacaaggcatccacgtaataaacatcataaacgcaaatgaaatgcagaacaattaagtgaagcatttaggaaaggacatcctttaactatgggactcgctatcaagtgccttctgaccaggagtgtccccagtgagaagaaatggaaaatcttaagagatgaagatcacattttacctgcatgaccagaatttgaaggactttaagttatacaccaaagtctttattctgagacccctttgattctcatacttttccatctattaggagaaatcccttctgcaaatggttcctttggatgaaggtgccagtgagagaccccttcaggttcccaaggagatctggcttctagtagatcacctattcaaatacgcctgtcaccaggtaagtgagagtagaccttccctacaactttggaaggtgtgtaactactataggaaatcacaacacctcacgtcagcatagcgcttttaactttcccaagctacctgcacacagtggcactgtcagatcgactgggtgggtggaagtgtcctagtcacagatgtcacagctgaagcatgtaaaggtaagttatttactaagacaaaggcctaagtgtagttgtggcagagccaggaccaaattaagagcacctgtctcctggctaccctctcattttccctggacagctgcacacctgagtctataatgcctactttggctatgagtcatgtaggcattagagattgtaaaatccaaagcagattttaaacccattttttaacttggtcctaatttttcttttaaatcctaactaaaatgccaccccacctcattcgcccccaaaagagatatttcttgggactaaattgaaaggtaatgttctcttacctactgacgaataatgtaacttgaaagcaaggtttagtatgagcatgcgatttcctccttccccagcgttcagtagtactagcatttgaatgtggttattctgtttggactctgccttctgctgcttgtcaagaggctacaagtaggccaggcatggtggctcatgcctgtaatcccagcattttgggaggcagagacgggcgcattgcttgagctcaggagtttgagaccagcctgggcaacacggtgaaaccccatctctataaaaaaaaattttaaaggaggctagaattagaacacctggtttcctgctctagccatctagtcccctgccttattaggtacaggctaaaacctttgaaaagatcattttcctatttgaaataacatttcacatggattagagaaatgctaaaggaaaaatgtgttattttcacacctccatttgtaattattaacacacataccacccttcccttttgcttcctgctgctcttctgatccttgggtaatcatcataacctcaggagtgattatcttgcctgtcccttcattctgacttctttggtaggaggacctgttccagacccctggaatgcaggaagagctccagcagatcattgattgtctggataccagcattcctgagacaatccgtatcctttgcgaccaaagcttaagaagctggatgagtacttgatcaaactcttcttcgcacctatatttgatttttgtggttctatatttattttctttgtaatatcttttattataagataaccactgactatccacttgtttctcatttcctttcaggaacttttgacctctttccatatccagctcttactaaaaggaagcaaggggtagataacaatgacttaaaagcatgggacatagaagccacagcactggtactattctccttcaggtgatcagtcactcctgccaccacacgtactgttgacagggcagggagaaggatgggaaacatgggcacctggtttataggactgctccagtgtcaactgtcactctgcaggctatattcccctgaccctgaagctgggccaaagctgccaagagtctttgaccaattctgtaacaactcacctgcagggcacttgaatcaataaaatatcaaacccccattaggatcaatgtgccctgaataagaggagggaaacagtccctgtaggagcttgaggaaaggagctcgtcggggctctgtgtggcctttctcctggagctcctttcccttgacttaagttgattcagctggcagcaaccactctgtggctgaagcactgctcattttcttggaagccctgccagagccagtcatctgttacgagctgtatcagcgatgtcttgactctgcttatgatccccggatctgccgacaggtgggttctactgacctggggatgtgtttgacgcagattgccccatagagaagtcgtcagttttacagagccagataggcagccagctgtctggtaggatgggtctgcatctgttattaatggcaggacaccaacattgagagttgctacccttaaattttaggttgtgttgtttcctacgatatttgccacctttttcccattggcctatttctgtttacagaaaacatagtggggtggatccctctactctggggtaaattggtgaagctgattgtacgtggaattctggctgacattaccaggaaggatgggtgacacttgggagcctttcttctttttctcttcttggtgtgtgtttttaatcctgaaatgattttaatgcacagtagctgacagtacctgtgaattggactagtgagtattgagaggagtccccatccatgctaagtgacattgtaaagaaaaccattcaaacaaaaaagaacagaaaaccattcagcttggtaggtgccgtggctacatgcctacggaaatgggaaaagaacagatgaacactgacctattgtgaggcagggtgtgcgtatgaatgtgtgatgaccacgtggcctggtcattgagtggacagggaccaaacagcacggccactcttactttgaagttataatttggaaggtattgtgttggccatgaggagataatagaagttagacagatgaaatgggtcctgcaagggttggattatagactactattacagcagctgtaagttcctcttactttcatcttccacctgtttttctcactgcctgcccctatttttaaaaacaggtgatctcccagcttccgagatgccatagaaatgttttccgttacttgatggcattccttcgagaactcttaaaattctctgaatacaatagcgtcaatgccaacatgatcggtaagagtgcttcatgcaacacggggcgtttgttgagaatactcttagtgcattgtatccagtatataccttactgcatatgcaggcacatggcagtcaatagtccttgtccccaggccctccagccctgaggttttgcttaggttatgtctgacagaagtttccgcttgtctttctctcgtcttgtagctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaagtgtgattttggtgaggaagcactcagaagggagggcttatgtgtcactgggttccattcgacttgactgcagtccccatcagctgtgcctgcactgtcatcacctgtcttacagggaaataccatttataagaattcttagtatattcaccctcagagatgagaagaaaccatgcgttttcagaggctaataaaggtgtcctgtactttcagaggccagccaagtacccttattttaaccctaaggattcaggcaacaaaacaactcaattagaggaaaggatgttgattcttaatgcatgtaaatgtcacactaggtcagatctgtgatccctccggccccagaaacaaaccctaagatacacatctggggagaacccagctacccctgctcagtagtctcagtagtttagacgcgcttccccaaagagcttgttttcacataatcctattttgcagcttttgaaaaccagttttgaacttttatgacttcttggggtgatcaagtccataaatttagtacttttttgttgttctaatctgaactgcctaacacgttgggaggaaaccgctgatttgagcatggtgccaatgcttccctgccaatctccattatgaatttgtggattctgattccattccctttgagactgaagaagcctcagctggaggtttcttctctactaaggccctcttccaattccctccaactgtgagcttgaccctgatgaatgtgctgactcagtgttgtcataaacaactttcaaagccccacccaaagccttggcaggagaaggtgtttctttctgagagtgattttccccccagcagatggagactgacaccagaagtttttacatagtagcaggcaatgagaatagcaggcaggtggtcagtctttccagaggttagagaggaaatggcatccccagctgtgaggcttctgttataggagacccattaggacctttctgattgcagggcaagttgaagaactggctcttggtgtagcctcataatgtaaaagccacacattgcaacagtggcatcactaaatgttagggagagaaccttagtggtgacctaatccaatctcattgtttggatagggaaagtctcagaggggacaatgactgacctaaggttacttaggttagtgacactgcatggcatagtggcatttgttttttcaagcagttctactctgcttgcccattaattcctttggtggcatcttatcaatttccgtggctgtaaatgtctgtaatacccctgattccaaatgttacgtctccacctcatagctctcttccgagttcctgcccagtatatccaattagttagctggcatctcccctcagatgtctcacaggcatgtcaagcttcacacgtccaaagtggaattcttttacttctggttcttttactaccacccaacctagatcctctacctgtcttccctcagctcagagaatgtcaacaccatctgcccagttgctggggctaagcatctaggagttagccttgatttctctctttcctaccgaccgaccacctcagcaacgtgccccacgcgtctgcttttcatcacccccactgccaattttattggtcaaggccaccaccatcatcccttcttagggtgtcgtcatggcctcctgcctagtcttctttctctctctctctcttttttttcttttttgagacagggtcttactctgttgcctcagctggagtgcagtggcatgatcggctcactgctgcagcctgacttcccaggttcaagcgatgctcccacctcagcctccgagtagctgggactgtaggcgcacattaccaagcctggctaattaaaaaaaaaataattgtagaggtagggtccccctgtgttgcccaggctggtctcaaactcctgggctcaagcagtcctcccaccttggcttcacaaagtgctgggattagaggcatgagcccaccatgccctgcctggtctttttaact

SEQ ID NO: 13155 - DNA, 52398 bp, Human; identical to SEQ ID NO: 13154
  misc_feature (1)...(52398): n = A,T,C or G

SEQ ID NO: 13156 - DNA, 34540 bp, Human
gttctgagagcatcaccaacattagcccattgaatcctcataacaaccctaagaagctagtactattattatgccaactcacaggtgaggacactggggactcagggagataaagtcacttgcccaagatcacacagctagtgggtgccagagctgggattgaaactcaggctgattggctcccaagtcagtgtttcaaggctcagttcactgacagaaagacaggaccatgtttgtcctcaaaggctatcttcaggggtcttcccctgcaaaatcccatcagctctacctgcttgcttgcccttcaggatggctactgcagcaaacagaggaggcaggagtctttgagggggcattttccagtgctctggtctctgggaataatttcattaccagtcctggaaggggtgggagagaggagcctggggaaaaggctgcgggagcttcagcagttattgaatgacagcattctcatgttctccttgtccctggtctgtcctctgaggctgtgggctcctgccctctgcttttattcctgagaatgaagttcactgggccacctcactcattttgactctgccccttcagagactcccatgaaggtccgttttccctcttcaaaatggcctattttgtcattcttgaatggatggttgaaagttgctttacacttgatgtggacataagcagactgtaaatccattaaaaatagaaacaaaaggaatggtggccaggcatggtgacacgcacctgtggtctcagctactcagaaggctgaggctggagaatcacttgagcccgggaggctgaggttgcagtgaaccgagaacatgccactgcactccaccctgggcaacagaataagaccctgtttcaaaaataaaaatagaaacaaaaggaatgggcagtttgcctctggggccctccaggctaggtgagcatccatccccattgggtctgtttgtctctctaaagcattcctctctgggaaatcgccttcctcgaacccaaagagcaagggttctgtagagcatttactaggagctgccttgaagctgccctctgattcagctgggcgtgaagacaaggcaggcctcagcttctccatttccctcattgggagttgtgttgtttacgagtgactcacacttcagggtaaccaaatccctgttctagaagctacagcagaaacagcatttccagttcaccaaattagtcttctcagagcgcccaaactcccctttctgtgtcttcttccctattcagtggcatcccccaaaccctccagataggggcatctttgggctttcatttcctcccaggtgtgagtggctctaacagcctcggttccccagagtgcaggttcagaaaatgcaggggaatgggactccccagatcccaagggaagagctggcatcacttcttcagagtgggcactcctggggggactcatcccagctcaagaaagtaactctccagtcacaaccaactttcccaaggggtacagtgggacttgccaagcactacaagaagagaggacactggcttttccagtcagcttggaggaagagagggaggaaaaaaggagggggaggaagagcaaaaaggaggaggaggaggaaatggacaaggaggaaaaaaaaaaaaaggaggaggatgaggagggaaaaggaggaagaagaagaggaagtggaggagcccagaaaaggaggggaaggaggaaaaaggaggaggagaaggaaaacgaggaggaagaagaggtggggaggaaaaggagcagcagcaggaggcaaatctccatccccacagcaaaagcagtgctggagccagagcccagagtgtgggagctaatgggaatcagcttgctggagggaaggggaccgaattaaggaatggctggggctctgccgctgagagggggctgggaaaagcaggctgattgagaccagctgttgtgcctctgtctctgagatctttggactctgcccaggatagcctcacaccctatcctacacgactaggaacttgcacagtccgcctcgggcagcccaaagctcctctgcccaccctggctcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtggtatgtgcatcctagcttccactggaaggcagctctgacctctcccctctgagctcagaaagggttggagtgagggttggggcccgagtctctttttctgttgcttcctctctctgacttgaggaagagacacctcagggccagtgttgggggccctcataacttggatcgagtctggtttggcacctttccattccccccgttatagaaaaaaaatattctgacactcgttaaaacggtaaggaaaacttaatttaagactaccgcattgcaatagaggagagaaatggggctcaactctgattacagaaaagacttccagggatctgtagccaaggagcagagtgagggggtcagtggatggaaaagtattaagaggagatagcaagggtagggggattcttgctaaaccgactgaacagcattcttgctgacggcaggccagagtgatcagatatcaagggtgtctaaactgacttagcaagattcttgctaagactgggtgatgcaagcctggcaagggcaggacagacacagaaggccaaggtcaaggccaagtggagaagaggctttgggggagcctaactaaactttggtcaggaagagagtctttcctctttgtcattcctgcggcaccctctctgtcctcaactaggtgcccagcccagcgctcccaccctagccttcctttctttgttgtctgtcagcagggcctgatcagtcactcaatgtccagttcctgagcacctacccagtgccaggccttgtgccagggaccacagagtcattcagctgcagagcctgctcttgggagccacagccctggcctcagagaacagcatattctggtgtccagagagacataagttggctgtgtcctcattcttatgttagcatatcagtgccaacattttgccagggatctgtttctacagaaatgggtgtttgttttcttaaatgaacagtatgggtcgcatctgatccttgagtttatgagaccaagataaaatcacacaggacgttcatggtgttgaaccccagccaccctccttgcatctgtagctcagcccactcgaaagtgtggctgggcgtggtggctcatgcctgtaatcccagctctttgggaggccatggcaggcggatcacttgaggtcaggagttcgagaccagcctggccaacatggtgaaacactgtctctattaaaattacaaaaattagccaggcatggtggcgcacgcttgtaatcccagttcctcagggggggctgaggcaggagaatcgcttgaactcaggaggcagagattgcagtgagccaagattgtgccactgcactccagcctgggcaaaagaaggagactccatctcaaaaaaaaaaaaaatgcgggcgcggggggcgttgggcgcagtggctcacgcctgtgatcccaacactttgggaggccggggcgggtggatcacctgaggtcaggagttcgagaccagcctggccaatatagtgaaacccccatctctactaaaaatacaaaaattagctgggtgtggtgggtgcatgcctgtagtcccagctacttgggaggctgaggcaggagaatcgcttgaacccgggaggcggaggttgcagtgagctgagatcgccccactgcactccagcctgggtgacagagagactctgtctcaaaaaaaaaaaaaaggagggggggcgggggagtgtaatgtctccccacactcagggccccattaccatctagggaaatccctccctaaaagacaggggggttagaggcaaggactatcagagaccgctttgtctaattcaagcccctcctttccagaggtccagagcctggagaacttagtccagtgcctggcacacagtaggcgcttaggagatggttgctcaatgaatattgggggggggtcactctcgagtcactctaaattgggggcagagcccaaactagaaactagatctccatatattctgtcccttctgtggcatcacctttttcaggcccacctctcatacttggcagagtgggaggactgaaagtgcgctcacctcttttgtattaagatggcctgggttcaaatccctgttctaccactgactcctggtggcacaagttagacaagttaccaaatctatctgggccttgacttcctcctctgcagaaagtgaacaataatttccacctcatagtgatgtcacaaatatcaaatgagatactgtagatgaattgctgcgttcagtatctggcacataatagggtgtctttaaatactaattaatccatctttccccaccatggcagactaggatttctgtctaatatattgaaaatgagcctggaatgataggcaaagatttggactgtaagaaacagtgcaagcaggccttgaattgaagtcaacccaatgtatcatacaattagatttataaaaggctaaaatgaaggtggggtgattatttagcgtgatcttctagagcatttcaaagaaaatttgataacaaaaatttaatttacacacaacttttctacttcactaaaccctgaaaagacccaattagattagaagaaaaattgatttaatgagcactaaaacccatccaaaagtggcaatcacttgtctatgaaacagatttctttgattgtgacccagggtgctatccagttcagcctgatttcctatgaaatgtgattatttttatcctcaagtagagctggccagcttcgtgcgtttcaaaggatggaggccccgtggggcgggctgagaggatactccttccctctctaggaactagctggtccccaaatgaccctggatttttctcccggcttctagcttgtgcctggggccacacaaagccagtggaccttggagggcaggatgtgagaaactgttccaccaacccccctgtgagtgccccttgccccccgcgcacggcccccctggccccacggcacccccccacccctgccccacgcacccctgcaccgcagcacccccgccctgctctatcatcttctctatccctcattgggtcagttggtagcccctcctcctaccaggctttctcctgatttccggactcttgggcccctcccccctccactccctcccctccacatcagtgccctcccctccctcccattcattcccccagcaggttatctgcttccgtcctgatctgggcctgggaaacccctctaggaggagggaggagggcaggaggcccctaactggcctttggctgaggccaggcagaggaaagaaaagacaaattctagagtgacagcaaaaagagaagcacagaagggaagagggaggaagacagaggttagaagagccaacggaggccgagcacggtggctgacgcctgtaatcccagcactttgggagaccgagccaggtggatcacctgaggtcaggagttcgagaccagcctgggcaacatggtgaaaccccgtctctactaaaaataaaaaaattagccaggcatggtggcgggtgcctgtaatccccgctactcaggaggctaaggcagaagaattgcttgaacccaggaagcagaggttgcagtgagccaagattgtgccactgcactccagtctgggcgacagagcaagactctgtctcaaaaacaaaacaaaacaaaaccaaaaccaaagaagagccaacggaagggcaagagagggaggcctagggtgtgcagacgaggaaaaggcccagcagaaggggcttgggtagtcagcttcctagctggagaccagagtgattctttctacaatcagagtagggctaaggggtaggcatgccagcagcactgtaagccatgggaaaaacgcagtacatctgctagcaatatcaactttatgggacccctggggcaggcaggtgggtgggcaaaccacattacttttatattaaaacaaacatggatatatcgtggagtagaaagcaaaacagcacaaacggaaacatgcttttcgttttaaagctaaaatgacctgtaaagaaatagagaactggtctggaaagggtctttctgggcaatatctcaaactgctgggggcattcattcactctcctctgccatttgggaccagtgggtggcaacctgaaaaagccctgccaagggaaggttgccagataaaatacaggacacccagttacatttgaattttagataacaaataagaatttagtgcaagtatgccccaaattgtgcatgttttaatataatacttacattaaaacattacacattgtttatttgaaatgcaaacataactaggtgagtgtcctgtatttttatttgctaatctggcaaccctacccccaggtagccaaagaaggactgtctgcatggcctggcccaatgccagagctcagacccctgcagttctcacccacacccatatcccagactcaggtcccattactgtcacaaggggtccctttccaaactctccaacacctccatctccacccagcccaggcatcttaatctagactaagcagtaacatcagttgccaccccatcccttcccaagccaggccagcctaacttcccccaaccgctgcttcaggagaggctgggggctcttctggaggccaggggcccagatgtcattttctctaagcaacgtgtgtatctgtttgtttgtgtctcaatgtcttcttgtcatctgtcagtaccttccagttactgtggtcaataccacaatgtcactcacagccctccgccagcagatgcagacccagaatctctcagcctacatcatcccaggcacagatgctcacatggtaagagacagcttctctcccccttgccctctctgctaccctgggtcagagaccacaaacaggagctgttaaaactcagaagatgaagacagagaaaggatctgatgggcaaagggagggaagtagagagcatggacacggtagttttagggcaagtgaaagaatgtatccctctacataggcgggcagacattgccaaacctccttaacctcaagaaattaaactataaacaacttcagaatcaattttcatcaattcccagaaggcagatccagaatgaatgtttagggtatccctgccctaggaggttagaaggtgggctggaaattgggctggaagaactccaagctcccttctggcccaggccttcccatactctgtggaatggagtagcaaaataatccaaaatcctgggttaagggagcgcggggttggttgtggaggggggcacccatcccaccgtttcccctcactagctccaccctccacaccatccacctttccaacaccagcccatttggaagagagggcatttttagtgtcaatgagcttgtttaaattaattttcccacatgctgggaagggctaagaacgttgggtaagtatctgaacttccctgagcctcagtttcctcttctgcaaagagaaatgggtctgtaatgagatctatctccaaggattatgaggatcaaaatatgataatgtgtaaagccctttgcagaagttatgatgttcccagtctactgtgcttgactcaggagggagaaggattagctggaggggaaaacccaaacgagccaaaagacaggaccctagactgcatagaatttgcagggcagggcaacaagtctcctttgcagaacagtccagtgttacactgagtccagtgtgaacagtgtgggggcgggggagttgaactgcaaaagatacggttgctcaaaggaagggaagatattgaaggctgggagagttacagagggcttcctggaagaggcacttggtgtgcttgggcttgtagctgacaaggggttggagccgacagacagaaataactgggatgtggttgggggcctttcatgtgggatctgataccacgaaaaaggctaatgatggtgttgttgatttcctagaacgagtacatcggccaacatgacgagaggcgtgcgtggattacaggctttacagggtctgcaggtgacaatcattacccagccccattgcttttgttggtagatccagaggtggtcacagaggacctaatgtggctagtgtctcagcatctgggaccccagaacctactgtagagaaaacccttctactctctctgtctccctccaccaccccaaaaccatcagattccccagggcacatatctcatagcccaccagccactttctgtgtagaaatgaggcagaggctgccttcctgtgctcattacctctgctgcaaccaggcccagtccagcactcccaggctccgtttctaaatagttgctacttctacctctaaccgctaagaacccgctgattcctttcacatgagggctcatttggagacaaagttttcctttgccggttgttttacggacaacatcacttcacatggccaaatgagacacaaacatataagcccttgatgagatcacagtgtctgaaggggcctcgcaccgtgatcctggcccattgaatgaaatccaagcttcctttcctgatcctcaaacattcctccttgggcttcaaactaccctgcctcgtgcctcgtaggctctttttccctttgccaaagtctctggattattcttgcccagcagtcctcagctgagcctctggtttagcctccctatcagccaccgagtctttacgctgagccccatctttcctgagagcgcctacatgcagccaaaagttgacctcacttctgctgaaagtccacaagcagccctcaacacaaagcagaggtgcctgattcaggacacctttctgccagctccccccacagctctttttaagatctccttcctcacttctttccaatggaggagagaatctctttccagaggccccttgtggcattctcagagccagcactgcattgcacatccatcagctaatgccacgttcctccccttcaccctcacctgcaagtttctctgttctgccccaggaactgcagtggtgactatgaagaaagcagctgtctggaccgacagtcgctactggactcaggctgagcggcagatggactgcaactgggagctccataaggaaggtagaagggccgcatggatttgttccccaagtcttgggacctggactaggttcaggaaggtataggtgagagcgtgcatgtaagaccatgctgggcctctatggggagcttaggaaatttgaggccatcactgactttcaaggctgatctcaaggaagacacacatggtaggaccatcagacagaacccctggctggagagcctggggctggccctgaaggtgacctctgcattgcttcctatctttctttcagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaagaaatggaccttggtagaaggaggggcggtgggactataaagatagagcatttgaaattgtagttgcagaatgttttgcaatgaggatgtattcatggattgtgtaattaaaatacatttaaaagaatcagtacaaatattttaaaattcatgagtgcagagacccaacctagaagactcagtgaatcattaaagagctagtggatgaataggccaggatgtgcttgaacccagaaccatcctctgtgccctggaaccctgccaatgatgatgctggaatcacatggtaaccctcttctggaaggtagcttagaagggtcaaaagagttgggagggcttctgagtttaaaaaaaaaagggcccctgagaatacaactcccggagttctggggcctcagacagctggcaagcccattcccccaaaggggagtcctcatgaatatgtactgaaaggcttgtgctttagaactggcttctctgccagcctgtccaatggcctgaacatcaccattccttttgactgtgacactgaagccctgataaaataattagtgcccaagagaaggaccacccacagccactggcaatgaaaaagacaagcttagccaatttgtggcagtcagtgttagagtaggctcagggcattaggcttggaaagcagaaagaggatgagaaacataccccagcgtgggcatacatgccgggggtggggggtgggcaggctgctggggcaggctccgggcagctgggctgcaaagggaggcaaagggaaccaggactaactttgcctgaatcacaattttttcctggggtgtaaatgggcaagggacaagtgactccttcttgtctctgcagacacctgggagagttatgatctggccctccaaggctctaacagacagctggtgtccatcacaaccaatcttgtggacctggtatggggatcagagaggccaccggttccaaatcaacccatttatgccctgcaggaggcattcacaggtgattcagtaagcccagtttccttcccaacttgtagcaacgcaggtcccggctgctattccgtaggtggcaaacttcatcatcagaggtaccaaagcagtggtttgcaaaccttagcatgcacctgagtcacctgggatgcttgtttaaaatgcagatttcagggccccctccccttgaggagtctgaatcaaaatgtcctccggccatatttagaaaatgttgggttaaagaatgttaggatttgaaacaagatggagcaggaagggaggaaagaagggaaacagagaaagatgagagaaaatatccaacccctttcaagagagaaaaaatcatgatatgatttgcttgcctggtggcagagactgatccataatgaatcattcagacctttacttctgaccctcttgtgatgaagaatttagatttgtgagatggctggggtcaggtgggccaggagtggacagaggaagtaaataactaagttcagagtcattctgtagcacagattacagttcaggttttgctggaccaatcaggaaggttagaaaaatataacatcaataaccttgaccccgttgacactatctaaatccatcacaaaagaacagtatgttgtaagattcctgtaagtcgtaactaaagtcctgaccaggaccagcctactgattatgaatcagtgtcttggccaccaaccagtcctatctccctgggaattctgaatgagccaatgaacttggattcctagtaacattgatcaagccaagagatccctttccgcatgcaagtccacataatttctcacttagaaaggagccaatacagcaggagggagatttcaaaatagcagccatgacgaaacaagtgaaaattgtgtccatttttctttatctgttctgatgtaacttccagaatcattctttctgcatcttgacaccatttttaaagaaatttgttatccaagactgttaaatcataaataaaactcatcttattcagataaagaaagtcaaagttatgtcgggaaggggaagggaaaaaagaaaaaccttcctggggctggaagggttttgtcacttcccaaaagtgaggggatgccgagtcatcacccgctgccagtcttcaagaaaaaggcacctggagcttgagtttggaagccgaagaacagagttcagcttcaataagcttataaagacgagagagactttccagccacttgcagattttaaaggagaaaggagagtgcaaagggcagaacatgaaaagttcgctactcaaacatacctgtacgcaccagaccattgaaatttgggttcatttggtttctcagaaaggtatcatattcctgaaccttgaaaacataattgcaagtgaaagaagccagtcagagaaggccacatattgtacaattccatttgtatgaaatatccagcactggcaaatccatagagacagaaaatagattagggatttcctggggctcaggggaggggggatagggagtgactccttagtgagtacagggtttcctttggggatgaagaaaatgttctagaattagatcgtggcgatggttgcacaacattgtgagtatgctgaaagccactgaattgtgcactttaaaaagattaaaatgatatgttttatgttatgtgtaaaatacacataacataaattatgtgtaaaatatgtagtaaaataaacctacaaaaatgtattgtacccaaagctttggtcattgttgaatagttttacctgttcacatgaaatatttttcacgacattaagttatttatgctcatatctgaacccaactaggacccttaatgtttatggccttcggccagcaaactcctagtcctgcctaggggtagactctttgaatatcttgcagggggcagggatagaagatgaaaactaaagtcatagaacccagatataagcatctgagaaaggacggtgctgtgacacagagtttaaggacagatttggagactgagaatgttatcaagacagtacggtgtctgtacagattaagagcgtgggccatgcagtcagacagaccagagttcaaatcccagctctacctcttgcatccatgaaaccctagacaagtcactttacctctctgaagcctcagtttccttatctgtaaaatgggatgggtaagaattagaacaatgcacatggagtgcttagcccagtacccgtggcttagtaaatactggggttactgcagagaaagttgaacacggccccagccctacccctttgtccttcaactaggactgctctcttgatctcagtctgcatgattatttattaatcagaaagatacaagagttactacatctcaagataccattctgtgtgctttacaaatattaattcattccatcctcatagcagccctattgaggcagatgcttattatactccatccccattttacaaatgtgcaaaatggaacacagaggggttaggtaatttgcccaaggtcacccatccagtaatggcaaagccaggatttgagccccatctgggtccagggcccatgtcattaatgagtacacaagtaagagtttgtttgaggaaagggtttcgctgctttttaagaggatgcaaaactgttaccctaaggctgaccttccaggaaccgagtgccaaaggcaaggtctgtcacttacacttttttggggctcctttgcttctagggagcacttggcaggagaaagtatctggcgtccgaagccagatgcagaagcatcaaaaggtcccgactgccgtccttctgtcggcgcttgaggagacggcctgtgagtgtggatttgcagacatgggtgggcgcctgggtctccccaatgccccaagcctcccgggccctgcagcacagagctagctcttccccaaataaccatgtgcccaccaattcttgagaactccatggccacagcccgtgggaaccaagaagggtaagggggcaggagctcatggcttcagaaaaaggacaaaaggtagccctgagcaagctgggaccagcccacaggccaccagaggaacgaactgactatggcagcaaagtgcttctgtcccactaaggggaggaggaccaggaaatgcctcccaacaacttagccactaccccagggcactcacactcccagctttagcacccagtgggactctactctttccgacatggctcaggacttcttgtctgatccctatggctgggcttcagatattccagggacccactggaactgtgtgctgactgctaagtatctgcatttttctggggggaaaagatccataactctcaacagcatctcaaagacgcccactcccccaccccccccccccggcaaaaagattgagtaacatgcagaggtagatgatacaagcatgctgttggtaatctttggaggccaaaggaaacagtggggcaaaagtgtcagaaatgcttgcctctggccgggtgcggtgactcacgcctgtaatcccagcactttgggaggccaaggtgggcggatcacctgaagtcaggagttcaagaccagcctgaccaacatgttgaaacgccgtctctactaaaaatacaaaaattagctgggcatggtggcaggcatctgcaaacccagctacctgggaggctgaggcaggagacttgcttgaacctgcgaggtggagattgcagtgagatcttgccactgcactccagcctgggtgacagagcaagatactgtcaaaaaagaaagaaaagaaagaaaaagaaagaaaggaagaaagaaagaaagaaagaaagaaagaaagaaagaaagaaagaaagaaagaaagaaagaaaggaaggaaggaaggaaggaaggaaggaaggaaggaaggaaggaagggaggaaggaaagaaggaaggaaggaaaggaaaaaaagaggaaaagaaaagcttgcctcaggcagatcagcattaaatattccttgtcaattctcttcccagggctcttcaaccttcgagccagtgacatcccctataaccccttcttctattcctacacgctgctcacagactcttctattaggtatggcttttccttagcttgctgttgtggactttctccaacttccaccctcttgatgccccaccactgatcccgccttaatatacagccctctggctgcccatcagctcggcgcctgctgcagcacgaccctttagaaaaccccctgttgtcttttcctgactctttaaacctctgtccctattgaatcccaaatctggcctgcttggctccctggggctggcttcctttgacctccaggaacagagggactgtgactgcctctggtcctttgcatccttagcagatgctcaggaccctccttgtcttcccaccccacccaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggtgggtttgccaggccccagcccaagccaggcaccaatccccactctaggcctgagaagtcttaacctaaagtgaggtgaagcccctcagccattcagtcatctggtcagccaacaactgtgcagtgagttcccttcttggcctaactgggaagagccagaagaggaaacagggatggccatccagagagctcataaaattgtcaggaggctggagagtatacggcctgatctagcagagactttggagtcagccaaacttgaaaatgaattccagctctgtccctaactagctgtgcagtgactttggacaagcaacttagccaatctgggtctttttcttcacctataaaatggcaataagagtcctgacctcgcaggagtcgctcagtggagatctaaaggagatagtgtatatgactgacacatggtagtgtccaataaatggtagctgtcatgatatgtacaggaaacttacactgtcaggacagcctgtcgagtgactcaggccagactctgatccatcccagagtgctggtgggatccgaagacagggagttcattgccaagcaaggcagtgtcaatcaaggaagccttcctggaaggagagagggttcagctggacgtggaaaactaggaaagacagaaagcacacacagagtagagagcattgccacgaaatggtggcaaatctcacgtctgctgggtcctcctgccagtcctctgaaaacacccctgtgccatggagacctcctttactgtgcccccagacctgtgcccccagacctccttttctcctccctgcccccaacaggagaaactcgtgacagacacctactccccagtgatgatgaccaaggcagtgaagaacagcaaggagcaggccctcctcaaggccagccacgtaagtccacgttcaggcagacatggccttttgggagtatccagcctaatgagttagaaaggaaaggcctccagaagagcctgaagaagaccctcaatgaaacaaagaagcaagctgggcgcggtggctcacgcctgtaatcctagcactttgggaggccaaggtgagaggattgcttgagctcaggagtccgagagcagcctggccaacatggtgaagccctgtctctactaaaaatacaaaaattagccaggcgtggtggcgatcacctgtagtcccagctactcaggaggctgaggcacgagaatcgcttgaacctgggaagtagaggttgcaatgagctgagatcatgccactgcactccagcctgggcgagactaggtcaaaaaaaaagaaagaaagaaagaaaaagaaataaagaagcagacaccaaattattcctgggcgcccacatgcacctcatatccttgcccccaatatagtacagtggtttagagcacaggccctggagctagggtgccttgagttcaaaccacagctccacccaattcctaactgggtgaccttgaccaagtcattttacctctctgggcctcagttaccccatctgtaaaatgaggatcataacagtaatcttacagcatatggttgttgtgagaattcaatgaatatgtatattgctctgagcaccacctagcacattctaagtgttaaataagtgttagctataatgatttcctcacactggcaagaggatggctcaatttttaaaaaagaattcttgttaaaattaagataaaccacctcatttaaaaaaaactttgtctcataggaaattttaaacacacacaaagataaagaaaatagcatcataatctccagtgtcccttcatccagcttcaataatccttgactcatggccattcttgtcttgtctataaccccatgttcattaccaccacaaccaccccctctgctgctggattcttttaaaagtaaatcctagatagtgtgtcatttctgccgtcaacacagaactctttcaaaaacaggaacacactatgatcatatataaacactaacaagaattctttgacatcaaatagccagtgttttcaaagctccacatcctggagccgctatctgatctccatcatcttggagcctgtggctgcaaccagacctcacccggctcctctgtttccctgcttccccaactccaggtgcgggacgctgtggctgtgatccggtacttggtctggctggagaagaacgtgcccaaaggcacagtggatgagttctcgggggcagagatcgtggacaagttccgagggtgaagagccacggccgtcctttttggctgactgtcttttagtgtggcagtgggggcagggagggggaatttgtccccttacttagcagaaaggaagatcctcctcatatgcgtgctgggtgggggagggctctggagaacaaggagtgacaggttcttgggtggtcggggagttgagcagggggcgttggatgatatttcccgccccgctgaaagcaggacaactcgaagggccacaacccaatagcgtcccctagtgtctgcttcaggtacggtctgaatctccctggggggtgctgtggctcagaccaggtcagcccctggaccacttgagaataccaggtagggaggaggattcccgaaggcatgcttggcccaggtcagggccggattgtaggtttgaggtacaggatgctctcccaggactgggggagttttcagatacagagagctgggtttcttcactcctatccgtaaaatggaggtggagaggaaataatgtgtgtctacagtgtgtcctctgatcttcctctataaatgacaggtcagggcttgaggagatggaaccaggaggtgagggctgggagagccaaatggtgtccagttgagaggtagaggcagccatgaccttcattggatttgattagatatcccgggcccagcctagtccaggggcccattcattgaccatgccttgccttgtactttccagagaagaacagttctcctccggacccagttttgaaaccatctctgctagtggtctgaatgctgccctggcccactacaggtacttgaggaaaaagaattttctagggccctgttggggcatcctgttgtgtgtgtagaggaacagggtgaggggagggggatgttctgggacctgagtccacgttgaaggtccgaggcccctagccctgtgggggctgggagaggagctcagtgtggagtagggagttgccttgtaatgaaaaggcctgagagctggaggctgggggacctggaaggaagacaccgatgccattggatgcttttccctggcttcccatgtgttgcttatgttagctaatgcttaaagctcacgagttcacatggagagaggtctgttcactcagcctgaaccagccaaggtgggcccaagatacaggctagccaggtgtttggccctatagaaaacaaacccctgcaggcctgcctgatgaaaagctgaccagctgcctccgcctggcatgggcacagcagggagaggtcaatgccctccaagggagtgcctgacatgtcccagaattccctcccctggtgtcccctggtgtctcccacgccttcggctgccttgccccagcccctcctacccactcgggctagagtggcagggtgggtgctcctcggctttaccacctcttgctcagcagccccaccctggaggtatcctcccttcctgtgctctgcttcttctcagggccctctgctctcggaggcagcaggaagttagagacaaagggccggagggagcatctgggtagaggcccagctctttgccgctttaccgcgcatcctcgtgcaagccccttggcctccataggcctgcttctccttatggaaaaggagacagctgagctggggggtctctagggctctcccagctctcatattctgggctttaccctctctctcctccctggggaccagggcctggctcagccaggtgcaggattaacagacgtgtgctgaggacagcagcaacggaagctgagttctcttccagggccctttgggatagaatgacttcctccagagggactggcctggaagcccaggccccagaggtcctcccaccaaggcctcccacgtgacccagtgcagggttaggctgcccttctcaacattctctccccttctcagcccgaccaaggagctgaaccgcaagctgtcctcagatgagatgtacctgctggactctggggggcagtactggtatgtaccccgacctcaccctagcctggatgtctctgctcagacctcctgagcctgccaagagtcagccaaagctttcccttcctgggccacggattcttcgtctgaaaaaggagagatctggaatgagccccgaacatcctacccattttcacacatgggggtccctgcacagtgggaaatacacagaggctggaatagtggcaggacccaggcagcacctctgtgggaattaggaaaagactccctttgcttaagttgctgttttttgtgggttgtttgtttgtttgtttcttgacagagtctcactctgtcgcccaggtttggagtgcagtggcgcgatcttggctcactgcaacctctgcatcccgggttcaagtgattctcctgcctcagcctcccaagtagcttggattacaggtgtccaccaccatgcccagctatatatatatatatatatatatatatacacacacacacacatatatatatacacacacatatatatacacacacatacacacacacacacacacatatatatatatgtatgtattagtagagatggagtttcaccatgttggccaggctgttctcaaactcctgacctcaggtgatccacctgccccagcctcccaaagtgctgggattacagacatgagccaccatgcccagcctcaagtaaaatgttttctaagtccacgtattattacacagtctgagcaactatactcaatgtccctgcctggccacacaaacacatataccctactctcatccactagtgcacaccctggacacccccgcaccaccaacgtcatgcagactcctcagccccctcttccccatggcactgttcagggtggaggtgggggcagatgagagaagcaacccttttgatgggctacctttgtacagtgtacaacctgaatgctcagacatgacagccgtgcagaatagactaacctggccaggcgtggtggctcacacctgtaatcccagcactttgggaggccgaggcgggcagatcacctgaggtcaggagcttgagaccagcctgggcaacatggtgaaaccccatctctactaaaaatacaaaaattttccgggtgtggtggagcatgcttcccaagggaaactgaggcaggagaatcgcttgaacccgggaggcggaggttgcagtgagccgagatcgtgacactgcactccagtctgagcaataagagcaagactataaaaggaagaaagaaagaaagaaagaaagaaagaaagaaagaaagaaagaaagaaagaaagaaagaaagagggagagagagaaagagagagagagagagagagagaaagaaagaaagaaagaaagaaagaaagaaagaaagaaagaaagaaagaaagaaagaaagaaagaaaaagaataggctaaccccattccttccaaacgtgtgactgatcattcacaccagagttgagctgagctgagctgacctgaaagattttcccttctcattgaggaaggaagtgtgggaagcgtggggtgggacaaaagaagggccgtactgaactgatggaggagcaaggagtcctgtggaaatggcgaatgtgctaacgacagaggctctttgcttgttcttagcacagctctaggggatccagagtagcaggcgctcagcttagcagcctttgctggtcaggagttcgatgctgtgtgtacttgagatggccaatgagcaaaggggaagtgaatttgtgggggcgttgctggaatggggtgtgctcagagtagggtgaggccggggaaatagtcacctcacttcctcttctttccttctgaagaagaaggtcaccacaccccatgacccaaggagaagccccagggccctgggaccatttctcccctctccctcaccaaggcatgatcacaggggccatctgtggcaactgctgcagctgggagttgggagtcagaccttgggactgaggcttcacctaactggaactcagcaagtcactgggtcagatccgtgtttgccatggagaggactgtgtggagaggcagtgcttgctctaggcctggcttcactgaggttcagagagggaaacagccgcatggcctcaatggcctcatctgtgaactggggataatgaggcctcttctaccattcttcccagggagcagcaaaagtgtcctataaatggtcgacaactatctgaatatgagagtgttatgataatataatctctctggacctcagtttccccagctgtaaaaaggggacattcccctttctgcctcccaggaagcctggaagaagccttgctttcataaccagctggacccaaggaaacccagacctacagaacagccaaaatgagtgggatgggggaggagtgtgtagggtggggagtcacacttgtcagacaacttagtaacttttaacttgataggtttgcagaggcctttcacacataggtgctgaagaggggattttgattatggtagctgtcttcttcctttcgccgtccacccatcccatcccagccctgccacttgtggaaagcacacagaaagcacatggccccagtccctagccccaggcatttggcatgttggttttccttctccatagggacgggaccacagacatcaccagaacagtccactggggcaccccctctgccttccagaaggtaagcatgggcccagatttcccctcaccaccttcccccaagggggcacccaagcagtcaagatcccttccatttcagaggctaaaactgaagctcagagaggttaagtagtttgcccaaggtgacaccactggtgccggaaaacccagtgctccctgctgcttccccggggatatttcaggccactgacaaggcctcagcccaagctgagcctcatcctattctggtaaatcagtgcacaaatatttttttgttgttgcctgtgtgcctggccctgtactcagcagaaaggagaaagaaaggcatcccaagtggaggaaaacggcacaagtgaagcctccgcggtggaaaggagccagaggtgttcaggaaacagcgagggctggccagctggggcagaggcgagggcattgtctctgtgcaccagagggccctgggggtggagcagcgagctgccgtcatgctgcatgcagcaggccgactatggggcagacattgtgctggaaacacagagaggggaacaaaatgctgtccaggtctccaggagctcacagtttagcggcggagtctgctgcctctggctgtcctgcccaaagtgacaagcctgtgaacctgtgtggtgatggagattgaccacatcgcctctggaagtgaccagaagaggccactgtcaggccacctccctccgctgacagaggaaggctaagctgccaagtcagcaaacctcaaccctcatgaaaggccttaagaaaactcagcagccgtcacaaccacaggaatgagtgtgctaaacttccgtgaagcatgcacgctgttggcagcaccttctgtacattagtctgcctgcctctcccaacaaccttaggagctaggtcctgttatcttcccatcgcagataaggaaactgaggcacacagcagttaaagtcgcctgcccaaggtctcagagtgagtggctaagtcaggattcagcccagggagtcacagcctcggttcaccgccaccaagtgtctcctgcagatattgtaatgatcctcatagaccagccagagggaagcacgtgatggagccccagctttgggaaggccctcctcagcctctgctggccatcttccagaacccgggcagccacacataacgatgagactccccccaccctgcctacacacacccaggcctgggccctgcaccgtgtatccataggccaagcagctggatactcctctggctcctcctcccgtcctccatatcacctcttcctctccccatcaggaggcatacacccgtgtgctgataggaaatattgacctgtccaggctcatctttcccgctgctacatcaggtgggtttcagaaaccagtctggacacagcctcaggccctgatttcacaggactcagaccatcaccctgggaggctggtggggcaaggattttgtcatcatcccatcccttatgtagatgagaaaatccagcctagagagagaaagtgacttgcccaaggtcacacagaaggttagcgggagatccaggccttgaacctgagtttcctgcctcttaatctaacactgttgctcagaggtgggagagatcagtgggccacagcaattatgggaggattcttagaggaattaggtgtcaaagtgcaaagccctgacagatggggagaaattacagtagaggcatcaattcaggtaatggatacaatgtatggtaagctggagatagtgatgggctggtctggcgagggaaccactaactccatccatcagccctcctccatcccaacccaacatcattgcatcagtgcatgcttagcggcctctcaggggcccctcttcttaggcaccactctgatagtgaagcaagaaggggcaaggtggacagtcttcggtaaagccatctgactggggtcaatctctcttcccttccagggcgaatggtggaggcctttgcccgcagagccttgtgggatgctggtctcaattatggtcatgggacaggccacggcattggcaacttcctgtgtgtgcatgagtgtaggtgtctcctcagcactccccaggccaccccccttttattataccctctatgaaggtagagaatttcacaggtatggaaatgacaaagacccacaaagatgccatgatctacccaaggttacccagctccacagggtaagtgaggaatgccagcagcaggccagtcctgctggctgcttggcattcaagagggcaccagaaagagggtcaagccctagtgactaacttatatagaccccagagaaataaaagccagagccagctgcatgtggtgactcacacccatagtcccactgctttgggaggccaaggtgggaggatcacttgaggccaggagtttgagatcagcctgggaaacacagcaagaccccgtctctacaaaagaaatgttttaagtatccaggtatggtggcatgtgcctgtagtcctggctactcgggaggctgaggtgggaggatcccaggaggtcaaggctgcagtgagccatgatggcgccactgcactccagcctgggcaacacagcaagacccctctcaatacctaaataaataataaaagccagagccaatctggtgtgtgccaggcccaggcagacaatgatgtgatggacctgtgctcatagagatgctctgggatcctcacttatctgctcttcctcggaagctgctcacttccaagctggtgagtataggagaactgataccatgtttatgtcttcctttctagggccagtgggattccagtccaacaacatcgctatggccaagggcatgttcacttccattggtatggccctcaggcccctctacctcaccaccccatcccagagcaggactagcccaggactgcagtctagagtgtaccagacttcagaggagcacagcaggcactagtacagctcgggactcacctccccattcccaccgctacgcccagccccaaatggcttgtcccaccctaattccagctcccctcagcccagaccctctttttgctcttgggagttgtttcccagctgtatattcagacgagatcaggtgcgttcagggtggtatggccgtagacccagctgtatattcagactctggagttgccaaatgctggagtaacaggacagtggcatccagggagatgggagtaccttcaggacccaagtgggtttttagggcttccctgctgggctacagggaagagagagtgagtcagagatgcccctgtgggggatctgaggcctgacagggatgagttgcctctgcttagccaacaaacatctaaccagttgtggggctgccagagtcaacagccaggggacagccagacagccagtccctccagccactcatcagtaggtacaggaagcctgggcttgggccctctcccagcttaatgccaccagcatctctgtgtctcccagaacctggttactataaggatggagaatttgggatccgtctcgaagatgtggctctcgtggtagaagcaaagaccaaggtaaactgccaccaggatgggctggaggtgtgggcagcatgtcagtgactttgggctgcatgggaggaaagtggggaggaagatcaaaggagaagggcatttagtgtgcaggcatgaatttatctggagtcttccttaggaattccataagtcagacttttcaaactcgcttgcacatttgaatcacccagagagctttctggtgctttaaatgcccatgcccaggccccattccagaccaagtgaatcagtatccctgccctatatcattggttctcaatgcacataataatcgccaggggagcttgttagaaataaagattctgtataatagcagccaacaagataaaatacctagatgtaaacttaaaaaggcttacatggagaaactctctactaagggacataaaaaagatttaagtaaatggtgctctctggagagaagcctcaatattatgaagatatcattactctctaaattaatctataaattcaagataacctcaattccagtgctaactggatacttttgtaacttcacaaaatgatagtaaagtttatttgtaaaaataaacatgcgaagatagctaggaaaattctgaaaaagaagagcagggccaggtgcagtgcctcatgcctgtaatcccagcactctgggaggccaaggcaggaggatcgcttgagctcaggagtttgagagcagcctgggcaacatggcaagaccccatctcaacaaaaaatacaaaaaaaaattagctgcacatggtgtcatgcacctgcagtcccagctactcgggaggctgaagtgggaggatggtctaagcctagggaggttgaggctgcagtgagctgtgaccacgccactgcactctagcctcggtaacagagcaaaacccaatctaaaaaaaaagcaataagaaaagccagtcctctcaaatttgaacacaaactaccataactaaaacagtatgacactggagatgaaatagatagctgtaacaatgaaacagaacaatcagtccagaagtaaaccctcttattcccataaacaacatgggaatttagtttacaagaaagctgattttgcaaaaaagtaagaaaaaaatgattattcagcaaatggacagggggaacaaatggctaatcatttggggggattaaactgaataacctccaaaataaaattccagatggaccaaagttttaaggtgagcaatgagaccacaaaagatgtagaggaaaacctatatcaattcatttataatctcagggtggaaaagagtctttctgtgcaagaccagaagccatgaaggaaaagattaataactctgactaaatagaaaatggaagctatgtttatggcattgtgagagggtgagttttcttattttaccatgagctttttacaaatccgtaagacaaaaatagacaaaacaggaaaaaatagggcaaaggacatgaaaaggcaattcactaaaattaacaccaaatggtccacatgcatgtggaaagatgctcaagttcatccttaaagaaatacaagaccgggcgtggtggcttatgcctgtaatcccagcactttggaaggccgaggctggtggatcacctgaggtcaggagttcgagaccagcctgaccaacacggagaaaccccatatctactaaaaatacaaaattagccgggtgtggtggtgcatgcctgtaatcccagctactcatggggctgaggcaggagaatcacttgaacctgggaggcggaggttgcggtgagccaagatcatgccattgtactccaacctgggcaacaagagcaaaactctgtctcaaaaaaaaaaaaaaatacaaatcagggccaggcatggtggctcacacctgtaatcccaacactttgggaggcagaagtcagcggatcacttgaggtcaggagttcaagaccagcctggccaacatggtgaagccccatttctactaaaaatacaaaaattagccaggcgtggtagtgtgtgcctgtaatctcagctactcaggaggctgaggcaagagaatcgcttgaacccgggaggtggaggttgcggtgagccaagatcacaccactgcactccagcctgggcgacagagcgagaatctgtctctaaaaaaagaagaaggaaaagaaagaaaagagaagggaaaaaaaagtctctttcttgctcagtttccttcctgagaacatttcaggcacacacagcgtatgtatctatctatgtatatattttgaaaatacaaacaaaatggattctactgtacatacttttctgcaccttccttccctgccccgctgccccttacttaatagtaaacctaggagagtggtctgcaatagcgcagggagatctacctcattcttttgaagggttgtcgaagagcctatagtatgtggatgtcccatgatttatttaaccaaccgtggatattgaggctgtttccaaatttttactatatttgccatcaatgctacaaatcactgtataaacatcttggtgagcttttgggactatatccagaaggtacatatctggcgtagggatttccaagacaaaaagtacaagcatttttaataggtaatttgatagatattgtcaaactgccctccagaaaggttgcaccaattgtactttctccaacagtgtgtgagagtgcccatttcctcacatactcactagcactgagaatcatcgaagtcactaatttttccaatctgataggtgaaacatggtattctattgttgttttgacttgtatttctttttttctttctttctttcttttttttttttttttttttttgatggagtctccctctttctcccaggctggagtgcagtggcgagatcttggctcactgcaacctccgcctcccaggttcaagtgattctcttgccttagtctcttgagtagctggaattacaggcacacaccaccacgactggctaatttttgtatttttagtagaaacagggtttcaccgtgttggccaggctggtcttgaactcctgacctcaggtgatgcacctgccttggcctcccaaagttctggattacaggcgtgagccaccacacccagccttgaatttctttaaggatgaacttgagcatctttccacatgtatgtgaaccatttggtgttaaattttagtgaattgctttttcatgtcctttgccttattttttcctgttttgcctatttttgtcttatggatttgtaaaagctcatggtaaatatgaaaattcaccctctctctgtgatatgtgctatatttgtcacacaactcttggctttgtttatggcattgtttccataaacattgtttccattttctgtttagtttagtcagagttattaatcttttccttcatagcttctggtcttgcacagaaagactcttttccaccctgagattataaatgaattgatataggttttcctctacatcttttgtggtttcagcctcccgagtagctgggactacaggcgcccaccaccatgcccaactaatttttgtgtttttagtagagagtagagacggggtttcaccatgttggtaatgctggtcttgaactcctgacctcaaatgatccacccacctcagcctcccaaagtgctgggattacaggcgtaagccatccattgcacctggcctctttttttttttttagagacagggtctcactctgttgctgaggctggagtgcagtggcacgatcacagcccgctgcagcttcaacctcctgggctcaggtgatgctcccacccttccacctcagactcccaaataactaggactatagatggacaccaccatgctcagctaatttttgtgtttttttgtagagactggtgtattagtctgttctcacattgctataaagatactacccaagactgggtaatttttaaaggaaagaggtttaattggctcacagttcccacatgcctggggaggccttgggaaacttataatcatggcagaaggcgaaggggaagcaaggatctcgacatggtggcaggaaagagagagctaacaagagcagggaaaactgtcttataaaaccatcagatcagccaggcgtggtgggtcatgcctgtaatcccagcactttgggaagctgaggtgggtggttcacctgagcttaggagttcgagaccagcctagccaacatggtgaaacctcatctctacaaaaaatacaaaaagtatctgggtgtggtggtgcccatcaataatcccagctacttggaaggctgaggtagaaggatcacctgagcccaggaggtagaggctgcagagggccgtcatcgtgtcactgctctccagcttgggtaacagagggagatcctatctcaaaaaaaataaaataaaataattgaaatttagatttctgggccctgccctaaggattctgcctccagtaggtttgggaggtgggccctggaatctgcatatttatcatgctccctaagtgctgttgatgtgcgtactttgaaaaacacaaacctaagtctaaatttccagaatcaggagggaagcaccaaaggtggagcactaagtggcagacaagggggctggccaagagaagggactctagaaggctcaggcctagccagggtgtccagggttgatgaggcccagctccttgtgtcctccgggtggagtgctccttccttcccttcagcccagttcctcctcctccctcactgtcctgcttacccggcttctattctgggctcccagtacccagggagctacctgacctttgaagtggtatcatttgtgccctatgaccggaacctcatcgatgtcagcctgctgtctcccgagcatgtgagtgcccctcagcattgccttctccctgaccctgggcctttcctgcctctgctacctgccaccacatcctctgtccctgcccctcctccaggagggtccacactggtggcacctgcagacacacactggggcattcctccccagctcatcagagaccccagagcttctagaactttccagtcagaccagcctgcccaaccccaggtagtgaataactggaggaatctgagattgggcctctgagctcggccactacaaggcctggaactataagtgatcccttctattcttttgcctcagtctcctcttttgtaagctgaggataagaatgcctgcccagcttactcccattcccgggcctgaaatctacccaccccaccgcccatgaacatcaccatgacatgaaacagccagccaggggaactgcctctgaaaagccccagagaattcctgaagcctgatgatggtgggggacctgtggccatctggactatggtgacagctggagtaccacaacaggggactgggcgtcaccaagacttcacctcttggcagcttggcttagagaggctgtcaccccttctatccttcgcagctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctctgggttttgcattgtgtctgctgtgttgccggagactgctgtcacctgtggcttttgtggtgggggaggaagaagagagggtgaggtgggggtggggacatgaggctcctagaagctcagtgggggagcacgtgggcttgagagtatgtgtgtgagcatgcatatgaatatgtgtgcgcatgtgcacagatgcacgtgcacaccacgcccaaccagccaacctccagcctgtctaaaaaggtattgtaaccttgtggaagggacagaaaggagccctacactggggaacttgtcaaatgtaatccagaaaagttggggctggcacctttgccaagcagcgcacagttggtggaaggaaagaaccaaggtgcagggtgccaggcaaaggcaccaggcagagaagtctcctggcctgaaaccatcaggcctagtctgctgagtgtgagggtgacctgtgatggttaccatcaccagtgcttgcatccagaggctccagccctgaccaagccttactgagtatccaaagatgggcctctgtttgctaaataatttgctccctcacctgctcaccccacaaagacaggtactactaataaaattaaagtcatcatcaccctcatcatcatcaccatcatcatcatcatggctgccatttactgagtgtttatgtgccaccgtgcaagaagctttacatgcattttctcatttaatcctcacaacctctgagaaggcccttttcttattcccattttacaagtgcaggaactcagtgaggcccatagagatttatcaagtgactcaaagtcacttttttcattgggtaaatgaaaaaaagccagatttaaaccagtcagaggactctagaatccactctcaagaaagggcaagtcctggccgggtgtggtggctcacccctgtaatcacagcactttgggaggccgaggtgggaggatcacatgaggccaggatttcaagagcagcctgggcaacatggtgaaaccccatctctactgaaaatacaaaaattagctgggtgtggtggcgcacacctatagtcccagctactcgggaggctgatgcaggagaatcgtttgaacccaggaggcggaggttgcagtgagctgagatcgtgccactgcactccagcctgggcaacagagcgagactccatctcaaaaaataataataataataaaataaagaaaaataaagggcaagtggtatggctttcatcattttactgacaagaaaactgaggctcaagcaggagaagcagatccacaccatagtgcctccccagaccctgccagacctttgcctttgcaccctgacacttgctcctggggttctggcaggtcatgggtggcaagaccaggcacctgaccaacaccctcacacaggcctttcggaccgaggcagctcgtgcttttttcctcagtgcgagacccaggactccacctcatctctgaatccccttaactgccccttccagcctaccattctgggaggaagaacccagccctggaacgtggctggaacgagggctcacagtcaccccagctcttccctcccctgggacccagatggccagacttgaccattcctgctttaagggattaactctgggtcaggcagggaaacagggcacatacaccagggctgatacacagggactcttgtgacatcgttaggaatgaaagattgttaggaactgtccccttgggctctagtactttgttttaatgttggaggatggggcttagcaaacctctcctcgcctgctgattgcctggggagccggccatgtggaaaagccccttttcctaggagttaagattctggggtttgagtcccatttgtgccagctgtgtggccttgggcaagtcacttctccctggtcttcagttatcctttctggaatctcccatgctgccttcttggtgaggttacagcgagaggctcatgagacccggatgtggcagcactctaaaccaggaagccaca
